United States Patent 11,098,302 (IDENTIFICATION OF POLYNUCLEOTIDES ASSOCIATED WITH A SAMPLE) - sequence listing, part 66

SEQ ID NO: 226577 - DNA, 712 bp, Homo sapiens
  misc_feature: GYAE6OF02FXV5D.44.56.F01.1.454.CMB.1.raw
  modified_base (461)..(461): a, c, t, g, unknown or other
  misc_feature (461)..(461): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagttttttagaaggtgtccagtgcgaggggcgacgtggcggaggtcggggggggggcttgggcacgagccgagggcggtctcgtgagactctcctgtgtagtctcgaggattcagtcttagtgtattatcacttggccttgggtccgtcagggcctccgaggggaagggtcgttggaggtggatcgtacttttcgtacagtaagtgtaaacgttagtgggtaggaagtaaaggagtacggccgcgtcgtggtaggaaaggggtagtaagttcgaacccgttcgtacgaaagggntacggtaacctccaaacgtggtaggttcggacccgttaatttaaccgaaaagttggaacgacctaaaccgtaggaaccgaaccccggtaaccgaaccaacggtaacgggtccgttacttaaacgtttaccgtacggacccggtccgaagggtcccgtaacggttacccggtacggggggtaacccgttacggtacggtacggtaccgttaaggtttacggtacttttacgggtttccggggggtaacccgg

SEQ ID NO: 226578 - DNA, 682 bp, Homo sapiens
  misc_feature: GYAE6OF02I3W72.44.56.F01.1.454.CMB.1.raw
tcagacagtatatacacgaccggtgctcgatttagcagacgtctgaacacacaaaggggggagaggagccccagccgtgagattcccaggagtttccacttggtgatcagcactgagcacagaccaccaacatggagttggctaatctgtatttccttgtagttttttagaaggtgtccagtgcgagggcgactggcggaggtcggggggggcttggcacgaggccgagggcggtctcgtgagctctcctgtgtagtctcgaggtattcgagtcttaagtgtattatcgacttggcctggggtcctcgaggctccgaggggtaagggcttggagtggatcgtactttcgcaggtaatgaaacgtttagtaggtaggaaagttaaaggagttacggccgtcgtacgtggtaggaaaggggtaatacgtttaccgaaccggtttcaacggtaaaggggacttacggaaccttacccgaaattggttcggttacggacccttaagtttaaaccgaaagttcggaaagcctaaaccgttggaaccgtaccccgaagaccgacgtaacggccgttactaagttacgcggccgccgaacggcgtaacgttcccggaggggtaacccttcgaagttccgacgttagtttaccggaagtttacgggttcgggacccgtagggtaaacccg

SEQ ID NO: 226579 - DNA, 574 bp, Homo sapiens
  misc_feature: GYAE6OF02IWYYC.44.56.F01.1.454.CMB.1.raw
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgattttccttgtagtttttttagaaggtgtccagtgcgaggggcgactggcggagtcgggggggggcttgggcacagccagggcggtctctgagactctcctgtgtagtctcaggattcagtcttagtgattatcacttggcctgggtccgtcaggctccgagggagggcttggagtggatcactttcgtcagaatgaaacgttntggtaggaagtaaagagtacgcgcgtctgtagaagggaanagttcaccgtntacgaagggatgactcaacngtgtggcctattacaatgagacaaccgtgacgacccgacgaccacgacggcgtactacttacgtcgccgccgacggcgacgtccgtgggtaccgtcgagttcgcgtacgtttggattaggttggggtacccgtagggggtaaccg

SEQ ID NO: 226580 - DNA, 665 bp, Homo sapiens
  misc_feature: GYAE6OF02IJY1I.44.56.F01.1.454.CMB.1.raw
  modified_base (283)..(283): a, c, t, g, unknown or other
  misc_feature (283)..(283): n is a, c, g, or t
  modified_base (424)..(424): a, c, t, g, unknown or other
  misc_feature (424)..(424): n is a, c, g, or t
tcagacagtatatacacgaccggtgctcgatttagcagacgtctgaacacgaacaaaggggctgggagaggacgccccagccgtgagattccccgaggagtttccacttggtgatcagcactgagcacagaccaccaaccatggagttgggctaatcttgattttccttgttagtttttttagaaggtgtccagtgcgaggggcgactgggcggaggtcgggggggggcttggccacgagccgagggcggtctcgtgagacctctcctgtgtagtctcgaggnttcagtcttagtgatttatctacttggccgtgggttccgtcgaggcctccgaggggaacggggcttggaggtggatcgtacgtttcgtacagaatgtaaacgtttgtggtaggaagtaaagagtacgccggacgtcgtagnggtaaggaagtattaccgaccgtctacgaagggtatacgactaccgaacgtagttggttacggacctaagttttaaccaaaagttcgaacgtaccaaaccgttggaaccgtacccccggagaaccaacggacggccgttactaacttaaccgtgccggtacccgagggtcccgaagttccccggtaggggacccgttacgagttcggcctaagttttcgatttacgggttcggggacccgg

SEQ ID NO: 226581 - DNA, 222 bp, Homo sapiens
  misc_feature: GYAE6OF02GVUY7.44.56.F01.1.454.CMB.1.raw
  modified_base (213)..(222): a, c, t, g, unknown or other
  misc_feature (213)..(222): n is a, c, g, or t
tcagacagtatatacacgaccggtgctcgatttagcagacgtctgaacacacaaagggaccacggtcaccgtctcctcagcttccaccaagggcccatcggtcttcccctggcgccctgctccaggagcacctctgggggcacagcggccctgggctgcctggtcaaggctacttcctatatactgtctgagcgggctggcaaggcgcatagnnnnnnnnnn

SEQ ID NO: 226582 - DNA, 635 bp, Homo sapiens
  misc_feature: GYAE6OF02GZVG4.44.56.F01.1.454.CMB.1.raw
tcagacagtatatacacgaccggtgctcgatttagcagacgtctgaacacacaaaggggggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcgggggggggcttggcacgagccgagggcggtctctgagactctcctgtgtagtctcaggattcagtcttagtgattatcacgttggcctgggtccgtcaggcctccggaggggaacggggtcttggagtggatccgtacttttcgtacagtaatagtaaaacgttagtaggtaggaaagtaaaggagtacggccgtcgtcgtggtaggaaagggaatacgttccgaaccgtctacgaagggagtcgaacctaccaacgtaggtcgttacggacctaagtttaacgaaagttgaacgacaaacccgtgacgacccgaacgacacgagcgtacttacttacgcgtccgcgaggccgacgtccggcgggtaccgtcgtacgtcgtacttagtttaggtacgttaggtttcggggaccgtaggggtaac

SEQ ID NO: 226583 - DNA, 704 bp, Homo sapiens
  misc_feature: GYAE6OF02I9CJH.44.56.F01.1.454.CMB.1.raw
  modified_base (427)..(427): a, c, t, g, unknown or other
  misc_feature (427)..(427): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggggcttgggcacgagccgaggggcggtctcgtgagactctcctgtgtagtctcaggattcgagtcttagtgattatcacttggcctgggtccgtcgaggctccgaggggaagggcttggagtgggatcgtactttcgtcagatagaacgttatggtaggaagtaaagagtacgcgcgtactggtagaagggagacgttcacccgtntacggaaagggtactcggaactacccgtaacgaggttcggttacggaccttaacgtttaaccgaaagttgaaaccgccgtaaacccgttagggaacccggtacccccggaaacggaacctaacccggtaaggggtcccgttaaccttaaacgtttacccgtaccgggcccggtacccgtaaccggggcccgttaaccgttcccggtacgggggtaaccgtccgggtaacttcggtacccgttaaggttttacggtagtttaccggttttacgggggg

SEQ ID NO: 226584 - DNA, 649 bp, Homo sapiens
  misc_feature: GYAE6OF02GIP0T.44.56.F01.1.454.CMB.1.raw
  modified_base (547)..(547): a, c, t, g, unknown or other
  misc_feature (547)..(547): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggggcttgggcacgagccgagggcggtctcgtgagactctcctgtgtagtctcaggattcagtcttagtgattatcacttggccttgggtccgtcgaggctccgagggaagggcttggagtggatcacgtttcgtacagaatgaaacgttatagggtagaaagtaaagacgtacgccgcgtctggtaggaagggagatccgacgtctacgaagggctgacctaccaacgtagtggttcggaccttaatttaacgaaagttcggaaacgtacctaaaccgtggaaccggaaccccgacgaaccaacgtacgggccgttactaagttaccgnggaccgtacccggaagggtacccgtacgttacccggtagggggacccgttcggaagttcggacttacgttttaggacgttttagggtttcgggggaacccgg

SEQ ID NO: 226585 - DNA, 775 bp, Homo sapiens
  misc_feature: GYAE6OF02IAL6R.44.56.F01.1.454.CMB.1.raw
tcagacagtatatacacgaccggtgctcgatttagcagacgtctgaacacacaaaggggggggtcacaagaggcagcgctctcgggacgtctccaccatggcctgggctctgctgctcctcactctcctgactcaggacacgagggacctgggcccaggtccgccctgactcagccagtcctcgtgtctgggtctccgtggaccaggtccgctccaccctctcctagcacgtaggaaactaactactgagttgttaacggaaaattacttaaccttggtcttacgttacggtaacaagtactaaccccgtaaaccggtaaaacccccctaacttcctttactttatacgtaacgtactaaagtaacggccggtacccgtcggtactacttttccacgtacgttaccgtcttcgtacgtacggtcctaccgtaagttccgaggaacctaaaccggacggttacccgttcggtttaacgtaacttttaacgtttccgtacgggtcccttaccgtcgtaccgtcggtaaccggtaacggtccgggaacccttaacgtttacttaacgtttcgacgttcgtaccttagtaagttcggttacgggtaccggttaccgttaagtttaacggttacggttttcgggtacccgttaccggggaccgggtaccgggaccgtcggtaaccggtcccgttacggtcgacgtaccggaccgaggtccctacccggtcccgtacggtccctacgtcccgtttacccggtcccacccgtttaccttacg

SEQ ID NO: 226586 - DNA, 786 bp, Homo sapiens
  misc_feature: GYAE6OF02F5FVX.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcgggggggggcttgggcacgagccgagggcggtctctgagactctcctgtgtagtctcaggattcagttcttagtgatttatctacgttggcccttggggtcccgtcgacgggccttccggaagggggtaacggggtcttagggaggtgggacttccgtacgttttccgtcgtaagtaaattacggtaaaacgtttagtaggggttaagggaaacggttaaaaggacggttaaccggacccggtacggttaccgttagggtaagggaaacggggtaacgtaacgtttacccgaacccggtttacgtaccggtaaaagggggtacttacggaacccttacccgtaaaacgtacgggtttacggttaccgggaaccctttaaagttttaaccaaaagttcggaacgtaccctaaaccgtcgggaaccgtaaccccggacgaaccacggtacgggtccttaccttaagttaccgtcgcccgtacccgagggtacctaaccgttcccgggtaggggtacccgttacggacttcgggacttaacggttttgaacggttttacgggtttcgggggacccg

SEQ ID NO: 226587 - DNA, 680 bp, Homo sapiens
  misc_feature: GYAE6OF02JE8X8.44.56.F01.1.454.CMB.1.raw
  modified_base (586)..(586): a, c, t, g, unknown or other
  misc_feature (586)..(586): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggttgtcctagtgcgagggcgacgtgggcggaggtcggggggggcttgggcgacgaggccagggtcggtctcgtggagacctcgtcctgtgtagtctcaggtattcagtcttagtcgattatcacttgggtcctgggttcccgtacaggtctaccgagggaagggcttggagtggatcgtactttcgcaagtaatacggtaaacgttgtaggtaggaaagttaaaagaggttaccggaccggtacgtcgttaggtacggaaaggggtaactagttaccgaaccggttcgtaacgaaaggggtaactaggtaacgtcccaaacgtgtacggttggacctaagtttaacaaagtgtaacgacaaacctggaacgaacccgagaccacgacgtacgtcgtaattaccgngaccgacgaggtaccgacttaccccggggattaacccggagtaccgtacgttacgtttacggtaacgtttggttaccgggggaccctaaggggg

SEQ ID NO: 226588 - DNA, 694 bp, Homo sapiens
  misc_feature: GYAE6OF02IWY3X.44.56.F01.1.454.CMB.1.raw
  modified_base (312)..(312): a, c, t, g, unknown or other
  misc_feature (312)..(312): n is a, c, g, or t
  modified_base (462)..(462): a, c, t, g, unknown or other
  misc_feature (462)..(462): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagttgggctaatcttgatttccttgttagttttttagaaggtgtccagtgcgaggggcgacgtgggcggaggtcggggggggcttggcacagccgagggcggtctcgtgacgactctcctagtgtagtctcgaggattcagttcttagtgattatctactggcctggtccctnacggcctcgagggacgggtctggacggtggtatctacgttcgtgaacgagtagtaaacgttgtaggtaacggtaaagtaaaggtagtaccggcgtaccgtcgttggtagggaaggtacgtacttccgaccgttcgacgggtaaaggggtntacccgggttaacccaccgtaacggttagggtttccgttacgggaaccctttaagttaaacgtaacggaggaactaaccgacgtaaccgtaaccgggaacccgtaagaaccgtaacgggtacgtaccgtacgttacacggcgtacccgagtaccgggtctaacggtccggtacgggaaccgtcgagttcccgagttacgtttcggaaacggtttcgggttaccgggaaccgg

SEQ ID NO: 226589 - DNA, 669 bp, Homo sapiens
  misc_feature: GYAE6OF02FPET0.44.56.F01.1.454.CMB.1.raw
tcagacagtatatacacgaccggtgctcgatttagcagacgtctgaacacacaaaagggggctctgggagaggagccccagccgtgagattccccaggagtttccacttggtgatcagcactgagcacagaccaccaaccatggagttgggctaatcttgattttccttgtagttttttagaagtgtccagtgcgagggcgacgtggcggaggtcgggggggggcttggcgacagccgagggcggtctcgtgagactctcctgtgtagtctcgaggattcagttcttagtgtattatctacgttggccgttgggtcccgtcgaggctaccggagggacggggtctttggagtggattctacgtttcgctagaagtagtaaacgttgtaggtaggaagtaaagacggtacgccgtcgttctaggtaggaaagggtagtagttccgaccgtctaacgaagggtatcgaactccaagtgtcggttcggactacgtttaacgaaagtgaactaccgaaaccgtgaaaccgacccgaacgaccgaacgacggtaccttaccgttaacgttaccgcggtacccgaccgtacgggtaccgtaaccgttccccgggtaggggtaacccgttacggattccggaccgtttagtttacgtagtttacggttacccgggg

SEQ ID NO: 226590 - DNA, 577 bp, Homo sapiens
  misc_feature: GYAE6OF02IF2JL.44.56.F01.1.454.CMB.1.raw
  modified_base (388)..(388): a, c, t, g, unknown or other
  misc_feature (388)..(388): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
tcagacagtatatacacgaccggtgctcgatttagcagacgtctgaacacacaaagggggggagaggagccccagccatgagattcccaggagtttccacttggtgatcagcactgagcacagaccaccaaccatggagtttgggctaatcttgattttccttgttagttttttagaaggttgtccagtgcgaggggcgactggcggaggtcgggggggggcttgggcacagccagggcggtctctgagactctcctgtgtagtctcaggattcagtcttagtgattatcacttggccttgggtcccgtcaggcctccgaggggtaagggcttggagtggactctacgtttcgactaagatgaaacgttgtgggtaggtaagtaaagngtacggccgcgttctagagaagggatatttccgaccgtntcgaaagggtntagactcaaacnggtgtggcctaattaacaaatgagacaactgaacgacccgagaccacgaggctactattacgngccgccaggccgtntcccggtaggacgtcgatcgactattgattaggttcgggaccgtaagggg

SEQ ID NO: 226591 - DNA, 746 bp, Homo sapiens
  misc_feature: GYAE6OF02HREXA.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtggcggaggtcgggggggggcttgggcacgagccaggggcggtctcgtgagactctcctgtgtagtctcgaggattcagtcttagtgtattatctacttggccgttgggtccgtcgaggccgtacccggggaaggggtcttaggaggttggattccgtacgttttcggtacgtaagtaattaggtaaaacgttgtagggtaggaaaggtaaagagtacgccggtcgtcgtaggtaggaagggtaatacgttccgacccggtactacggaaaggggtactacggaaccttaccgaaacgtagggttacgttacgggaacccttaaagttttaacccgaaaagtttcggaaaccgtacctaaaccgttaggaaccggtaacccccgaacggaaccaacggtacggtaccgttacgttaacgttaaccgtcggacccgaccgtaagggaccgtaacgttccccggttaaggggaacccgttaacggagttaccggacgtttaagttttcggtaaacgttttacggttaccgggggtaacccgg

SEQ ID NO: 226592 - DNA, 650 bp, Homo sapiens
  misc_feature: GYAE6OF02GSJW3.44.56.F01.1.454.CMB.1.raw
  modified_base (347)..(347): a, c, t, g, unknown or other
  misc_feature (347)..(347): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgattttccttgttagtttttttagaaggtgtccagtgcgaggggcactgggcggaggtcgggggggggcttgggcacgagccagggcggtctctgagactctcctgtgtagtctcaggattcagttcttagtgattatcacttggcctgggtcctcaggcctccgagggagggcttgagtggatctactttcgnagaatggtaaacgttatggtagaaagtaaagacgtacgccgtcgtcgtgtaggaaagggaagtacttccgacccgttactacgaaaggggtctcggaacctaccaaagtggttggtacggtaccctaagttttaacaaagttgacgacctaaccgtgaaccggacccgacgaaccacgtacggtccgtacttactttaaccgcggtccgacccgtagggccgtacctttccgggacggggaaccttcggaagttccggacttagtttggaacgtttagggtttcggggacccgaggggtaacc

SEQ ID NO: 226593 - DNA, 611 bp, Homo sapiens
  misc_feature: GYAE6OF02GDHEP.44.56.F01.1.454.CMB.1.raw
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
tcagacagtatatacacgaccggtgctcgatttagcagacgtctgaacacacaaaggggggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcgggggggggcttgggcacgagccgagggcggtctctgagactcctcctgtgtagtctcgaggattcagtcttagtgatttatcacttggcctgggtcccgtcaggcctccgaggggaacggggtcttggagtggatcactttcgnagaatgaaacgttnggtagaagtaaagngtacgcgcgtctgtagaagggaangtcaccgtcgtacgaaggatgactaccaacagtcgtggcctaatttacaaatcgagtaccaacgtgacgacccgagaaccacgacggcgtctaacgttactcggaccgccgtaacgggcgacgttcccggtaaggggtaccgttcggaatcggtacttaagtttcggaagtttacggtttcgggggtacccgaagggggtaacc

SEQ ID NO: 226594 - DNA, 873 bp, Homo sapiens
  misc_feature: GYAE6OF02IC2DP.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagttgggctaatcttgtattttccttgtagttttttagaaggtgtccagtgcgagggcgacgtggcggaggtcggggggggcttgggcacgagccgagggcggtctcgtggagctcgtccgtgtgtagtctcgaggtacttcgagttcttagtgtatttacgtctacgttcggtccgttcgggtccgtacgtaggtaccgttacccggaaggggtaacggggtccttaggtaggtacgggtaacttaccgttaaccgttttccgactaaggtaaacgttacggtaaaacggtttagttagggtaacgggtaaaagttaaacggtaacggttaacccgtccggtacgttacgttaggtaacggaaacgggtaaagtcgttacctaacggttctaaccggtaaaggggtactacggaaccgttaaccgaaacggttggttacggttaccgtaaccgttaaaggttttaaacccaaagttaccgtaaacgggtacctaaaacccggtggtaaacccggtaaccccgaaaccggtaacccgtaaacgtaccggggtaacctttacccgttaaaacgttaccggttaccgaaccccggtaacccgggtaacgggtacccgtaaaccggttacccccgggtaagggggttaaccccgttaacgtacgtttaaccggaaccctttaaccggttttacggtaaaccggtttacccgggtttaccgggggtaaacccccgggg

SEQ ID NO: 226595 - DNA, 721 bp, Homo sapiens
  misc_feature: GYAE6OF02JT9KM.44.56.F01.1.454.CMB.1.raw
tcagacagtatatacacgaccggtgctcgatttagcagacgtctgtcggcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtggggacggtccctggacgcttctccgtgtgcaggtccgtgtaggtacttccaccctttcacgtacctagtcggacagtcggccgtaccgtcgggtcccgacgacggcctccgaagggcgtaaggggcctaggggtagtcggggtacgactaacgttagtgtacgggttataggtagtacgggtaaaattaaacttaaaacgtacgttagtacgtaacgtaacgggtaacccttccggtaaacgggaacgggtcctaacgttacccgaaccgttagttaccccgtaaccgaaaggtaacgtaaaccttaaacgttacccgaaagaacccgtaccgacgtttaagtactccgtaaacgaactaaagttccggaaataccggtaccgtaagaaccggacccgggtaacgaacgggaccggtaacggtacgttcggttaacgttaacgtacggtcggttaaggaccgtaaggtacttattacggttaacg

SEQ ID NO: 226596 - DNA, 698 bp, Homo sapiens
  misc_feature: GYAE6OF02FVQS6.44.56.F01.1.454.CMB.1.raw
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgtattttccttgttagtttttttagaaggtgtccagtgcgaggggcgactggcgggagggtcggggggggggcttgggcacgagccgagggcggtctctgagactctcctgtgtagtctcgaggtattcagttcttagtgtattatctacgttggccgttggggtcccgtcgacggtcctccggaaggggacggggtcttggaggtgggacttcgtacgtttcgtactaagtaattaggtaaacgttagtaggtaggtaaaggtaaagacggtacggccgtcgtcgtaggttagggaaagggaagtacgttaccgaccggttctaaccgggaagggacttacggaacccttaccgaaacgtgggttacgttacggaccttaagttttaacaaagtcgaacgtacccaaccgtggaaccgtaacccggacgaaccaccggaggtacccgtattaacgttccgcggccgtacgacggcgtaacgtccgggtcgggactacggagtcggattaggttcgtagtttcgggtcgggaccgtagggtaacc

SEQ ID NO: 226597 - DNA, 595 bp, Homo sapiens
  misc_feature: GYAE6OF02FLGYV.44.56.F01.1.454.CMB.1.raw
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (476)..(476): a, c, t, g, unknown or other
  misc_feature (476)..(476): n is a, c, g, or t
  modified_base (513)..(513): a, c, t, g, unknown or other
  misc_feature (513)..(513): n is a, c, g, or t
tcagacagtatatacacgaccggtgctcgatttagcagacgtctgaacacacaaaagggggctctgggagaggagccccagccgtgagattcccaggagtttccacttggtgatcagcactgagcacagaccaccaaccatggagtttgggctaatcttgattttccttgttagtttttttagaaggttgtccagtgcggaggggcgactgggcgggaggtcggggggggggcttgggcacaggccgaggggcggtctctgagactctcctgtgtagtctcaggattcagttcttagtgatttatcacttggcctgggtccgtcaggtccgtcccggggaagggtcttggaggtggatcgtacgtttcgcagaattagaaacgtttagtggtaggtaagtaaagagtacgccgcgtctggngaagganactcgaccgtnacgaagggntgactacagngtgtgctattacaatganacactgacgaccgacgacacgagtcctatacttacgngccgaccgaggtccgaactccggtagggaccgttcgaagttcggacttaaggtttggaacgttttagggttacgggaccggg

SEQ ID NO: 226598 - DNA, 701 bp, Homo sapiens
  misc_feature: GYAE6OF02FW1XX.44.56.F01.1.454.CMB.1.raw
  modified_base (477)..(477): a, c, t, g, unknown or other
  misc_feature (477)..(477): n is a, c, g, or t
  modified_base (612)..(612): a, c, t, g, unknown or other
  misc_feature (612)..(612): n is a, c, g, or t
  modified_base (662)..(662): a, c, t, g, unknown or other
  misc_feature (662)..(662): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtatttccttgttagttttttagaggtgtcagtgcgaggggcgagtggcggaggtcggggggggggcttgggcacgaggtccgaggggccggtctcgtggacgtactctccgtggtgtagtctcgagggattcaggtacttagtgtattaatctacgttggccttggggtccgttcagggtccttaccggaggggaggggtcttggacggtggtatcgtactttcgtcgaagtaacgttagtaaacgttagtaggtaggtaagttaaaggacgttaacggccgtcgtgtggtagggaaagggtataacgttcgaacccggtntacgaacgggatagtcctaccgaacgtggtacgttacggacttaactttaacgaagttggaactacctaaaccggtcggaacccggtaacccgtaaccggtaacgaaccgacggccgttaacttacgtttaaccncgttaccggcaccgggacgttacctaccgggtacgggtaaccgttcgaancggtcgttaagtttccgattttaccggtggggaacccgg

SEQ ID NO: 226599 - DNA, 675 bp, Homo sapiens
  misc_feature: GYAE6OF02HKA6Y.44.56.F01.1.454.CMB.1.raw
  modified_base (273)..(273): a, c, t, g, unknown or other
  misc_feature (273)..(273): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaggtgtccagtgcgaggggcgactggcggagggtcgggggggggcttggcacgagccagggcggtctctgagactctcctgtgtagtctcgaggnttcagtcttagtgattatctacgttggccgttgggtcccgtcgacggtcctcccggagggggaacggggtctggaggtggatctacgttttcgacaggtaatggtaaacgttgtagggtaggtaaagtaaacggtaggtaccgccggtcgttacgtggtaggaaggggtaatacgttaccgaccgtctacggaaagggtctacggacctaccaacgtacggttgttacggccttaaattttaacgaaattcgggaagtacccgtaaaccgttcgaaccggtaaccccgaacgaaccgacggagggtcccttacgttaaacttaccgtgcccgaccgagggtacccgagttcccgtaggggccgtcgagttcgcgttagtttgagtttcggttcggggaaccg

SEQ ID NO: 226600 - DNA, 814 bp, Homo sapiens
  misc_feature: GYAE6OF02HYM5P.44.56.F01.1.454.CMB.1.raw
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgatttttccttgttagttttttagaaggttgtcctagtgcggaggggcgacgtgggcgggaggggtcgggggggggtcttgggaccacgaggcccgaggggtcggtctcgtaggacgtactcttccgtgtcgtagtctcgtaggtactttacgagttcgtttacggngtattttaacncgttaccgttcgggtcccgttcgggttccccggtcgacggggtacctaccgggtaaggggggaacggggttccttagggaggttacgggtattaccgttacgtttcggacgtaagtaaagttacggtaaacggtttaggtacgggtaagggtaaagtaaacgggtcgtaccggccgggtactttacggtgggtaaagggaaaggggtaactaacgtttcccggaaccgttacgtaccgggtaaagggtctaaggacccttaacgaacgttagggttcgtaacggtacccttaagtttaaacgaagttcggaaacgttacccaaccgtggaacccggtaaacccgacgtaacgaaccggtcggtacttacgtaacgttacgcgacccggacggtcggtaacctcggttcccggtaacggggtaacctccggtagttacgtaccgtttaagtttaggttacgtttaccgggttacggggg

SEQ ID NO: 226601 - DNA, 754 bp, Homo sapiens
  misc_feature: GYAE6OF02GO0L5.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgatttttccgttgttagttttttagaaggttgtccagtgcgagggcgacgtggcggaggtcgggggggggcttggcacgagccgagggcggtctcgtggacgacttcctcgtgtagtagtctcaggtatctagtcttagtgtattatctacgttggccgttgggtccgtgacggtctccggaaggggacgggtctggaggtcggtattctaccgtttcgacgaagtaacgtagtaaacgtttgtaggtaaggtaaagtaaaggtcgtaacggccggtacgtcgtaggagggtaaagggaacttaattaccggacccgtacgtaacggaagggtactacgaacctaccgaaatcgggttacgttccgggacttaaagttttaaccgaaagtttcgggaaactcccgtaaaaccggttagaaccccggaaacccgacgaacccgtaacgaccgggttaacgttacccgttaacggtttaaccgcgggaacccggttccgaacggggtccctaaacgggttcccggtacggggtaccgttaacggtcttaaccggtctttaaaggttacccggttaagttttacgggtacccggggtaacgg

SEQ ID NO: 226602 - DNA, 720 bp, Homo sapiens
  misc_feature: GYAE6OF02IX1HP.44.56.F01.1.454.CMB.1.raw
  modified_base (273)..(273): a, c, t, g, unknown or other
  misc_feature (273)..(273): n is a, c, g, or t
  modified_base (569)..(569): a, c, t, g, unknown or other
  misc_feature (569)..(569): n is a, c, g, or t
tcagacagtatatacacgaccggtgctcgatttagcagacgtctgtcggcgggggggattcccagctgtttctgcttgctgatcaggactgcacacagagaactcaccatggagtttggctgagcttgggttttccttgttgcttaattttaaaggtgtccagtgtgaggtgcaggtgatggtaagtttgggggacgtcgtaggttccgggccgggggccctaagctctcgtgtctcgtcctcgtacgaccctaccttagctagctacgtggntcgtctacgtcgggtccgaccaagtccctaccgaagggtaacgggccttggagttggtaccgggtctaccgtaacgttaacgttaaaccaccggtagtcggtaacctaacgtctaacgttacggttacctacgaggaccgtccggttaggaaccgggtacgtacttcgaactttcgaacttcgtccgaaagtacgaactaagtaccggtaaaccgaaaacggtacggttaagttaacttaaaccgaaagttacgaaagtacgttaacgtaaaggtacgtaacgaggaccgaacgtntacgtacttaatcggttgagtacgtacgtacttagtacgttagttaccgtaggttaagggggtatttaccggttacggttcgacccgtaggtaccgacggggtcgttaaccggtacgttcggcgtttaccggctaccgtcgtacgtacccg

SEQ ID NO: 226603 - DNA, 669 bp, Homo sapiens
  misc_feature: GYAE6OF02FU4JK.44.56.F01.1.454.CMB.1.raw
  modified_base (382)..(382): a, c, t, g, unknown or other
  misc_feature (382)..(382): n is a, c, g, or t
  modified_base (481)..(481): a, c, t, g, unknown or other
  misc_feature (481)..(481): n is a, c, g, or t
  modified_base (594)..(594): a, c, t, g, unknown or other
  misc_feature (594)..(594): n is a, c, g, or t
tcagacagtatatacacgaccggtgctcgatttagcagacgtctgaacacacaaagggggctctgggagaggagccccagccgtgagattccccaggagtttccacttggtgatcagcactgagcacagacccaccaaccatggagtttgggctaatcttgtattttccttgtagttttttagaaggtgtccagtgcgagggcgactggcggaggtcgggggggggcttggcacgacggccgagggccggtctcgtgagactctcctgtgtagtctcaggtacttcagttcttagtgtattatctacttcggtccgtgggttaccccgtgacggtcctccggaggggaacggggtctttaggagtggtatctacgtttcganagtaagtagaaacgttgtaggtaggaaagtaaaggtacgtaaccggccgtacgtcgtaggtggaaagggactacttacgtaccgtcgtaacgaagggtntcggaacctaccgaaacgtggttgttacggtaccctaatttaaccgaaatcggacaacgtaaccttcggaaacgaccccggtaacgacacgaacggtcctaacttattaccgngacccgtgacggtcgagttcccggaggacctacggtactacggtacgttatttggacggtttgttaacccggggg

SEQ ID NO: 226604 - DNA, 626 bp, Homo sapiens
  misc_feature: GYAE6OF02ITP0H.44.56.F01.1.454.CMB.1.raw
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
tcagacagtatatacacgaccggtgctcgatttagcagacgtctgaacacacaaagggggctctgggagaggagccccagcccgtgagattcccaggagtttccacttggtgatcagcactgagcacagacccaccaaccatggagtttgggctaatcttgattttccttgtagttttttagaaggttgtccagtgcgaggggcgacgtggcggaggtcgggggggggcttggcacagccgagggcggtctcgtgagactctcctgtgtagtctcaggtattcagtcttagtgacttatcacttggcctgggtcccgtcgaggtctccgaggggagggnttggagtggatcattcgtcagatgtaacgttntggtagaagtaagngtacgcgtgtctggagaagggacnttacgaccgtctacgaagggtctagacctaccaacgtaggtgttacggaccctaagtttaaccaaagttcgaacgtaccgaaccgtggaaccggtaccccgaacgaacctacgacgggtaccgtcgttaaatcgtacggcccacgacgggtaccgtaccttccgtggggaaccttcggtaatccggacttagtttacgacttttacgggtaccgggg

SEQ ID NO: 226605 - DNA, 895 bp, Homo sapiens
  misc_feature: GYAE6OF02F9XHY.44.56.F01.1.454.CMB.1.raw
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgtattttccttgttagttttttagaaggtgtccagtgcgaggggcgacgtggcggagggtcggggggggcttggcacgagccgagggcggtctcgtgacgactctcctgtgtagtctcgaggtattcagttcttagtgtatttatcctacgtttcggccttacggggttcccgtcgtacgggtccttacccggaaggggggaacgggggtccctttagggaagggttacgggtattacccgtacgtttttccggacgaaggtaacgttacggtaaaacggttttagtacggggtaaggggtaaaaaggtttaaacgggaacggttaacccggcccggtaccgggtttacgtcgggttaaagggaaaacgggggtaagtacgtttacccgaaccggtttaccgtcggaaaaggggtcttacggaccccttacccgaaaaggttcggttagggttacggaacccttaacgttttaacgaaacgtgggtaaccgtaacctaaacccgttgggaaaccccggacccccgggtaaacgaaccgtaaccggaacgggggttacccttaacgttaaaccgtttaccgtacggtacccgggaaccccgttagggggacccgttaaccgttaccccgggggttggggttaacccgtaaccggggttataccgggtaaccgtttaggtttttacggaaaggtttttaacccggggttttcggggggaaccccgttaaggggggttaaacccg

SEQ ID NO: 226606 - DNA, 791 bp, Homo sapiens
  misc_feature: GYAE6OF02G2UQ8.44.56.F01.1.454.CMB.1.raw
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
tcagacagtatatacacgaccggtgctcgatttagcagacgtctgaacacacaaaggggggagaggagccccagccgtgagattcccaggagtttccacttggtgatcagcactgagcacagaccaccaaccatggagtttgggctaatcttagattttccttgtagtttttttagaaggtgtccagtgcgagggcgacgtggcggaggtcggggggggccttgggcacagccagggcgtcctcgtgacgactctcctgtgtagtcctanaggtattcagttctttagngtattactcgtacttcggccgttgggtccgtcgtacggtccgttcccggaaggggtacgggggtaccttagggtaggttcggaaactttccgtaacgttttcccggactaagggttaaacgtaccggttaaaacggttacgttagggtaaggggtaaaaccgtttaaaggacgggtttaaccggacccggtcggtacgttacggtacggtaaaaggggacgtaacgtttccgaacccgttccgtaacgtaaacgggtactacggaccctaccgaaaccgtagggtcgttacggaacccttaagtttaaccgaaattcggaacgaccgtaaacccgttgaaacccggaacccgtaaccggaacccacgggacgttacccggtattaaccgttactccggaccgaccgtacggccgttaccgtcccggttcggggtacgtcctaaggttagtcccgtaaattttcggaacgttaacggttttacggggccggagggtaaacccg

SEQ ID NO: 226607 - DNA, 233 bp, Homo sapiens
  misc_feature: GYAE6OF02FU0JG.44.56.F01.1.454.CMB.1.raw
  modified_base (216)..(233): a, c, t, g, unknown or other
  misc_feature (216)..(233): n is a, c, g, or t
tcagacagtatatacacgaccggtgctcgatttagcagacgtctgaacacacaaagggaccatggtcaccgtctcctcagcttccaccaagggcccatcggtcttccccctggcgccctgctccaggagcacctcgtgggggcacagcggccctgggctgcctggtcaaggactacttcctatatactgtctgagcgggctggcaaggcgcatagnnnnnnnnnnnnnnnnnn

SEQ ID NO: 226608 - DNA, 677 bp, Homo sapiens
  misc_feature: GYAE6OF02GGTT9.44.56.F01.1.454.CMB.1.raw
  modified_base (281)..(281): a, c, t, g, unknown or other
  misc_feature (281)..(281): n is a, c, g, or t
tcagacagtatatacacgaccggtgctcgatttagcagacgtctgtcggcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcgggccgggggggcccctaagactctcctgtctcgtctctgaacccacctttagcagctactggatgcacgtgggtccnccaagcctaccgaggaaacgggcctgagtgtgggtctacacgtattacgaccgagtcgggactagtcacttggttacctcaggacgccggtaggaacgggcctaagttcagtcactctaccgagacgactaatcgtaacgaaacgtacgtataatttaacaaatcgaaactagtactaaaggcggtacgaacggtaacgacggtcttagtactacgtagttggtgtacgtagttacccttagttacgttatttaccgacggttttagggggatttacgttaccgggtttaccgggacccctaacggtaaccgggttcgggggaacccgtaacggggttacccgtttcggggttacccgttccggttacccttcccggttacctaccggttaccccg

SEQ ID NO: 226609 - DNA, 671 bp, Homo sapiens
  misc_feature: GYAE6OF02HLHV5.44.56.F01.1.454.CMB.1.raw
  modified_base (396)..(396): a, c, t, g, unknown or other
  misc_feature (396)..(396): n is a, c, g, or t
tcagacagtatatacacgaccggtgctcgatttagcagacgtctgtcggcgggggggattcccagctgtttctgcttgctgatcacggactgcacacagagaactcaccatggagtttgggctgagcttcgggtttccttgttgacttagttttaaaaggtgtccagtgtgaggtgcaggtgatggaacgtttgggggacgcctaggttccgggcccggggggacccctaaggcctcgtcctggtcctcgtcctacgtcgaaaccctactttagcacgtacttacgtcggatcgactacgtgggtccctacgaagcttaccgaagggaaacggcctagactggtacggtactacgtacgttaacttaacgaccgagtcggactagtcactggtacngacgcgccgtaggaggtcctaatcatcgactctcgaagacaacgtaatcgaacgaaaacgcgttagtaacttaaactaaagtcgaaacgtaacgtacgtaaagagttacggaacgtaccgacggtacttagtaccgtaactacgttcgtagtaggtacgtacccgttagtacttgtttaccgaggttgggtagttacgtcggttacggcctaacgcggtcgggtaccgacggttaaccgttcggtaccgtccgttcttccctacgtacgtacccg

SEQ ID NO: 226610 - DNA, 750 bp, Homo sapiens
  misc_feature: GYAE6OF02HVJDY.44.56.F01.1.454.CMB.1.raw
  modified_base (611)..(611): a, c, t, g, unknown or other
  misc_feature (611)..(611): n is a, c, g, or t
tcagacagtatatacacgaccggtgctcgatttagcagacgtctgaacacacaaagggggctctgggagaggagccccagcccgtgagattcccaggagtttccacttggtgatcagcactgagcacagaccaccaaccatggagttgggactaatcttgtacttttccttgttagttttttagaggtgtccagtgcggaggggcgacgtgggcgggaggggtcgggggggggcttggcacgagccgaggggccggtcgtcgtgacgtaccttctccgtgttgtacgttctacgaggtattcgaggttcttaggtgtattatctacgttggccgttcgggttcccgtacgacggtccgtaccggagggggacgggtcgttaggaggtggtatccgtacgtttcggactaagtaagttacggtaaacgttgtagggtaaggtaaaggtaagacggtacggtccgtagttccgtagggtacggaagggtaattacgttaccgacccggttcgtaacgggaaagggtccttaaggacccttaaccggaaagttagggttcggtacgtaacctttaaagttaacgaaaggttaccgaactaacccgtaaaccggnggaaacccggtacccgaacgaaccgacggtacgtaccgttacttaacgtcgtacgcccgacggtacggccgtaacggttcccgggtggaaccgttgaacttccggactttagggtttactacgggtttgggtacccggg

SEQ ID NO: 226611 - DNA, 740 bp, Homo sapiens
  misc_feature: GYAE6OF02I5U6W.44.56.F01.1.454.CMB.1.raw
  modified_base (484)..(484): a, c, t, g, unknown or other
  misc_feature (484)..(484): n is a, c, g, or t
tcagacagtatatacacgaccggtgctcgatttagcagacgtctgaacgacacaaagggggctctgggagaggagccccagccgtgagattcccaggagtttccacttggtgatcagcactgagcacagaccaccaaccatggagttgggctaatcttgattttccttgttagttttttagaaggtgtccagtgcgaggggcgacgtggcggaggtcgggggggggcttgggcgacgagccgagggcggtctcgtgagactctctgtgtagtctcaggtattcgagtcttagtgtattatctacgttcggtcccgttggggtcccgtcgtaggtcctacccggaaggggacgggtcgttggaggtggtactccgtacgtttcgacgtagaactacggtaaacgttagtagggtaggtaaaagtaaggacgtaccggaccgtacgtacgtaggtaggaaacgggaagtacgttaccgaaccgttnaaccggaagggggtacttacggaaccttaaccgaaacgtaggtttaccgtagggaccccttaaatttaacgaaacgtgtaaaccgacccgtaaccgtcgggaaacccggtaccccggaacgtaaccggaccgtaccggggtaccttacttaacgttaccgccgtaccgtaccggaacgggtccgtaaccgtcccgggtacgggacgttacggacttacggtccggttaactttcggtaacgttcgggttacggggg

SEQ ID NO: 226612 - DNA, 768 bp, Homo sapiens
  misc_feature: GYAE6OF02GTJ6H.44.56.F01.1.454.CMB.1.raw
  modified_base (268)..(268): a, c, t, g, unknown or other
  misc_feature (268)..(268): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgtattttccttgtagtttttttagaaggtgtccagtgcgaggggcactgggcggaggtcgggggggggcttggcacgagccgagggcggtctcgtgagctctcctgtgtagtctnaggattcagttcttagtgattatcactttggccttggggtcctcgacggtcctccgagggggaagggtctttaggacggtggagtcctacgttttcgtactagaagttaggaaaacggttttctagggttagggtaaagtaaaaggtacgttaaccggcccggtaccggttacgttagggttacgggaaaagggggtaaggtaacgtttaccgaaccccggttactaccggtaaaacggggattgggaaacccgttaccccgaaagttacgggtttagggttaccgggtaacccttaaacgtttttaacgaaaacgtttggaacgtacccgtaaacccgttgaacccggtaacccgaaccggacccaacgacggtaccggtacttactttaaacgccgaccggtacccgacgggccgtacttacccggtggggaccgttccggaatccggacttaagtttccggaaactttgggtttaccgggacccggttaggggaacc

SEQ ID NO: 226613 - DNA, 745 bp, Homo sapiens
  misc_feature: GYAE6OF02FZS7H.44.56.F01.1.454.CMB.1.raw
  modified_base (196)..(196): a, c, t, g, unknown or other
  misc_feature (196)..(196): n is a, c, g, or t
  modified_base (624)..(624): a, c, t, g, unknown or other
  misc_feature (624)..(624): n is a, c, g, or t
tcagacagtatatacacgaccggtgctcgatttagcagacgtctgtcggcgggggattcccagctgtttctgcttgctgatcaggactgcacacagagaactcaccatggagttgggctgagctcgggttttccttgttgctattttaaaggtgtccagtgtggagtgacaggtgagtcggtaagtttgggggacnccgtggttccgggcccggggggcccctaaggtactccgtccgtacgtcctcgtcctcgtacgaacccctacttacgcacgtactaccgtaggtctgccgtacgtccgggtccctacgaacgtccgtacgtaagggtaaacggccctagaagtggttacggtctccgtaacgtaacgttaaccgccggtagttacgggacctaagttccggtaaccgttagggtttaccgtaccgaacggtaccggtacccggtagggttaaacccgggccggtttaacttccgaaacgtttcccgacgtttaccgacgtacggtaacgaacggtaactagggttaacccgaaagtacggttaagtttaacgtaactaagtaacggactacgtacgtaaggacgacggaagtacgcgacgttgtactacgttatcggtnacgtacgtatagtgtacgttccgttaggttgggtacgttgttacggttccgacccgttacgacggtccgggtacggtccgtacgtttccggttcggtccgttccgtccgttccagtccccg

SEQ ID NO: 226614 - DNA, 659 bp, Homo sapiens
  misc_feature: GYAE6OF02I70S8.44.56.F01.1.454.CMB.1.raw
  modified_base (279)..(279): a, c, t, g, unknown or other
  misc_feature (279)..(279): n is a, c, g, or t
  modified_base (399)..(399): a, c, t, g, unknown or other
  misc_feature (399)..(399): n is a, c, g, or t
tcagacagtatatacacgaccggtgctcgatttagcagacgtctgaacacacaaaggggctgggagaggagccccagccgtgagattccccaggagtttccacttggtgatcagcactgagcacagaccaccaaccatggagtttgggctaatcttgattttccttgttagttttttagaaggttgtccagtgcggaggggcgacgtggcggaggtcgggggggggcttggcacagccgagggcggtctagtgagacctctcctgtgtagtctcgagtnttcagtcttagtgtattatcgattggcctgggtccgtcgaggcgtccggaggggacgggtctggagtggatcgtcttcgcagaagtagaacgttgtggtaggaagtaaggagtacggccngtctgtagaggtatattccgaccgtcgtacgaagggtactacgactacgaacgtgttaggtacggaccttaagtttaacaaatggaactacccgtaaacgttggaaaccgtaccccgtaacgaccacgacgggttaccgttaacgttacgttaccgagcccgtaccggaacgggtcgtaaccgttaccggttagggggacccgttaggacggttacgtacgttaacgtttagtacgggtttagggttccgggtaaccggg

SEQ ID NO: 226615 - DNA, 676 bp, Homo sapiens
  misc_feature: GYAE6OF02FOL5D.44.56.F01.1.454.CMB.1.raw
  modified_base (276)..(276): a, c, t, g, unknown or other
  misc_feature (276)..(276): n is a, c, g, or t
  modified_base (568)..(568): a, c, t, g, unknown or other
  misc_feature (568)..(568): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagttgggctaatcttgattttccttgttagttttttagaaggtgtccagtgcggagggcgactgggcggaggtcggggggggcttggcacgaggccgagggccggtctcgtgagactctccgtgtgtatctcaggtntcagtcttagtgatttatcacttggccttggggtcctcgaggcctacggaggggagggtccttggaggtggattcctacgttttcgtacaagtaacgtaggtaaacgtttagtcgggtaaggtaagtaaacggtgtaccgacggtcgttcgtgtaggaacgggtatagttaccacgtcgacgaaggactgactaccagtcggtgtacggacttaatttaacaagtacgacgaccaaccgttgaaccgacccgtaagaaccctacgggacgtaccggtacttacgttacccgnggacccgaccgacgggtccgtaacttccccgggtaaggggaccgttacggacggttacgtacctttagggttttagaaccggtttttaggtacccgggggtaacgggg

SEQ ID NO: 226616 - DNA, 788 bp, Homo sapiens
  misc_feature: GYAE6OF02ISGPR.44.56.F01.1.454.CMB.1.raw
tcagacagtatatacacgaccggtgctcgatttagcagacgtctgaacgacacaaaggggctctgggagaggagccccagccgtgagattcccaggagtttccacttggtgatcagcactgagcacagaccaccaaccatggagtttgggctaatcgttgtatttttccttgttagttttttagaggtgtccagtgcgagggcgagtggcggaggtcggggggggcttggcacgagccgagggccggtctcgtggacgactcgtccgtagtgtagtctacgtaggatttcagttcgttagtgtattatctacgttcggaccgttggggttacccgtacgacggtccgtaccgaaggggaacgggtctttggaagtcggattccgtacgttttcgacgtaagtaagttaggtaaacgttagtagggtaacggtaaagtaaaaggtacgtaaccggaccgtacggtacgtaggtaggtaaaggggtaaacgtacgttttacccgaaaccggtttacgtaacggtaaaagggcgttacggtaaccctacccgtaaacgttaacgggttcggtttaaccggaaccctttaaagtttaaacccgaaaggttcggtaaacggtccctaaaacggtcggaaacccgaaacccccggtagaacccgaacggttaacggggtcccttagtttaaacgttccgttaccggccgtacccgtagggaccgtaacccgttcgggacgggtaaccgttgaaccgttcggtacttaggtttacgtaggttacggttaccgggg

SEQ ID NO: 226617 - DNA, 830 bp, Homo sapiens
  misc_feature: GYAE6OF02I8DI8.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttggcacgagccagggcggtctcgtggacgactcctccgtgtgtagtctcgaggtattcgagttccttagttgtatttatctacgtttcggccgttggggtcccgtcgagggcccttaccggaacgggggtaacgggggtcttacggacgggttgggtaattccgtacttttccggtaccgtaaggtaagttaggtaaacggtttataggggtaagggtaaacggttaaaaggacggttaccggaccggtcgtttaccgtggtaacgggtaaagggtaacggtactttacccggaacccggttaccgtacgggaaacgggtacgtacggaaacccttaccgtaaaacgttgggttccggtttaacgcccgtttaaattttaaacccggaaatttgggaaccgttaaccctaaaccgttcggaaaccgggaaccccgtaaacggacccaacgggtacccgggtaccgtttaacttaaaccgttttaccgacggtacccggtacccgaggggtaccgtaaccggttcccgggtaagggggtaccccgttacggtaagttcccgtacgtttagtttaccggagttttacggggttcggggtaaacccggg

SEQ ID NO: 226618 - DNA, 791 bp, Homo sapiens
  misc_feature: GYAE6OF02JXZHQ.44.56.F01.1.454.CMB.1.raw
  modified_base (181)..(181): a, c, t, g, unknown or other
  misc_feature (181)..(181): n is a, c, g, or t
  modified_base (715)..(715): a, c, t, g, unknown or other
  misc_feature (715)..(715): n is a, c, g, or t
tcagacagtatatacacgaccggtgctcgatttagcagacgtctgaacacacaaagggctgggagaggagccccagccgtgagattcccaggagtttccacttggtgatcagcactgagcacagaccaccaaccatggtagttggctaatcttgtatttcttgttagtttttagagtgtcngtgcgtagggcgacgtggcggtaggtcgggggggctggcgtacgagcgagggcgtctcgtagacgactccgtccgtgtggtagtcctacgaggtctttacgacggttcttaggtgtacttagtcctaggttccggaccggttggttaccggtcgaacggtccgtaccgggtaacggggaacggggtccttgggagggttacgggtacttcgtacgtttcgacggtaaacgtagttacggtaaaacggtttaggtagggtaaccgggtaaagttaaaggacggttaaacccggtccggtaccggttacggtaggttaacggtaaacggggtaacttacgttaccgtaagttcccggttacgtaaaccgggtaaggggtaacgtaaccggttaccgtaaacccgtaaacgggtacggtttaggtacccgggtaaccctttaaggttaaacgtacggaaacggtaaccggtcgtaaacccgtcggaaaccgtacccgaacggtaacccgacgtaacgggtacgtaccgtagtaccgngtacccgtcgacggtcgtaccttacgggacggttacgaccgtagccggtaattcgtagttaccggtaggtaacggg

SEQ ID NO: 226619 - DNA, 636 bp, Homo sapiens
  misc_feature: GYAE6OF02GMX27.44.56.F01.1.454.CMB.1.raw
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (496)..(496): a, c, t, g, unknown or other
  misc_feature (496)..(496): n is a, c, g, or t
tcagacagtatatacacgaccggtgctcgatttagcagacgtctgaacacaccaaagggggggagaggagccccagccgtgagattcccgaggagtttccacttggtgatcagcactgagcacagaccaccaaccatggagttgggctaatcttgattttccttgtagtttttttagaaggtgtccagtgcgaggggcgacgtggcggaggtcggggggggcttggcacaggccagggcggtctcgtgagacctcgtcctggtgtagtctcgaggtacttcgagtcttaggtcgatttactcacttggcctgggtcccgtcaggctccgagggacgggtcttggagtggatctacgtttcgcagatgaaagtgtggtaggaagtaaagngtaccgcgaccgtntgtaggaacgggtaagcttaccacgtctacgaaggggatggacctacaacgtgtgttacggacctaagtttacaaagtgaacgctaaaccgtnaaccggacccgaagaacccacgacggtaccgttactacttacgcggacgcccgaaggccgtacgtcccggtagggaccggtacggacttcggcttaagtttcgtaacgttacggtttacggggacccgtaagggtaaccg

SEQ ID NO: 226620 - DNA, 638 bp, Homo sapiens
  misc_feature: GYAE6OF02F3IY1.44.56.F01.1.454.CMB.1.raw
  modified_base (473)..(473): a, c, t, g, unknown or other
  misc_feature (473)..(473): n is a, c, g, or t
  modified_base (513)..(513): a, c, t, g, unknown or other
  misc_feature (513)..(513): n is a, c, g, or t
tcagacagtatatacacgaccggtgctcgatttagcagacgtctgaacacacaaagggggggagaggagccccagccgtgagattcccaggagtttccacttggtgatcagcactgagcacagaccaccaaccatggagtttgggctaatcttgattttccttgttagtttttttagaaggtgtccagtgcgaggggcgactgggcggaggtcggggggggcttggcacgagccgagggcgtctctgagactctcctgtgtatctagaggattcgagttcttagtgtattatctacgttggccgttgggtccgtcaggtcctacccggagggggtaacgggtcgttaggaggtggtacgtcctaacgttttccgtacaggtaattacggtaaaacgtttagtagggtaagggaaacggtaaaagtagtaccggccggtacgtccgtggtaggaaagggatacgttcaaccgtnaccgaaggctagactacgaagtagtgttacgactatttanaagtgaacgcaacgtgacgacccgacaacacgacgcgtctagtacgtcgacgtaccacggtacgactccggtagggtacctcggaagtgtactagttcgagttaggttcgggaccgagggtaacg

SEQ ID NO: 226621 - DNA, 750 bp, Homo sapiens
  misc_feature: GYAE6OF02HGFXY.44.56.F01.1.454.CMB.1.raw
  modified_base (203)..(203): a, c, t, g, unknown or other
  misc_feature (203)..(203): n is a, c, g, or t
  modified_base (519)..(519): a, c, t, g, unknown or other
  misc_feature (519)..(519): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttcctgttagttttttagaggtgtcagtgcgagggcgacgtggnggagggtcgggggggggcttgggcacagccgaggggcgtctctgacgactctcctgtgtagtctcgaggattcagtcttagtgtattactctacttcgggtccttcggggtccgtacgagggtcctacccggaggggggtaacggggtccgtttggaaggtcggtagtccctacgttttccggtcgtaaggtaacttagggttaaaccgttggtaggggtagggaaagttaaagaacgggttaccggaccggtcgtcgtaggtacgggtaaaaggggaacgttacgttaccacccggttcgtaacgaaacggggtntacggaacctccgaaacgtaggttcggttacggaccgttaactttaaacgtaagtggtaacgccaaacgtcgaaccggaaacccggaccgaacgtaaccggacgggtccttacctttaacgtaccgtcgtcccggtacccgacgggcccgtaaccgtccgggttacggggaccgttacggatggttaaccgttggtttaacggtacggtttaggttcgggggtaaccccgg

SEQ ID NO: 226622 - DNA, 688 bp, Homo sapiens
  misc_feature: GYAE6OF02H9RBG.44.56.F01.1.454.CMB.1.raw
  modified_base (262)..(262): a, c, t, g, unknown or other
  misc_feature (262)..(262): n is a, c, g, or t
tcagacagtatatacacgaccggtgctcgatttagcagacgtctgaacacacaaagggggggggtcacaagaggcagcgctctcgggacgtctccaccatggcctgggctctgctgctcctcactctcctgactcaggacacagggacctgggcccagtccgccctgacctcagccagcctccgtgtctgggtctcctggacagtcgctcaccctctcctgcactggaactaatctgatgttaggaaatattacttgtactnttacgtaccaagtactaacccgaacggtaaaccccccaacttccttactttatcgtaaagtctaaagtaacgccggtccctcggactacgtttctcatccgtcttctcgacgtctccaagtctcgactaacctcggaccttcgttagtacttaattcgtacgggtcccttccgtcgtccctcgtaccggtacggacggtacctacgttacttagttaggtctcgtactactagtacgttcggtacggtacctaggtacgtttaggtttcgggttacggttcggggacgggtaaccggggtcccggtccgtacggtacccgttacgttaccggttacgaccggacccgtaaccggtccgtaccccggtccccgtacggttcccgtaccgttcccgttacccgttacccctacccctccgtttaaccc

SEQ ID NO: 226623 - DNA, 645 bp, Homo sapiens
  misc_feature: GYAE6OF02GES4H.44.56.F01.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
tcagacagtatatacacgaccggtgctcgatttagcagacgtctgaacacacaaaggggggggtcacaagaggcagcgctctcgggacgtctccaccgatggcctgggctctgctgctcctcactctcctgactcaggacacgagggacctgggcccagtccgccctgactcagccagcctcgtgtctgggtctccgtggacagtcgcctcaccctctcctgcactgaactatcngatgtagaaatntacttgtctntgacatacaccacgtaaccccatccttnttangatacatacgcgcctcggctattcnatcgcttcncagctacagtcgngacacgcggtctacgtntattacttcgtcgtacctcgtcgtactaggaccgcggacgtccgtaacttattctcgaccttgaccttacagttacgtcggtaccggttacctaggtacgttcggtttacgggtccgttacggggacgggtaccggggtacccgtaccgttaccgggtacccgttccgtacgggttccgaacccggtaccccggaaacgggtccccgtaccccgggttacccccgttacgggttacccctacccgtttcccggttccccggttccccccgtaccccgtttccttaaccccgg

SEQ ID NO: 226624 - DNA, 917 bp, Homo sapiens
  misc_feature: GYAE6OF02FKAMS.44.56.F01.1.454.CMB.1.raw
tcagacagtatatacacgaccggtgctcgatttagcagacgtctgaacacacaaagggggctctgggagaggagccccagccgtgagattcccaggacgtttccacttggtgatcagcactgagcacagaccaccaaccatggaggttgggctaatcttgattttccttgttaggtttttttagaaggttgtccgtagtggcggtaggggcgacgttgggcgggaggggttcggggggggggtctttgggacgacgtacgggccgagggggtccggttaccgtcgtacggacgtaccttccttccgtagttcgttacggtccttcgaggtacgttacgtacggttacgttaggttagtactttaacgtctaccggttcggtcccggttcggggttacccgttcgacggtcccgttaccggaagggggaacgggttccttagggacggtacgggtacttaccgtaccgttttccgagtaacggtaaacgttacggtaaacgtttaggttacgggttaaagggtaaaaggtaaaacgggtcgaacccgggtcggttaccggttaggttacgggtaaggggaaacgggtaacgttacggtttaccgtaacccggtaccgttaggaaacgggtattacgtaaaccgtacctaacggttacggttacggttacgtaaccgttaattttaaccggaaacgttagtaccgtaaccgtaaaccgttacgggaaacccggtaccccggaaacgtaaacccggtaaccggaaaccgggttccttaaaccgtttaacgttaaccggtccgtacccggtaccggtaacggtaacccgggtaacctcccggggttaaccgggtaccgttaagtaccggttacggtaacccgtttaggtttaccggttaagtttaccgggttaaccggggg

SEQ ID NO: 226625 - DNA, 734 bp, Homo sapiens
  misc_feature: GYAE6OF02J07LV.44.56.F01.1.454.CMB.1.raw
  modified_base (123)..(123): a, c, t, g, unknown or other
  misc_feature (123)..(123): n is a, c, g, or t
  modified_base (687)..(687): a, c, t, g, unknown or other
  misc_feature (687)..(687): n is a, c, g, or t
  modified_base (717)..(717): a, c, t, g, unknown or other
  misc_feature (717)..(717): n is a, c, g, or t
tcagacagtatatacacgaccggtgctcgatttagcagacgtctgaacacacaaagggggctctgggagaggagccccagccgtgagattcccaggagtttccacttggtgatcagcactgancacagaccaccaaccatggagtttcgggctaatcttgtacttttccttgttagttttttagaggttgtccagtgcgaggggcgacgtggcgggagggtcggggggggcttagggcagacgccgaggggcgtctctggagtctcgtcctgtcgtagtctacgaggtacttcgtagtcgttaggtagtattacgtactaccgttcgggtccgttcggggtcccgtacggtacggtccggtccggtaaggggtacggggtctagggtcgtaggactcgtacgtttcgtagaagtaagtacttaaacggtctaggggttaacgtaaagtaacgtaggtaacggaccggtacggttcgttacggtagggtaaacgggaacgttactaccgtacccgtcgtaacgaagggtactacgaccgttaacgaacgtacggtcggttagttaccctaaagtttaacgaaacgttgaccggtaaccgtaacggttacggaaccgggtaacccgtacgaacggtaccggtacgtaccgtacttacgtccaggtaccgacggtcggagtccgtccggnggtacccgaggttgtaaccgttgtacgttntacggttggttaccggg

SEQ ID NO: 226626 - DNA, 713 bp, Homo sapiens
  misc_feature: GYAE6OF02IQKEV.44.56.F01.1.454.CMB.1.raw
  modified_base (188)..(188): a, c, t, g, unknown or other
  misc_feature (188)..(188): n is a, c, g, or t
  modified_base (231)..(231): a, c, t, g, unknown or other
  misc_feature (231)..(231): n is a, c, g, or t
  modified_base (426)..(426): a, c, t, g, unknown or other
  misc_feature (426)..(426): n is a, c, g, or t
tcagacagtatatacacgaccggtgctcgatttagcagacgtctgaacacacaaagggggggagaggagccccagccgtgagattccccaggagtttccacttggtgatcagcactgagcacagaccaccaaccatggagtttgggctaatcttgattttcctgtagttttttagaaggtgtcagtgnggaggggcgacgtggcggagggtcgggggggggcttggcacgngccgagggcggtctctggacgactctccgtggtagtagtcctgaggtattccaggttccttagtggtaatttacttaccacttgggtccttggggtcccgtggaacggtccttccggaggggaacgggtcttaggacggtcggatcttaccgttcggctagtaagttaacgtaacgttgtaggcgtaaaggtaanacgggtacgacgtcggtactgtacggaaaggtacgattccgaaccgttcgtagaagggtaactagaacccgtacgaaccgtgttcggtacggtacctatttaaacgtaagtacgtacgacctaacgtagtaccggaaccgaccgaacgacgacgtaccgtactagttaacgtcgaccgaccgttacgggacgtacgtacccggttacgggaccggttaggtacccgtggtaacccgttaggttaccggtaacggtttacggtttacgggacccggtaggggtaaccg

SEQ ID NO: 226627 - DNA, 759 bp, Homo sapiens
  misc_feature: GYAE6OF02H17U7.44.56.F01.1.454.CMB.1.raw
tcagacagtatatacacgaccggtgctcgatttagcagacgtctgaacacacaaaggggctgggagaggagccccagccgtgagattcccaggagtttccacttggtgatcagcactgagcacacgaccaccaaccatggagtttggctaatcttgtattttccttgttagttttttagaaggtgtccagtgcgaggggcgagtgggcggtagggtcgggggggggcttggcacgaggccgagggtcggtctcgtgagtacctctctgtgtacgtctcgaggtacttcgtacgttcgttagtcgtattactactacgttcggtaccgttcgggttcccgtacgacggtccgtaccgggaagggggtacggggtctttcgggtaggtacggtacttccgtacgttttccggtacgagtaaacgttaggttaaaccggtttggtaggggtaacggtaaagtaaaggtacggtaccggtccggtacgtgtacggtagggtaaacgggtaatacgtttaccaccggttcgtaacggaaaggggttctagtaaccctaccgaaaccggtagttcgggttacgaaccttaatttaacgaaagttcgactaaccgaccgtacggaaccgaaccccggtacgaaccaaccggtggtacccttaataccgtttacggaccgaccgtaccgagggcccgtaagttacccgggaggtacgttaccgtatccggtaacttaggttaagtcgtttacgggtcgggtaaccgg

SEQ ID NO: 226628 - DNA, 877 bp, Homo sapiens
  misc_feature: GYAE6OF02HI4WS.44.56.F01.1.454.CMB.1.raw
tcagacagtatatacacgaccggtgctcgatttagcagacgtctgaacacacgaaagggggggagaggagccccagccgtgagattcccaggagtttccacttggtgatcagcactgagcacagaccaccaacatggagttggctatcttgtattttccttgttagtttttttagaaggttgtcctagtgcggaggggcgacgtgggcgggaggggtcgggggggggtcttgggcacgagccgagggccggtctcgtagacgacctctccgtgttgtacgtctcgaggtattctagttcgttagtgtattatctacgttggccgttcgggtccgtcgacggtccgtaccggaggggggtaacggggtcgtttacgggaggttcgggtactttccgttaacgttttccggtaccgtaagtaaacgttacggtaaaacgtttaggttaggggtaaaggtaaaaggtaaacggtacgggttaccggacccggtcggttacgtagggtaacgggaaaacggggtaacgtacgttacccggtacccggttacgtaaccgggtaaaggggttacgtaccggtaaaccccgttaaccgtaaaccccggtagggtttcgggttaccgggtaccttaaagttttaaaccgaaagttacggaccgtaacccgtaacgtacggtaaccggaacccggaccgtaaccgtaccggacggttaccgttaacgttaacgtttaccgccgggtaaccggtaccggtaacggtacccgggtaccgtttcccgggttaagggggtaccctttaccgggtagttaccggttacgttacggttttacggtaggttttaccgggggtttaccggggacccggtaacgggggtaaccgg

SEQ ID NO: 226629 - DNA, 760 bp, Homo sapiens
  misc_feature: GYAE6OF02GW3QA.44.56.F01.1.454.CMB.1.raw
  modified_base (310)..(310): a, c, t, g, unknown or other
  misc_feature (310)..(310): n is a, c, g, or t
tcagacagtatatacacgaccggtgctcgatttagcagacgtctgaacacacaaaggggctgggagaggagccccagccgtgagattcccaggagtttccacttggtgatcagcactgagcacagaccaccaacatggtagttggctaatcttgtattttcttgttagttttttagaggttgtcctagtgcggaggggcgacgtgggcgggaggggtcgggggggggcttgggcacgacggccgaggggtccggttctcgtggacgtacctccgttccgtggtgtagtcctcgagtattcagtcttagtntattatccgtagttcggccgttcgggtcccgtgacggtccgtaccggagggggacggtcgttggaggttgtacgtcgttactttcgggaactaggttaagtacggtaaacgtttaggtaggggttaaaggtaaacggtaaaaggttcggtaacccggtcccggtcgttaacgggttagggtaacgggaaacggggtaaacgtttcgtaacccggtaccggttacggtaaccgggaaaggggtacttacccgaaccgtaacccgtaaaggttccggttggtaacccggtacttaaacgtttacgaaagtcggaataaccctacgtacggaaccgaccccgtagaaccgacggtacgctttaaccgtactaccgggctccgacggacgtcgtccggtacggtcgggaacgtcgagtccgtattagtttaggtacgttagggtaccggaaggg

SEQ ID NO: 226630 - DNA, 871 bp, Homo sapiens
  misc_feature: GYAE6OF02HAV0H.44.56.F01.1.454.CMB.1.raw
  modified_base (740)..(740): a, c, t, g, unknown or other
  misc_feature (740)..(740): n is a, c, g, or t
tcagacagtatatacacgaccggtgctcgatttagcagacgtctgttcggtcgggggcccccaagccctcgggatttcccgagacttcgtttctgcttgctcgactcaggactgccacgacagagaacctctacctatggtagtttgggctgagtcttgggttttccttagttcgtacttaattttaaaaggtgtacccaggttgtggtacggtgccgtaggtagagttagggtaacgtttgggggacctaccgtaggttccgggggcccggggggtacccctaaggaccttcgttaccggttcgtcctacggtctaccgtacgtaacccctacgtttacgcgtaacgccttaacgttggattacgtaccgaacgttcgggtacccgacgtaaacgtccgttaaccgaaaggggttaaaccgggaccttacggacgttgggttacgggtaccttaaccgtaaaccggtttaaacgtaaccgaccgggtaagttaccggggtactttacacgttaaccggttagttaaccgaccgtacgaaccggttacgaggtaaccgtcggtaacttcgtaaccgtacgtacgtaccgtacccgtaaggtaacctaacgtaacgtacggttaaaccgtaaaacgttaccggttaagtttaacgttaaaagtaaacgtaacgtaaaccggtattaaaccggttaacggacggttaaccggagtaaccgtaccggagtttacgacgtttanaggttacgtgtacaagggtttaacctaacgttgttacgtttaccgtagggtttacggtacgtacgttacggttacgaccgttaagaccgggtacggtacgtaccggtacctacggttacccgaccgttccg

SEQ ID NO: 226631 - DNA, 844 bp, Homo sapiens
  misc_feature: GYAE6OF02HSRUU.44.56.F01.1.454.CMB.1.raw
  modified_base (223)..(223): a, c, t, g, unknown or other
  misc_feature (223)..(223): n is a, c, g, or t
  modified_base (280)..(280): a, c, t, g, unknown or other
  misc_feature (280)..(280): n is a, c, g, or t
  modified_base (316)..(316): a, c, t, g, unknown or other
  misc_feature (316)..(316): n is a, c, g, or t
  modified_base (343)..(343): a, c, t, g, unknown or other
  misc_feature (343)..(343): n is a, c, g, or t
tcagacagtatatacacgaccggtgctcgatttagcagacgtctgaacacacaaaggggctcgtgggagaggacgccccagccgtgagacgttcccaggagtttccgacttggtcgatacagcactgcgcacagaccaccaaccagtggacggttggactaagtcttgtactttctgtttaagtttttacgaaggtcgtacctaggtgtggacgggcgtacgngggaccgggagggtcggggggggcttggcgaccgaggccgacgggtccggtcttcgngtacggacctcttcgtgtacgtacgtccgtcaggtnttaacgtagttcgttaagtgactttanacgtcgtcgtcgtcggtccgtcgacgcgttaccgaagggaccgggtcttacggacggttacgggtactttaccgtacgtttaaccggttccggaaagttaaaccggtaagttaaaaccgggttaggtacggggttaagggtaaaacggtttaaaagggccggtaaaccggggtccccggtaagtttcgggaaggtttaagggaaaaccggacgtaacgttcggaccttcgtacgtaaccgtaagggtacaagtacccgtacgtaaattggtacggttgtactaagtttaaacaagttcgaagttaacccgtacggtacaaccggtaaccccacggtaacgtacccgggtacggttaccaactttaaccggtaccgttaacgggaccccggtttacgaaacccgggtcggttaacccgtaaccccggggttaacggttaacgggtcccccgttaaggtacccggtaaggtttttacgaaccgggtttagtttaaacgggggg

SEQ ID NO: 226632 - DNA, 802 bp, Homo sapiens
  misc_feature: GYAE6OF02JLFQC.44.56.F01.1.454.CMB.1.raw
tcagacagtatatacacgaccggtgctcgatttagcagacgtctgaacacacaaagggggctctgggagaggagccccagccgtgagattcccaggagtttccacttggtgatcagcactgagcacagaccaccaacatggagttgggactaatcttgtactttccttgttagtttttagaggttcgtccagtgcgaggggcgacgtgggcgggtacgggtcggggggggcttgggcacgacggccgagggaccggttctcgtcggacgtacctcctccgtggtcgttagtcctacgaggtattacgtacgttcgttaggtcgtacttactaccgtaccgttacggtcccgttacggggtccgtacgacggtaccggtacccggggtaagggtcgtttcggacggttacggtaccttccgtacgtttaccggtacgtaacggtaacgttacggtaaaacgtttcggttaaggggttaacggtaaaggtaaaccggtaacggtacccgggtacccgtacgggttacgttacgggtaagggaaacggggtaacgttaccgttacccggtaccgttacgtacggtaagggtacgtacggacctaacccgaagttccggtaggttaccgtaaccgttaattaacgtaagtacgaactaccgaacgtacgaccgtaacccgacggtaaccgaacgtacggtccttaagttacgtaccgtcgtaaccggcccgtaggacccgtaggtaccgttcgggaactccgtagtcggtactacggttaggaccgtttcgggtacggaacccggg

SEQ ID NO: 226633 - DNA, 855 bp, Homo sapiens
  misc_feature: GYAE6OF02GEO3N.44.56.F01.1.454.CMB.1.raw
tcagacagtatatacacgaccggtgctcgatttagcagacgtctgaacacacaaaggggctgggagaggagccccagccgtgagacttcccgaggagtttccacgttggtgatcagcactgagcacagaccaccaaccatggagttggctaatcttgattttccttgttagttttttagaggtgtccagtgcgaggggcgacgtggcggagggtcgggggggggcttgggcacgagccgagggcggtctctggacgactctcctggtgtacgtcgtacgaggtattcagttcttagtgtattatcacgttggccgtgggtcccgtagacggtcctccggaggggaacggggtcttaggaggtgggacttaccgtacgttttccgtacgaagtaacgtacggtaaacgtttaggtaggtaagggtaaagttaaaggacggttaccggcccggtacgttaccgttagggtaaggtaaaggggtaactacgtttaccgaccggttccgtttaacggaaaggggtactcgggtaaacccttaccgtaaaccggtagggtttacggttccgggaaccctttaagttttaaaccgaaagggtttccgaaacgtacccgtaaacccggttaacgggaacccgggtaacccccgaaacggtaaccctaacccgggtaacggggttcccgtttaaaccgttacgttttacccgacgggttaccccgggttacggaacggggtaccccggtttaggttaccccgggttaaggggggtaaccccgtttacgggaatttccggggtaaccttttaagggtttacggtaacggtttttaaccgggggtttcccgggggaaacccgggg

SEQ ID NO: 226634 - DNA, 627 bp, Homo sapiens
  misc_feature: GYAE6OF02JETHM.44.56.F01.1.454.CMB.1.raw
  modified_base (240)..(240): a, c, t, g, unknown or other
  misc_feature (240)..(240): n is a, c, g, or t
  modified_base (467)..(467): a, c, t, g, unknown or other
  misc_feature (467)..(467): n is a, c, g, or t
  modified_base (522)..(522): a, c, t, g, unknown or other
  misc_feature (522)..(522): n is a, c, g, or t
  modified_base (564)..(564): a, c, t, g, unknown or other
  misc_feature (564)..(564): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagttgggctaatcttgtattttccttgttagttttttagaggtgtcctagtgcggaggggcgacgtggcggagggtcgggggggggtcttgggcacgngccgagggtcggtcgtcgtagacgacctcgtccgtgtggtagtcctcgaggtattcgagtcttagtgtattagtctacgttggccgtacgggtccgtagcggccgtaccggaggggaacgggtcttggaggtgcgtacgtacgttcgtacgagtacgtaggtaacgttagtagggtaagtaagtaagacggtacgcgtacgtgtaggaggaagggtagtacgtaccncgtagacgtaagggatcgtactacgtagtaggtgtacgtacctagttaacagtanagtccaactaggaccgaccgagaccagacgtagtctaagtcncggcgtacacggctacctccgggtacggtagcctagtcgtattcggtagtagttcgggtacgg

SEQ ID NO: 226635 - DNA, 977 bp, Homo sapiens
  misc_feature: GYAE6OF02F68FK.44.56.F01.1.454.CMB.1.raw
tcagacagtatatacacgaccggtgctcgatttagcagacgtctgaacacacaaagggggctctgggagaggagccccagccgtgagattcccgaggagtttccacttggtgatcagcactgagcacagaccaccaaccagtggtagttgggactaatcttgtacttttccgttgttagttttttagaggttcgtccagtgcggagggcgacgtggcggtaggggtcggggggggtcttcgggcacgacgccgagggtcggtctcgtgacgtacctccttccgtgtgtcgtctgagtcttacagttcgttagtagtattactacgtacgttcggtccgttcgggtcccgtacgacggtcccgtacgggaagggggtaacgggtcgttaggtacgggtaggtaacttccgttaccggttttacgacgtaaagggtaacgtttaacggtaaaacggttttagggtacggggttaaaggtaaaaacggtaaacggtaaccgggtaccggtaccccggtacggtttacggttaagggtaaacggggtaaacgggtaaacgttaccgtttaacccgggtaaaccgggtttccgtaaaaccggggttaaaggggttaccttaacccggtaaacccggttaccccgtaaaaagggtttcgggttttacgggtttaacccggtaaaccttttaaagttttaaaacggaaacggtttcggaaacccgtaaaccgttaaacccgggtaacgggaaaccccgggtaaccccggtaaaccgtaaccggtaaccggttaccggggtaaccgttttaaacccgtttaaggtttaccccggaccgggtaccgtaacccgggtaaccggggttacccgttaaccggttccccgggggttaagggggttaccctaaccgggtttacgttaccgggttaacccgttttaggttttaacgggttaacccggtttttacgggggtaacccggggggg

SEQ ID NO: 226636 - DNA, 736 bp, Homo sapiens
  misc_feature: GYAE6OF02ITCO2.44.56.F01.1.454.CMB.1.raw
  modified_base (126)..(126): a, c, t, g, unknown or other
  misc_feature (126)..(126): n is a, c, g, or t
tcagacagtatatacacgaccggtgctcgatttagcagacgtctgaacacacaaagggggctctgggagaggagccccagccgtgagattcccaggagtttccacttggtgatcagcactgagcanagacccaccaaccatggtagttgggactaatcttgtattttcttgtttagttttttagaaggtgtccagtgcggaggggcgacgtgggcgggaggggtccggggggggggtcttgggcacgacggccgaggggccggtctcgtggacgaccttcctctggtgtagtctcgtaggtattcagttcttagtgtattatcctacgttcggccggttcgggttcccgtcgacggtcctccggaaggggggtacgggtcgttgggaggttggacttcgttacgttttcgacgaagtaacgttagttaaacggttgttagggtaagggtaaaagtaaacggaggtaaccgccggtcgttacgtggtagggaaaggggtatacgttccggaaccggttctaacgggtaagggtactacggaccctaacggaagttgggttcgttacggtaaccctttaaggtttaaccaagtttcgaacgtacctaaccgtgggaaaccaccccggaattccggaacgcgggttaactcctttaaatccgagtcccgaacggtggaaccgtcggttcgtaccggggattcggacttgtaccgtgtttacgaggtttcgggtacgggg

SEQ ID NO: 226637 - DNA, 741 bp, Homo sapiens
  misc_feature: GYAE6OF02F9KUF.44.56.F01.1.454.CMB.1.raw
  modified_base (200)..(200): a, c, t, g, unknown or other
  misc_feature (200)..(200): n is a, c, g, or t
  modified_base (602)..(602): a, c, t, g, unknown or other
  misc_feature (602)..(602): n is a, c, g, or t
tcagacagtatatacacgaccggtgctcgatttagcagacgtctgtcggcgggggccccagccctgggattcccagctgtttctgcttgctgatcaggactgcacacagagaactcacagtggagtttggctgagcgtggtttctgtgctatttaaaggtgtcagtgtgaggtgcgaggtgagtggtaagtttggggacnccgttaggttccgggaccggggggaccctaagccgtctccgtgtctcgtctactcgaaccctacttagctagctacgtgtactgcgtacggtcggtccgacaagtacctaccggaagggaaccggtctaggtacgttcggtacgggtctacgaacggttacttaaccgaccggtagtacgggaaccttacgtactacgttacggttaacctacgaacggtaccggtaccggtagggaaccgggtctaacgttcaactactactaccgtacaacgtaacgtaacgaagttacggtaacgtaaacgtaccgggttaattaaacgttaacgtaaagtaactaagtacgttaaacgtaggaccggtagaacggacgtacgtctagttaacgtagttaggttacgtnacggttaactacgttaagttcgtagttaccgggtaggttacgggttaaccgtttacgttccggttaccgggtacctaacggttacgggtccgggtaaccggttaacgggttacccgtttgggttacccgtccgttaccg

SEQ ID NO: 226638 - DNA, 734 bp, Homo sapiens
  misc_feature: GYAE6OF02IQARG.44.56.F01.1.454.CMB.1.raw
  modified_base (387)..(387): a, c, t, g, unknown or other
  misc_feature (387)..(387): n is a, c, g, or t
tcagacagtatatacacgaccggtgctcgatttagcagacgtctgaacacacaaagggggggagaggagcccccagccgtgagattcccaggagtttccacttggtgactcagcactgagcacagaccaccaaccatggagttggctaatcttgattttcctgttagttttttagaaggtgtccagtgcgagggcacgtggcggaggtcggggggggcttcggcacgacgccgagggcggtctcgtgacgactctcctgtcgtacgtctacgaggtacttcgagttaccttaggtagtaatttactctaacttcgggccttcggggtacctcaggtacctccggaggggtaacgggtccttcggaggtggactcgttacgttcgtanaacgtataacggtaactaggtggtaacggaaagtaaacgtcgtaccgaccggtcgtacgtaggtaaggtaaggtacgtacttaccgtaccgtacgtaacgaaacgggtactaccgacctaccaaaggtacgttcggtaccggaaccttaacgtttaaacgaaagtccggtaaccgtaacccaaacggttacggaacccggttaacccgaacgtaacctccgggtaacgtccgttaattaaccgtaaccgcggaaccgaccgtacggttccagtttcccgggaggtacctacggatacgtcttaattccgggaattttaccggggaccggggaccgtaaggtaacccg

SEQ ID NO: 226639 - DNA, 818 bp, Homo sapiens
  misc_feature: GYAE6OF02GZPGS.44.56.F01.1.454.CMB.1.raw
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (349)..(349): a, c, t, g, unknown or other
  misc_feature (349)..(349): n is a, c, g, or t
tcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgatttttccttgttagtttttttagaggttgtccagtgcgaggggcgacgtggcgggagggtcggggggggggtnttgggcacacggccgnggggccggttcgtcctgacggacttcctccgtggttgtacggtctcgaggattcgagttcgttagtgtattatctacgttggccgttcgggttccgtacncgggtcctccggaggggtaacgggtcgttggtaggtggtatcttaccgtttccgtagtacgtaagtacggtaaacgttggtacggtacgggtaaaagtaaacggaggttacgaccggtgttacgtggttaggaaaggggtaacccccgtagtttacccgtaaccggttaccgtaacggaaacgggttacgtacggaacccttaacccgaaacgttagggtttcgggttacccggttaacctaaacgttttaaacgaaaagttacggaaaccgtacccggttaaaccgtaccggtaaaccggtaccccgaaacgaaccggtaaccggaaccggttaccgtttctaaaccgttacggttccggacccgtaccggacggtacccgtaaccggttcccgggtaaaccgggttacccgttcggaacggttcgtaaggttaacttttacggtaggtttacgggtttaacccgggg

SEQ ID NO: 226640 - DNA, 168 bp, Homo sapiens
  misc_feature: GYAE6OF01CTMFM.46.14.B03.1.454.CMB.1.raw
  modified_base (167)..(168): a, c, t, g, unknown or other
  misc_feature (167)..(168): n is a, c, g, or t
tcagactagcagtacacgaccggtgctcgatttagtgtgagtagttcgcgggggtgttcggcggagggaccaaactgaccgtcctaggtcagcccaaggctgcccctcggtcactctgttcccacctcctctactgctagtctgagcgggctggcaaggcgcatagnn

SEQ ID NO: 226641 - DNA, 220 bp, Homo sapiens
  misc_feature: GYAE6OF01DNTF1.46.14.B03.1.454.CMB.1.raw
  modified_base (57)..(57): a, c, t, g, unknown or other
  misc_feature (57)..(57): n is a, c, g, or t
  modified_base (167)..(220): a, c, t, g, unknown or other
  misc_feature (167)..(220): n is a, c, g, or t
tcagactagcagtacacgaccggtgctcgatttagtgtgagtagttcgcggggggtnttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnn

SEQ ID NO: 226642 - DNA, 187 bp, Homo sapiens
  misc_feature: GYAE6OF01CGOZI.46.14.B03.1.454.CMB.1.raw
  modified_base (168)..(187): a, c, t, g, unknown or other
  misc_feature (168)..(187): n is a, c, g, or t
tcagactagcagtacacgaccggtgctcgatttagtgtgagtagttcgcgggggggtgttcggcggagggaccaaactgaccgtcctaggtcagcccaaggctgccccctggtcactctgtcccacctcctctactgctagtctgagcgggctggcaaggcgcatagnnnnnnnnnnnnnnnnnnnn

SEQ ID NO: 226643 - DNA, 172 bp, Homo sapiens
  misc_feature: GYAE6OF02GCLVI.46.14.B03.1.454.CMB.1.raw
  modified_base (169)..(172): a, c, t, g, unknown or other
  misc_feature (169)..(172): n is a, c, g, or t
tcagactagcagtacacgaccggtgctcgatttagtgtgagtagttcgcggggggtgttcggcggagggaccaaactgaccgtcctaggtcagcccaaggctgcccctcggtcactctgttcccaccctcctctactgctagtctgagcgggctggcaaggcgcatagnnnn

SEQ ID NO: 226644 - DNA, 171 bp, Homo sapiens
  misc_feature: GYAE6OF02HM3YL.46.14.B03.1.454.CMB.1.raw
  modified_base (171)..(171): a, c, t, g, unknown or other
  misc_feature (171)..(171): n is a, c, g, or t
tcagactagcagtacacgaccggtgctcgatttagtgtgagtagttcgcgggggggtgttcggcggagggaccaaactgaccgtcctaggtcagcccaaggctgccccctcggtcactctgttcccgccctcctctactgctagtctgagcgggctggcaaggcgcatagn

SEQ ID NO: 226645 - DNA, 231 bp, Homo sapiens
  misc_feature: GYAE6OF02FWVG6.46.14.B03.1.454.CMB.1.raw
  modified_base (58)..(58): a, c, t, g, unknown or other
  misc_feature (58)..(58): n is a, c, g, or t
  modified_base (170)..(231): a, c, t, g, unknown or other
  misc_feature (170)..(231): n is a, c, g, or t
tcagactagcagtacacgaccggtgctcgatttagtgtgagtagttcgcgggggggtnttcggcggagggaccaaactgaccgtcctaggtcagcccaaggctgccccctcggtcactctgttcccgcctcctctactgctagtctgagcgggctggcaaggcgcatagnnnnnnnnnnnnnnnnnnnnnnnnnnnnnnnnnnnnnnnnnnnnnnnnnnnnnnnnnnnnnn

SEQ ID NO: 226646 - DNA, 490 bp, Homo sapiens
  misc_feature: GYAE6OF01DNT6V.15.28.C06.1.454.CMB.1.raw
  modified_base (399)..(399): a, c, t, g, unknown or other
  misc_feature (399)..(399): n is a, c, g, or t
  modified_base (485)..(490): a, c, t, g, unknown or other
  misc_feature (485)..(490): n is a, c, g, or t
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgtctgcgttggggccagggaaccctggtcaccgtctcctcagcctccaccaagggcccatcggtctccccctggcgccctgctccaggancacctccgagagcacagcggccctgggctgcctggtcaaggactactccgctacgtagactgagcgggctggcaaggcgcagtagnnnnnn

SEQ ID NO: 226647 - DNA, 531 bp, Homo sapiens
  misc_feature: GYAE6OF01CP7ZT.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcgcagtggatctgggacagaattcagtctcacatcagcagcctgcagcctgacgattttgctaacttactactgcccaagttgactataaataatacgtattttcgggcggaagggaccaaggtggagaagtcaaaacggtaacgtggtaggccttaggcctaacccgattaccttggttcctttcaatttccccg

SEQ ID NO: 226648 - DNA, 507 bp, Homo sapiens
  misc_feature: GYAE6OF01C4376.15.28.C06.1.454.CMB.1.raw
  modified_base (402)..(402): a, c, t, g, unknown or other
  misc_feature (402)..(402): n is a, c, g, or t
  modified_base (498)..(507): a, c, t, g, unknown or other
  misc_feature (498)..(507): n is a, c, g, or t
tcagtctacgtagccacgaccggtgctcgatttagagctcacgtattgggtttgggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtatactgtgtgagagatgtctgcgttggggccagggaaccctggtcaccgtctcctcagcctccaccaagggcccatcggtcttcccctggccgccctgctccaggacncacctccgagacgcacacgccggccctgggcctcgcctggtcaacggacctacgttccgctacgtagacgtgagcgggctggcgaaggcgcagtgnnnnnnnnnn

SEQ ID NO: 226649 - DNA, 508 bp, Homo sapiens
  misc_feature: GYAE6OF01DAUV1.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgtattttgctaacttactactgaccaagtgacaataataatctagtttcggcggagggaccaagggtggaagactagaaacgtactgtggctgacacctatactgtctctattcccg

SEQ ID NO: 226650 - DNA, 491 bp, Homo sapiens
  misc_feature: GYAE6OF01DPFEQ.15.28.C06.1.454.CMB.1.raw
  modified_base (487)..(487): a, c, t, g, unknown or other
  misc_feature (487)..(487): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctgggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcaataataatcatttcggcgagggaccaaggtgagatacaaacgactgtggctgcaccatctgtcttcnttcc

SEQ ID NO: 226651 - DNA, 497 bp, Homo sapiens
  misc_feature: GYAE6OF01EE4DV.15.28.C06.1.454.CMB.1.raw
  modified_base (490)..(497): a, c, t, g, unknown or other
  misc_feature (490)..(497): n is a, c, g, or t
tcagtctacgtagccacgaccggtgctcgatttagagctcacgtattgggtttgggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggccgccctgcctccaggagcacctccgagagcacagcgccctgggctgcctggtcaaggactacttccgctacgtagactgagcgggctggcaaggcgcagtgnnnnnnnn

SEQ ID NO: 226652 - DNA, 447 bp, Homo sapiens
  misc_feature: GYAE6OF01DHMQ3.15.28.C06.1.454.CMB.1.raw
  modified_base (444)..(447): a, c, t, g, unknown or other
  misc_feature (444)..(447): n is a, c, g, or t
tcagtctacgtagccacgaccggtgctcgatttagagctcacgtattgggtttgggggaagaggaagactgacggtccgccaggctccagggaaggggcgtggagtgggtggccaccatacaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctcaccaagggcccatcggtcttccccctggcgccctgctccaggagcacctccgagagcacagcggcccctggggctgcctggtcaagggactacttccgctacgtagactgagcgggctgggcaaggcgcatagnnnn

SEQ ID NO: 226653 - DNA, 495 bp, Homo sapiens
  misc_feature: GYAE6OF01D8P8V.15.28.C06.1.454.CMB.1.raw
  modified_base (483)..(483): a, c, t, g, unknown or other
  misc_feature (483)..(483): n is a, c, g, or t
  modified_base (488)..(489): a, c, t, g, unknown or other
  misc_feature (488)..(489): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaacaggaaagacccaaagtacctgatctctgccgcctctactttgcaaagtgggtccatcaaggttcagcggcagtggatctgggacagaattcagtctcaccatcagcagcctgcagcctgacgattttgcaacttactactgccaagtgcataataatctatttacggcggagggaccaaggtggagatacaaacgaactgtaggctgcaccatactntcttnnttcccg

SEQ ID NO: 226654 - DNA, 494 bp, Homo sapiens
  misc_feature: GYAE6OF01BLE0M.15.28.C06.1.454.CMB.1.raw
  modified_base (419)..(419): a, c, t, g, unknown or other
  misc_feature (419)..(419): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgtattttgctaacttactactgaccaagtnacataataatctatttcggcggagggaccaaggtggagatacaaacgactgnggctgcactatctgtctgntccg

SEQ ID NO: 226655 - DNA, 478 bp, Homo sapiens
  misc_feature: GYAE6OF01BAJ80.15.28.C06.1.454.CMB.1.raw
  modified_base (470)..(470): a, c, t, g, unknown or other
  misc_feature (470)..(470): n is a, c, g, or t
  modified_base (474)..(475): a, c, t, g, unknown or other
  misc_feature (474)..(475): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaagtgggtccatcaggttcagcgcagtgatctgggacagatcagtctcacatcagcagcctgcagcctgacgtattttgctaacttactactgacaagtgcataatatactagttcggcgaggacaagggtgaagatacaacgatgtgctgcactatctntctnntcc

SEQ ID NO: 226656 - DNA, 553 bp, Homo sapiens
  misc_feature: GYAE6OF01DGL7O.15.28.C06.1.454.CMB.1.raw
  modified_base (542)..(553): a, c, t, g, unknown or other
  misc_feature (542)..(553): n is a, c, g, or t
tcagtctacgtagccacgaccggtgctcgatttagagctcacgtattgggtttggggggggtccctgagactctcctgtgaagcctctggattcaccttgagcacttattggatgacttgggtccgccaggctccagggaaggggctggagtgggtggccaccataacaaaaagatggaagtgacacaaacctatgtgaactctgtgatgggccgattcaccgtctccagagacgacgccaagaactcactacatctgcaaaatgaacaacctgagagccgaggacacggctgtgtattactgtgtgagagatgttctgcgttggggccagggaccctggtcaccgtctctcagcctcaccacgggcccagtcggtccttccccgtggccgccctcgcctccgaggacgccaccgtccgagacgcacgacggccggcccgtgggcctcggcccgtgggtaccgaacgggtaccttaccgttcccgacgttaccggtacgtaccgtggacggccgggcgtcggacgaacggcgacgagtacgnnnnnnnnnnnn

SEQ ID NO: 226657 - DNA, 500 bp, Homo sapiens
  misc_feature: GYAE6OF01D0097.15.28.C06.1.454.CMB.1.raw
  modified_base (494)..(495): a, c, t, g, unknown or other
  misc_feature (494)..(495): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgtattttgctaacttactactgccaagtgacaataataatctagtttcggcggagggaccaagggtgaagatacaaacgacgtgtggctgcactatctgtcttnnttccc

SEQ ID NO: 226658 - DNA, 500 bp, Homo sapiens
  misc_feature: GYAE6OF01B1W59.15.28.C06.1.454.CMB.1.raw
  modified_base (347)..(347): a, c, t, g, unknown or other
  misc_feature (347)..(347): n is a, c, g, or t
  modified_base (493)..(494): a, c, t, g, unknown or other
  misc_feature (493)..(494): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcgcagtggatcngggacagaattcagtctcaccatcagcagcctgcagcctgacgtattttgctaacttactactgccaagtgacattaataatctatttcggacggagggaccaagggtggagatacgaaacgactggtggctgcacatctgtcttnnttcccg

SEQ ID NO: 226659 - DNA, 436 bp, Homo sapiens
  misc_feature: GYAE6OF01DX341.15.28.C06.1.454.CMB.1.raw
  modified_base (434)..(436): a, c, t, g, unknown or other
  misc_feature (434)..(436): n is a, c, g, or t
tcagtctacgtagccacgaccggtgctcgatttagagctcacgtattgggtttgggggaagaggaagactgacggtcctgccacaggtggtgctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggcgccctgctccaggagcacctccgagagcacagcggccctgggctgcctggtcaaggactacttccgctacgtagactgagcgggctggcaaggcgcatagnnn

SEQ ID NO: 226660 - DNA, 496 bp, Homo sapiens
  misc_feature: GYAE6OF01BL3BC.15.28.C06.1.454.CMB.1.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
  modified_base (438)..(438): a, c, t, g, unknown or other
  misc_feature (438)..(438): n is a, c, g, or t
  modified_base (472)..(472): a, c, t, g, unknown or other
  misc_feature (472)..(472): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctntactttgcaaagtgggtccatcaaggttcagcggcagtggatntgggacggaatcagtctcaccatcagcagcctgcagctgacgtattttgactaacttactactcgccaagtgactataataatcatttcggnggaggaccaggtggagatacaaacgactggtagntgcacatctgtcttcatctccccg

SEQ ID NO: 226661 - DNA, 502 bp, Homo sapiens
  misc_feature: GYAE6OF01C5YVK.15.28.C06.1.454.CMB.1.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattacaaatggttgctggttcagcagaaacagggaaagccccaaaagtcctgatctctgccgcctctactttgacaaagtgggtcccatcaaggttcagcggcagtggatcngggacagaattcagtcncacatcagcagcctgcagcctagacgtattttcgactaacttaactactgaccaagtnacaataaataatctagtttcggacgtagggaaccaagggtgagtanaacaaagactgagctgacacatctagtcttnacttccc

SEQ ID NO: 226662 - DNA, 501 bp, Homo sapiens
  misc_feature: GYAE6OF01B1GC8.15.28.C06.1.454.CMB.1.raw
  modified_base (475)..(475): a, c, t, g, unknown or other
  misc_feature (475)..(475): n is a, c, g, or t
  modified_base (494)..(495): a, c, t, g, unknown or other
  misc_feature (494)..(495): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgactattttgactaacttactactgaccaagtgacataataatctattcggacggagggaccaaggtggagatacgaaacgactggnggctgcaccatctgtcttnnttcccg

SEQ ID NO: 226663 - DNA, 548 bp, Homo sapiens
  misc_feature: GYAE6OF01C7YHZ.15.28.C06.1.454.CMB.1.raw
  modified_base (199)..(199): a, c, t, g, unknown or other
  misc_feature (199)..(199): n is a, c, g, or t
  modified_base (353)..(353): a, c, t, g, unknown or other
  misc_feature (353)..(353): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtcaccctgtctgcatctgtcggagacnggagtcaccatcacttgccgggccagtcagagtattactaaatggttggcctggtttcagtcagaaaccaggaaacgacccaaaagtcctgatctctcgccgcctctactttgcaaagtgggtcccatcaagttcagcgcagtggatctagganagaatcagtctcacagtcagtcagcctgcagcctagaacgtacttttgactaaacttactaactcgaccaagtgactaataactaatctagtttcggacggtagggaccaagggtacgaaggattacgaaaacgtaacgttggtacggcgttaggccaacctattaccgttagtttcggttcctaagtttccccg

SEQ ID NO: 226664 - DNA, 507 bp, Homo sapiens
  misc_feature: GYAE6OF01CO9V7.15.28.C06.1.454.CMB.1.raw
  modified_base (501)..(501): a, c, t, g, unknown or other
  misc_feature (501)..(501): n is a, c, g, or t
tcagtctacgtagccacgaccggtgctcgatttagagctcacgtattgggtttgggggagtcatactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagaccccaaaagtcctgatctctgccgcctctactttgcaaaggtcggggtccatcgaaggttcagcggcagtggatctgggacagaattcagtctcaccatcagcagcctgcagcctgacgtatttgactaacttacactgaccaagtgacaataataatctagtttcgggcggaggaccgaaggtggagactagaaacgactgtaggctgcactatctagtcttcncttccg

SEQ ID NO: 226665 - DNA, 495 bp, Homo sapiens
  misc_feature: GYAE6OF01BK10S.15.28.C06.1.454.CMB.1.raw
  modified_base (490)..(490): a, c, t, g, unknown or other
  misc_feature (490)..(490): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcagcggcagtggatctgggacagaattcagtctcaccatcagcagcctgcagcctgacgtattttgctaacttactactgccaagtgcataataatctatttcggcgagggaccaggtggagatacgaaacgacgtgtggctgcactatctgtcttcnttccc

SEQ ID NO: 226666 - DNA, 498 bp, Homo sapiens
  misc_feature: GYAE6OF01A93FH.15.28.C06.1.454.CMB.1.raw
  modified_base (492)..(492): a, c, t, g, unknown or other
  misc_feature (492)..(492): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccaggaaagccccaaaagtcctgatctctgccgcctctactttgcaaagtgggtcccatcaaggttcagcggcagtggatcgtgggacagaattcagtctcaccatcagcagcctgcagcctgacgtattttgactaacttactactgccaagtgcaataataatctatttcggcggagggaccaaggtgagtatacgaaacgactgtggctgcactatctgtcttcnttcccg

SEQ ID NO: 226667 - DNA, 510 bp, Homo sapiens
  misc_feature: GYAE6OF01EWPBN.15.28.C06.1.454.CMB.1.raw
  modified_base (504)..(505): a, c, t, g, unknown or other
  misc_feature (504)..(505): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatcgtgggacagaattcagtctcaccatcagcagcctgcagcctgacgtattttgctaacttactactcgacaagtgacaattaatatctatttcggacggaggaccgaggtggagtatacgaaacgaacgtggtcggctagcacctatctagttccttnnttccc

SEQ ID NO: 226668 - DNA, 597 bp, Homo sapiens
  misc_feature: GYAE6OF01BTYB0.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggccgggccagtcagagtattactaatggttgcctggttcagacaagaaaccgaagggaaacgacccaaaagtcctagactctctcgccgtccttacttactttgacgtaaaggtcgggtaccctagtacgtaaggttcgacggcggacaggtggatcgtgggaacagtaacttcagtctacactatacagcacgcctgacacgcctagacgttatttacgactaacttactactcgaccgtagtcgactaataataactacgtagttaccgggacggtaacgggaccgaagggtggaacgtacgtaaacgaaacggtacgttaggtacggtctacggacctacctacgttcgttacgttccttaccgtacgtttaccccg

SEQ ID NO: 226669 - DNA, 502 bp, Homo sapiens
  misc_feature: GYAE6OF01E0BHO.15.28.C06.1.454.CMB.1.raw
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
  modified_base (495)..(496): a, c, t, g, unknown or other
  misc_feature (495)..(496): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccaggggaaagccccaaaagtcctgatctctgccgcctctactttgcaaagtggggtcccatcaaggttcagcggcagtggatcgtggacagattcagtctcaccatcagcagcctgcagcctgacgtatttgctaacttactactgcctaagtgcaataataatctaatttcgggcggagggaccaagggtggaagatacaaacgactagnggctgcaccatcntcttnnttcccg

SEQ ID NO: 226670 - DNA, 506 bp, Homo sapiens
  misc_feature: GYAE6OF01BD1J7.15.28.C06.1.454.CMB.1.raw
  modified_base (500)..(500): a, c, t, g, unknown or other
  misc_feature (500)..(500): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgctaaagtggggtcccatcaaggttcagcggcagtggatctgggacagaattcagtctcaccatcagcagcctgcagcctgacgtattttgactaacttactactgccaagtgcaataataatctatttacggcggtaaggaccgaaggtggagatacgaaacggactgtggctgacacatctgtcttcgnttcccg

SEQ ID NO: 226671 - DNA, 444 bp, Homo sapiens
  misc_feature: GYAE6OF01BOCY5.15.28.C06.1.454.CMB.1.raw
  modified_base (437)..(444): a, c, t, g, unknown or other
  misc_feature (437)..(444): n is a, c, g, or t
tcagtctacgtagccacgaccggtgctcgatttagagctcacgtattgggtttggggggaagaggaagactgacggtcctgccacaggtggtgctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggcgccctgctccaggagcacctccgagagcacagcggcccgtgggctgcctggtcaaggtactacttccgctacgtagactgagcgggctggcaaggcgcagtgnnnnnnnn

SEQ ID NO: 226672 - DNA, 587 bp, Homo sapiens
  misc_feature: GYAE6OF01AMN0M.15.28.C06.1.454.CMB.1.raw
  modified_base (169)..(169): a, c, t, g, unknown or other
  misc_feature (169)..(169): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcnccgtccaccctgtctgcatctgtcggagacagagtcaccatcacttgccgggccagtcagagtatactaatggtggcctggtttcagcagaaccaggaaacgccccaaaagtcctgatctctgccgctctactttgcaaagtgggtcccatcaaggttcagtcggctagtggatcgtgggacaggtaattcgagttctcacctatcagcacgtccttagcctagtccgttagacgttattttcggacctaaacgttaacctacgtagccctaaaggtcgactaagttaataacgtctaaggtttccggacgggtaacgggacctaacgggtaggacgtacgaccgaaacggtaaccgttaggcgggtccgtgacccgaaccctagttaccccgttagttacccttgacgtttaccccg

SEQ ID NO: 226673 - DNA, 592 bp, Homo sapiens
  misc_feature: GYAE6OF01BMT49.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcagaaaccagggaaactaccccaaaagtcctgatctctcgccgcctctactttgacaaagtcggggtcccatacgaaggttcaggcgcagtggatcgtgggacagaattcagtctacacatcagcagcctgcagcctagacgtattttcgactaactttacctactcgacctaagtcgactaacttaataactcgtaagtttccgggacgggtaacgggaccgtaaaggggttaggaacggtaacgtaaccgtaaaaccggtaacgttcgggacgggtccttacggacccaacccgtaacttcctttacggttccctttacgtccgtttacccccg

SEQ ID NO: 226674 - DNA, 528 bp, Homo sapiens
  misc_feature: GYAE6OF01DPXND.15.28.C06.1.454.CMB.1.raw
  modified_base (520)..(520): a, c, t, g, unknown or other
  misc_feature (520)..(520): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaaccagggaaacaccccaaaagtcctgatctctcgccgcctctactttgactaaaggtcgggtcccatcgaaggttcagcggcagtggatcgtggacagaattcagtctcacatcagcagcctgcagcctagacgtatttgactaacttactactcgacctaagtgactaataataatctagtttcgggacggtagggaccaaggtggaagactacgaaacgtaacgtggtacggctcgacacctatcgtagtccttnacttcccg

SEQ ID NO: 226675 - DNA, 496 bp, Homo sapiens
  misc_feature: GYAE6OF01A8QZQ.15.28.C06.1.454.CMB.1.raw
  modified_base (456)..(456): a, c, t, g, unknown or other
  misc_feature (456)..(456): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgtattttgactaacttactactgaccaagtgacataataatctatttcggcgaggaccaggtgganatacaacgactgtggctgacactatctnttcttnattccc

SEQ ID NO: 226676 - DNA, 517 bp, Homo sapiens
  misc_feature: GYAE6OF01DZC1W.15.28.C06.1.454.CMB.1.raw
  modified_base (510)..(511): a, c, t, g, unknown or other
  misc_feature (510)..(511): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaaatggttggcctggtttcagcagaaaccagggaaagccccaaaagtcctgaatctctgccgcctctactttgcaaagtggggtcccatcaaggttcagcggcagtggatctgggacagaattcagtctcaccatcagcagcctgcagcctagacgtattttgctaactttactactgccaagtgcaataataatctatttcggacggtagggaccgaaggtggagatacgaaacggtaactgtcggctagccaacctatacttagtccttnnttcccg

SEQ ID NO: 226677 - DNA, 506 bp, Homo sapiens
  misc_feature: GYAE6OF01B18HM.15.28.C06.1.454.CMB.1.raw
  modified_base (497)..(506): a, c, t, g, unknown or other
  misc_feature (497)..(506): n is a, c, g, or t
tcagtctacgtagccacgaccggtgctcgatttagagctcacgtattgggtttggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaaatgaacaacctgagagccgaggacacggctgtgtattactgtgtgagagatgttctgcgttgggccagggaaccctggtcaccgtctcctcagcctccaccaagggcccatcggtcttcccctggcgccctgctccaggacgccacctccgagacgccacacgccggccctgggcctgccctggtcaaggacctacttcccgctacgtagactgaggcgggctggcaaggcgcatgnnnnnnnnnn

SEQ ID NO: 226678 - DNA, 538 bp, Homo sapiens
  misc_feature: GYAE6OF01CWI1M.15.28.C06.1.454.CMB.1.raw
  modified_base (528)..(528): a, c, t, g, unknown or other
  misc_feature (528)..(528): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaaccagggaaagccccaaaagtcctgaatctctgccgcctctactttgacaaagtcgggtcccatcaaggttcagcggcagtggatcgtgggacagaattcagtctcaccatcagcagcctgcacgcctagacgtattttcgactaacttactactcgaccaagtgactaataaataatctatttcgggacgtaagggacctaagggtcggaagactacgaaacgtaacgtggtaggcctgaccacgtacttactgttaccttntacttccccg

SEQ ID NO: 226679 - DNA, 523 bp, Homo sapiens
  misc_feature: GYAE6OF01EURL4.15.28.C06.1.454.CMB.1.raw
  modified_base (517)..(517): a, c, t, g, unknown or other
  misc_feature (517)..(517): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgactaaagtcgggtccatcaaggttcagcggcagtggatcgtggacagaattcagtctcacatcagcagcctgcagcctgacgtatttcgactaacttactactgaccaagtgactaataataactctagtttcggcggaacgggaccgaagggtggaagtatacgaaacgtacgtagtcggctagccaccgtattctagttcttcgnttcccg

SEQ ID NO: 226680 - DNA, 526 bp, Homo sapiens
  misc_feature: GYAE6OF01BVFDO.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgttctggctcccaggtgccaaatgtgacatccagatgacccagtctccgtccaccctgtctgcatctgtcggagacagagtcaccatcacttgccgggccagtcagagtattactaaatggttgctggtttcagcagaaaccagggaaagccccaaaagtcctgatctctgccgcctctactttgcaagtgggtcccatcaaggttcagcggcagtggatcgtgggacagaattcagtctcaccatcagcagcctgcagccctgacgtattttgactaacttactactgccctaagtgactaataataattcaagtttcgggcgggtaacggggaccaagggtggaagactacgaaaacgacgtggtggctgctaccattcctgttacttctagtccttccccg

SEQ ID NO: 226681 - DNA, 587 bp, Homo sapiens
  misc_feature: GYAE6OF01EJLJK.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaatggtgctgttcagcagaaacaggaaacacccaaagtcctgatctctgccgtcctctactttgactaaagtcgggtccatcgaagttcagcggcagtgatcgtggacagtaattcagtctcacatcagcacgcctgcacgcctagacgtatttcgacttaacttactacgtcgacctaagtcgactaagttaaactaacttacgtaacgttttaccgggacgggtaacgggtaaccgtaagggtacggtaagtacgtaaaccgaaaaccggtaacgttagggtacggtccgtacggaccctaaccgttacgttacgttacggtttacctttaccgtaccgtttaccccg

SEQ ID NO: 226682 - DNA, 577 bp, Homo sapiens
  misc_feature: GYAE6OF01DRN62.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggtttcagcagaaaccagggaaagccccaaaagtcctgatctctgccgcctctactttgacaaagtgggtcccatcaagttcagcggcagtggatctgggacagaattcagtctcaccatcagcagcctgcagcctagacgtattttgactaactttactactgacctaagtcgactaattaaagttaataccgtaagttttaccgggacgggtaacggggtaccgaaagggtggaacggtaataaccgtaaaaacggtaacgttagggtacggtcgtacggaccaacccgtaacgttcgttacgttccctttacgtctttacccccg

SEQ ID NO: 226683 - DNA, 591 bp, Homo sapiens
  misc_feature: GYAE6OF01D4S2I.15.28.C06.1.454.CMB.1.raw
  modified_base (334)..(334): a, c, t, g, unknown or other
  misc_feature (334)..(334): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttgctggttcagcagaaaccaggaaacacccaaaagtcctagatctctgccgcctctactttgacaaagtgggtcccatacaagtcagcgnagtgatcgtggacagtaatcagtctcaccatcagtcacgcctgcacgtcctagtacgtattttcgactaactttacctactcgtacctaagtgactaaattaaagtaacttaccgtagttttaccgggacgggtaacggggaccgtaaagggtacgggaagtaacttaaccgaaaaaccgggtaacttagggtacgggtactacggtacccgaacccttacgttaccttacggttaccttttccgagtttacccccg

SEQ ID NO: 226684 - DNA, 615 bp, Homo sapiens
  misc_feature: GYAE6OF01DI3PT.15.28.C06.1.454.CMB.1.raw
  modified_base (435)..(435): a, c, t, g, unknown or other
  misc_feature (435)..(435): n is a, c, g, or t
tcagtctacgtagccacgaccggtgctcgatttagagctcacgtattgggtttgggggagtcagactcagtcaggacacagcatggacatggacgggtccccgctcagctccgtggggctcctgctgctctggctcccaggtgccaaatgtgacatccagatgacccagtctccgtccaccctgtctgcatctgtcggagacagagtcaccatcacttcgccggccaggtcagtagtattactaaagtggttggcctggttcagcaagaaaccagggaaacgaccccaaaagtccctgatctctgccgcctctactttgcaaagtcggggtaccctatcgaaggttcagcggcagtggatcgtggacaggaattcagtctcacatcacgtcacgcctgcagcctagtacgtatttcgtactaactactttttacngtaccaagtgtacaattaacttaacgttacgtacgtttaccgggacgggtaacgggtacccggtaaggggtacggaaacggacgttaaccgaaaacgggtaacgttaagggttcgggtaccgttacggtaccaacccgttacgttaccttcggtttacccttccgttcctttacccccgg

SEQ ID NO: 226685 - DNA, 685 bp, Homo sapiens
  misc_feature: GYAE6OF01C79UP.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccgggcagtcagagttattaactaaagtggttcggtccttggttcagcaaggaaaaccgagggaaacaccccgaaaagtcctagactcctctcgccgtccttacttacgtttgacgtaaacggttcgggtacccagtacgaaacgggttcaggccggacgtaggttcggagttcggtagggaacagtaacttcagttccaccaacctatcgaagcacgccgtagccacgtccgtaggaacgtttgtttcgaaccttaactttacgtactacggtacctaaggtcgaactaattaacgtaactttacgtaacggtttaccggggacgggtaacggggtaacccgtaaggggttacggaacgtaacgtaaaccggtaaaacggtaacggttaggttacgggtccgttacgggaccctaaacccggttctttacccgtacggttttccctaccgttaccctttacccccgg

SEQ ID NO: 226686 - DNA, 660 bp, Homo sapiens
  misc_feature: GYAE6OF01BUAY3.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccagtcctcccgtccaccctgtctgcatctggtcggagacagagtcaccatcacgttggccggccagtcagagttattactaagtggttgccttggttcagcaagaaacgtagggaaacgacccaaagtcctagtactctctcgccgtccttcttacgtttgacgtaaaggtcgggtaccctagtacgtaacggttcaggcggagtaggtaggactcgtagggactaagtaacttcgtacgttactaccacctatacgacggccgtacgtaccgtcgaccgtacggtaccttacggtaaccgttagttttaccgaaccttaaacgtttacctacgttaccgaaccgtaagtcgtaacttaaattaacttaactacgttacgtttacggggacgggtaacggggtaaccgtaagggtcggaagtaacgttaaacgaaaccggttcgtaggtaggtccacgtacctaccgtatcgtttacgtccttcgttaccttccccg

SEQ ID NO: 226687 - DNA, 498 bp, Homo sapiens
  misc_feature: GYAE6OF01BYWRF.15.28.C06.1.454.CMB.1.raw
  modified_base (417)..(417): a, c, t, g, unknown or other
  misc_feature (417)..(417): n is a, c, g, or t
  modified_base (476)..(476): a, c, t, g, unknown or other
  misc_feature (476)..(476): n is a, c, g, or t
  modified_base (493)..(493): a, c, t, g, unknown or other
  misc_feature (493)..(493): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcagcgcagtggatctgggacagaatcagtctcaccatcagcagcctgcagcctgacgtattttgctaacttactactgccaagtnacaataataatctatttcggacggaggaccaagggtggagatacgaaacgactgtggcngcacctatctgtcttcnttccc

SEQ ID NO: 226688 - DNA, 476 bp, Homo sapiens
  misc_feature: GYAE6OF01BZDOG.15.28.C06.1.454.CMB.1.raw
  modified_base (467)..(467): a, c, t, g, unknown or other
  misc_feature (467)..(467): n is a, c, g, or t
  modified_base (471)..(476): a, c, t, g, unknown or other
  misc_feature (471)..(476): n is a, c, g, or t
tcagtctacgtagccacgaccggtgctcgatttagagctcacgtattgggtttggggggaagaggaagactgacggtccgccaggctccagggaaggggctggagtgggtggccaccatacaaaaagatggaagtgacacaacctatgtgaactctgtgatgggccgattcaccgtctccagagacggcgccaagaactcactacatctgcaaatgaacaacctgagagccgaggacacggctgtgtattactgtgtgagagatgttctgcgttggggccagggacctggtcaccgtctcctcagcctccaccagggcccatcggtcttccccctggccgtcccctgcctcccgaggacgccaccctccgagacgccacaggccggccccgtggggcctcggcccgtgggtccaagggtaccttaccgttcccgctacgtagactggacggcgggctggacgaggcnatgnnnnnn

SEQ ID NO: 226689 - DNA, 620 bp, Homo sapiens
  misc_feature: GYAE6OF01BBIW9.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccaatcagagtatactaaatggttggcctggtttcagcaagaaaccgaggaaagccccaaaagtcctgatctctgccgcctctactttgcaaagtgggtccatcaaggttcagcggcaggtggatctgggaacagaatcagtctcacatcagcagcctgccagccgtagacgttaagttttcgactaaacgtttactactcgaccgtaatagactaaattaaattaaactacgtaagttttaccggggacggtaaacggggtacccgtaaaggggttacgggaaacgtacgttaaaccgtaaaaaccggtaaacggtttgggacggtccgtaaggaccccgtaaacccgttaaagttcccgtttacggtttacccctttaccgtaacgtttaccccccgg

SEQ ID NO: 226690 - DNA, 631 bp, Homo sapiens
  misc_feature: GYAE6OF01AOK3U.15.28.C06.1.454.CMB.1.raw
  modified_base (322)..(322): a, c, t, g, unknown or other
  misc_feature (322)..(322): n is a, c, g, or t
  modified_base (619)..(631): a, c, t, g, unknown or other
  misc_feature (619)..(631): n is a, c, g, or t
tcagtctacgtagccacgaccggtgctcgatttagagctcacgtattggggtttgggggggggtccctgagactctcctgtgaacgcctctggattcaccttgagcacttattggatggacttgggtccgccaggctccgagggaaggggctgggagtgggtggccaccaataacaaaaagatggaagtgacacaacctatgtgaactctgtgatgggccgattccaccgtctccagagacgacgccaagaactcactacatctgacaaaatgaacaacctgacgagccgagggaccacggctgtgtattactggtgtgagngatgttctggcgttggggccagggaccctggtccaccgtctcctcacgccctacccgacccgaacgggccccctacgttcccggttccctttcccccccgtcgggcccgtcccccttcggccctacccgacgggaccgcccacccgtcccggagacgccgacgaccggccgggccccgtggggcccttcggcccgtcgggtaccaaacgggtaccttaacccgtttcccgaccgttaccggtacggtaccgtgggacggtccggggctaggggaccgagggtcccgacgacgtaggnnnnnnnnnnnnn

SEQ ID NO: 226691 - DNA, 579 bp, Homo sapiens
  misc_feature: GYAE6OF01CJSJW.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtcggggtcccatcaaggttcagcggcagtggatcgtggacagaatcagtctcacatcagcagcctgcagcctgaccgtattttcgtaacttactactgacctaagtcgactaagtaattaatcgtaacgtttcgggacgggtaacgggaaccgtaagggtacggaacggaacgtaaccgaaaacggtaacgttcgggtaggaccgttggacctaacctaacgtttccttacggttacctttacctacgttccctttacccccgg

SEQ ID NO: 226692 - DNA, 580 bp, Homo sapiens
  misc_feature: GYAE6OF01C6B2Y.15.28.C06.1.454.CMB.1.raw
  modified_base (275)..(275): a, c, t, g, unknown or other
  misc_feature (275)..(275): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaanccccaaaagtcctagatctactgccgtcctctactttgactaaaggtcgggtacccagtctaaggttcagcggcaggtgatcgtaggacagtaattcagtctacacatcagcagacctgcacgcctagtacgtatttcgactaacttactactcgaccgtaatcgactaataaattactacgtacgtttcgggacgggtaaggaccgtaagggttagggaacgtacttaacgaaacggtaacgttgggtaggtaccgtacggaccaaccgtacttacgtacgtttcccttcgactttacccccgg

SEQ ID NO: 226693 - DNA, 537 bp, Homo sapiens
  misc_feature: GYAE6OF01DKEUY.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggccttggtttcagcaagaaaccgagggaaacgaccccaaaagtcctagatctctgccgcctctactttgacaaaggtcgggtccatcaaggttcaggcggcaggtggatcgtggacagaatcgagtctcacatcagcacgcctgcagcctagacgtatttcgacctaacttactactcgacctaagtgacaataatatctagttcggacggacgggaccgagggtacgagtactacgaaacgtacgtggtcggctacgaccacgtacttactgttacttcgtacttccccg

SEQ ID NO: 226694 - DNA, 751 bp, Homo sapiens
  misc_feature: GYAE6OF01DEONI.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaatggttgcctggttcagcaagaaaccgagggaaacacccaaaagtcctagactctcgtcgccgtccttacttacgtttcgacgtaaacggttcggggtaccctaagtacgtaacggttcaacggtccggacgtagggtagggaacgttcggttacggggaacggtaacgtttaccgaacgttccttaaccctacccgtaacgtacccgaacggtacccgtaacggtccccgttacggacccgtaacggtaccccgttacgtaaaccggtttaacttttttccggaaaccctttaaacccgttttaaccgttaaccgtacccggtaaccgtaacggttacgtaaccctaaaagtttaaacttaaacgttccgttaacggttttaccggggacgggtaaacgggtaaccggtaagggtacggtaacgtaacgtaaacggtaaaaaccgtacggttggacggtacgtcgacccgaacctacgttcttacgttcttaccttaccgtttccccgtacg

SEQ ID NO: 226695 - DNA, 584 bp, Homo sapiens
  misc_feature: GYAE6OF01CDWJK.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgccccaaaagtcctagatctctgccgcctctactttgacaaagtggggtcccatcaaggttcagcggcagtggatcgtggacagtaattcagtctacacatcagcagcctgcagcctagacgtattttcgactaacttactactgacccaagtcgactaataaataactacgtagtttccgggacggtaacgggacctaaagggttaggaaacgtaacgtaaccgtaaaacggacgttagggtacgggtaccgttacgaccctaaaccgtactttacgttacggttacctttccgaactttacccccgg

SEQ ID NO: 226696 - DNA, 705 bp, Homo sapiens
  misc_feature: GYAE6OF01BNGJU.15.28.C06.1.454.CMB.1.raw
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (685)..(685): a, c, t, g, unknown or other
  misc_feature (685)..(685): n is a, c, g, or t
  modified_base (693)..(693): a, c, t, g, unknown or other
  misc_feature (693)..(693): n is a, c, g, or t
  modified_base (697)..(697): a, c, t, g, unknown or other
  misc_feature (697)..(697): n is a, c, g, or t
  modified_base (699)..(699): a, c, t, g, unknown or other
  misc_feature (699)..(699): n is a, c, g, or t
  modified_base (701)..(701): a, c, t, g, unknown or other
  misc_feature (701)..(701): n is a, c, g, or t
  modified_base (703)..(703): a, c, t, g, unknown or other
  misc_feature (703)..(703): n is a, c, g, or t
  modified_base (705)..(705): a, c, t, g, unknown or other
  misc_feature (705)..(705): n is a, c, g, or t
tcagtctacgtagccacgaccggtgctcgatttagagctcacgtattgggtttggtggggggtccctgagactctcctgtgaagcctctggattcaccttgagcacttattggatgacttgggtccgccaggctccgaggggaagggctggagtgggtggccaccaataacaaaaagatggaagtgacacaacctatgtgaactctgtgagtgggccgattccaccgtctccagagacgacgaccaagaactcactacatcngacaaatgaacaacctgagagccgagacacggntgtagtattactgtgtgagagtattgttcgtggcgggttcggggacccgaacggggtaaccccgttggtaccctacccggtccttcccgtcgaaccgtcccctaccgaaaccggaaccggggtcccctacggttccccggtttcccctttccccccggtcgggtccccgtccccgttcggacccgttacccggaacgggaccgtaccccgtacccgtacccgggaagaccgacccgaaccgaccgggtccccgggtcccggtgggtcccgtcggtcccgttacgggtaccgaaaccgggttaccttaccgtaccggtaccgtaacggtaccgtacgtcggacgggccgggtcgtacgggaccgtaacggggaccgtacgtaaagtggacncgacgcgngcgngncngngn

SEQ ID NO: 226697 - DNA, 539 bp, Homo sapiens
  misc_feature: GYAE6OF01BNBN4.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgccccaaaagtcctgatctctgccgcctctactttgacaaagtcgggtcccatcaaggttcagcggcagtgatctgggacagatcagtctcacatcagcagcctgcagcctgacgtattttgactaacttactacgtgaccctaagtcgactaataataactctaagtttcggacggaagggaccgaagggtggaagtacgtaacgaaaacgtaacgtaggtacggtctacgaccacctaacttctagttccttcgcttccccg

SEQ ID NO: 226698 - DNA, 569 bp, Homo sapiens
  misc_feature: GYAE6OF01EAOX5.15.28.C06.1.454.CMB.1.raw
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggccttggtttcagcaagaaaccagggaaacgccccaaaagtcctagatctctgccgcctctactttgacaaagtgggtcccagtcaaggttcagcggnagtggatcgtggacagaattcagtcncaccatcagcagcctgacagcctgaacgtattttcgacctaacttactactcgacctaagtgactaagtaaacttaagtactaagtttccgggacgggtaacgggtaaccgtaagggtggaagtacgtaaccgaaaacggtaacgttgggtaggtctacggaccaaccgtattacgtagttccttcgactttaccccg

SEQ ID NO: 226699 - DNA, 689 bp, Homo sapiens
  misc_feature: GYAE6OF01B901N.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtcctccgtcccaccctgtctgcatcgtgtcggagacagagtcacatcacttcggccggacagtcagatattacaagtggtgtacctggttcagacaagaaaccgaaggaaacgacccgaaaagtcctagactctactcgccgtcctactacgtttacgacgtaaacggtcgggtacctagtcgtaaacggttcgaaggacggtactaaggttggtaacgtccggttagggaaccgtaaggtaacttcgaacgttacctaccgaacctatccgacgacgacgtccacggctacgtcccgtagtaaccggtttatttaccgacttaaacctttacctacgtacgtaccgtaagtaccgtactaaattaataacgttacgttaggttaaccggggacggtaacgggaaccggtaacgggtaggaacgtaacgtaaccgtaaaaaccggtacgttagggttacgtccgttaacgaccctaaaccgttcttaacgtcggttttacccttacgtccgttttaacccccgg

SEQ ID NO: 226700 - DNA, 512 bp, Homo sapiens
  misc_feature: GYAE6OF01D6MKW.15.28.C06.1.454.CMB.1.raw
  modified_base (275)..(275): a, c, t, g, unknown or other
  misc_feature (275)..(275): n is a, c, g, or t
  modified_base (366)..(366): a, c, t, g, unknown or other
  misc_feature (366)..(366): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaanccccaaaagtcctgatctctgccgcctctactttgcaaagtggggtcccatcaaggttcagcgcagtggatctgggacagaattcagtctnaccatcagcagcctgcagctgacgattttgactaacttactactgccaagtgacaataataatcgtatttcgggacggaagggaccaagggtggaagagtacaaacggaactggtaggctgacaccatctgttccttgacttcccg

SEQ ID NO: 226701 - DNA, 579 bp, Homo sapiens
  misc_feature: GYAE6OF01BXMC2.15.28.C06.1.454.CMB.1.raw
  modified_base (566)..(569): a, c, t, g, unknown or other
  misc_feature (566)..(569): n is a, c, g, or t
  modified_base (571)..(579): a, c, t, g, unknown or other
  misc_feature (571)..(579): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggcctccgaggggaaggggctggagtgggtggccaccataacaaaaagatggaagtgacacaacctatgtgaactctgtgagtgggccgattcacccgtctccagagaccgacgccaaagaactcactacatctgacaaatcgaacaacctgagacgccgaggacacggctgtgtattactgtgtgagagatgttctggcggttggggccacggggaacccttggtccaccgtctcctcgacgccctcccaaccgaacgggccccacgtccggtcccttcccccgtgggcccgccctgcctccgacggacgccaccgtccgagcgccacgacgccggcccgtgggctcgccgtggtacgaacggtaccttaccgttccgactacggtacgtacgtggacggccgggctgggaccgaacggccgacgtacgtaggnnnngnnnnnnnnn

SEQ ID NO: 226702 - DNA, 589 bp, Homo sapiens
  misc_feature: GYAE6OF01BRYRG.15.28.C06.1.454.CMB.1.raw
  modified_base (355)..(355): a, c, t, g, unknown or other
  misc_feature (355)..(355): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattaactaaagttggttaggcctggtttcagacaagaaaaccgaggggaaaacgaccccaaaagtcctagatctctgccgccttctactttgacaaagtcgggtccatacaaggttcagcggnagtggatcgtgggacagtaattcagtcacaccatacgagcaacgcctgacagcctgaacgtattttcgaccttaacttacctacgtacgacctaagtgtacaataaattaactcgtaacgtttaccggacgggtacgggtaaccgtaagggtacggaagtagtaaccgaaacggtaacgtaggtacggcgtacggacctaacgtacttctacgttccttcgtacgtttaccccg

SEQ ID NO: 226703 - DNA, 555 bp, Homo sapiens
  misc_feature: GYAE6OF01EMXSU.15.28.C06.1.454.CMB.1.raw
  modified_base (175)..(175): a, c, t, g, unknown or other
  misc_feature (175)..(175): n is a, c, g, or t
  modified_base (537)..(537): a, c, t, g, unknown or other
  misc_feature (537)..(537): n is a, c, g, or t
  modified_base (543)..(555): a, c, t, g, unknown or other
  misc_feature (543)..(555): n is a, c, g, or t
tcagtctacgtagccacgaccggtgctcgatttagagctcacgtattgggtttgggggggtccctgagactctcctgtgaagcctctggattcaccttgagcacttattggatgacttgggtccgccaggctccgagggaaggggctggagtgggtggccaccataacaaaaagntggaagtgacacaacctatgtgaactctgtgatgggccattcaccgtctccagagacgacgccaagaactcactacatctgacaaatgaacaacctgagagccgaggacacggctgtgtattactgtgtgagagatggttctggtcggttggggccagggaaccctggtccaccgtctcctcacgccctccaccgacgggccctagtccggtcccttcccccgtggcccgccctgcctccgaggcgccaccgtcgagacgccacgacggcccggcccgtgggcctcggccgtcggtacgaacggtcctaccgttcccgacgttacggtacggactggacgccgggcgtcggacgaggccganagtcgnnnnnnnnnnnnn

SEQ ID NO: 226704 - DNA, 569 bp, Homo sapiens
  misc_feature: GYAE6OF01E2BEX.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtggcctggttcagcagaaaccagggaaagaccccaaaagtcctgatctctgccgcctctactttgcaaagtcgggtcccatcaaggttcaggcggcagtggatcgtgggacagaattcagtctacacatcagcagcctgcagcctgacgtattttgaactaacttactactcgacctaagtgactaattaaataacttacgtagtttaccgggacgggtaagggacccgtaaaggggtcggaagtaactaaccgaaaacggtaacgttaggtacgggctacggaccaacccgtacgttacgttagttccttcgtacgtttccccg

SEQ ID NO: 226705 - DNA, 603 bp, Homo sapiens
  misc_feature: GYAE6OF01DRC60.15.28.C06.1.454.CMB.1.raw
  modified_base (580)..(580): a, c, t, g, unknown or other
  misc_feature (580)..(580): n is a, c, g, or t
tcagtctacgtagccacgaccggtgctcgatttagagctcacgtattgggtttgggggagtcagactcagtcaggacacagcatggacatgagggtccccgctcagctcctgggctcctgctgctctggctcccaggtgccaaatgtgacatccagatgacccagtcctccgtccaccctgtctgcatctgtcggagacagagtcaccatcacttgccggcagtcagagtattactaaatggttggccttggtttcagcaagaaaccaagggaaacgaccccaaaagtcctagatctctgccgtcctctactttgcaaaggtcgggtacccatcgaaggttcagcggacgtaggtggagtcgtagggacaagtaattcgagtctaccaccattcgaacgtcgacgcccgtgaccacgtccctaggtaacgttattttcgaccttaacctttacgtactcgaccaagtgactaaagttaataatctaggtttcggacgggaacggaccgtaagggtcggaagaacgttacgaaacggtaacgttaggtcggtcgttaccggacctaaccgtacttacgttnttaccttccgtactttcccccgg

SEQ ID NO: 226706 - DNA, 646 bp, Homo sapiens
  misc_feature: GYAE6OF01CQ6G9.15.28.C06.1.454.CMB.1.raw
tcagtctacgtagccacgaccggtgctcgatttagagctcacgtattggggtttggggggagtcagactcagtcaggacacagcatggacatggacgggtcccccgctcagctccgtggggcctcctgctgctcgtggcctcccgaggtcgaccaaatgtgacatccagatcgacccagtcctccgtcccaccctgtctgcatctgtcggagacagacgtccaccatcacgttcggcccggcagtcagtagttattaactaagttggttcgccgttggttcagacaacgaaaccgaagggaaaccgacccctaaaagtcctagactcctcgtcgcccgtccttacttacgtttgacgtaaagggttccgggtacccagtacgtaacggttcgacggcggacgtaggtggactcggtaggacagtaatcgagtccacaccatcagcgacgtccgtgcacgcctagtaacgttgtttacgacttaacttactacgtctacgtagtacgtactaaattaactaacgtacgttaggtttcgggaacgggtaacgggtaccgtaagggtaggaacgtacgtaacgaaacggtacgtaggtacggcgtacgaccacgttacgttacgttccgttcttcgtcccgttaccccg

SEQ ID NO: 226707 - DNA, 538 bp, Homo sapiens
  misc_feature: GYAE6OF01D5BQW.15.28.C06.1.454.CMB.1.raw
  modified_base (530)..(530): a, c, t, g, unknown or other
  misc_feature (530)..(530): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgaccccaaaagtcctgatctctgccgcctctactttgcaaagtggggtacccatcgaaggttcagcggcagtggatctgggacagaatcagtctcaccatcagcagcctgcagcctagacgtattttgctaacttactactgaccaagtgactaataattaatcgtatttcgggacggtacgggaccaagggtggaagtactacgaaacgtaacgttaggtcggacgtcgactaccgtattcctagttccttcgntttccccg

SEQ ID NO: 226708 - DNA, 539 bp, Homo sapiens
  misc_feature: GYAE6OF01AO9LC.15.28.C06.1.454.CMB.1.raw
  modified_base (331)..(331): a, c, t, g, unknown or other
  misc_feature (331)..(331): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggttgctggttcagcagaaaccagggaaagaccccaaagtcctagatctctgccgcctctactttgcaaagtgggtccatcaagtcagcgnagtgatcgtggacagtatcagtctcacatcagcacgcctgcacgcctgtactatttcgactaacttactactcgactagtgactaataataatcgtacgtttcgggacggtaacgggaccgtaagggtggaacgtaacgtaccgaaaacggtacgtagggtacggctacgaccaccgtacttacttcgttcttccgtactttaccccg

SEQ ID NO: 226709 - DNA, 515 bp, Homo sapiens
  misc_feature: GYAE6OF01CR1IA.15.28.C06.1.454.CMB.1.raw
  modified_base (176)..(176): a, c, t, g, unknown or other
  misc_feature (176)..(176): n is a, c, g, or t
  modified_base (323)..(323): a, c, t, g, unknown or other
  misc_feature (323)..(323): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (504)..(515): a, c, t, g, unknown or other
  misc_feature (504)..(515): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccaccatacaaaaagntggaagtgacacaaacctatgtgaactctgtgatgggccgattcaccgtctccagagacgacgccaaagaactcactacatctgcaaaatgaaacaacctgagagccgaggacacggctgtgtattactgtgtgagagatgttctgngttggggccagggaaccctggtcaccgtctcctcagcctccaccaagggcccatcggtccttccccctggccnccctgctccaggagcacctccgagancacagcgccctggctgcctggtcaaggacctacgttccgcttacgtagactggacgcgggctggcgaaaggcgcaacgtagnnnnnnnnnnnn

SEQ ID NO: 226710 - DNA, 621 bp, Homo sapiens
  misc_feature: GYAE6OF01DS0XD.15.28.C06.1.454.CMB.1.raw
  modified_base (606)..(607): a, c, t, g, unknown or other
  misc_feature (606)..(607): n is a, c, g, or t
  modified_base (609)..(609): a, c, t, g, unknown or other
  misc_feature (609)..(609): n is a, c, g, or t
  modified_base (612)..(614): a, c, t, g, unknown or other
  misc_feature (612)..(614): n is a, c, g, or t
  modified_base (617)..(621): a, c, t, g, unknown or other
  misc_feature (617)..(621): n is a, c, g, or t
tcagtctacgtagccacgaccggtgctcgatttagagctcacgtattgggtttgggggggggtccctgagactctcctgtgaagcctctggattcaccttgagcacttattggatgacttgggtccgccaggctccagggaggggctggagtgggtggccaccataacaaaaagatggaagtgacacaacctatgtgaactctgtgatgggccgattcaccgtctccagagacgacgccaaagaactcactacatctgcaaaatgaaacaacctgagagccgaggacacggctgtgtattactgtgtgagagatgttctgcggttgggcagggaaccctggtcacgtctcctcagccctaccacgaacgggccctaatcggtcccttcccccgtggcccgtcccctggcccttacccgaagggacgcccgaacccgtccggaaggacgccaaaccgacggcccgggccccgttggggccgtacggtcccgtaggggtaccaaacgggtacctttaaccgttacccggaccttaaaccggtaacgtaccgttagggacgggaccggggcgttacgggaccgaaaggggtcccgaacgaagtaacggnngnacnnncannnnn

SEQ ID NO: 226711 - DNA, 576 bp, Homo sapiens
  misc_feature: GYAE6OF01CPY14.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccagggaaacaccccaaaagtcctgactctctcgccgtcctctactttgactaaaggtcgggtacccagtctaaggttcaggcggcagtggatcgtggacagaattcagtctcaccatcagcagcctgcagcctgacgtatttcgactaacttactactcgacctaagtcgactaataaataatacgtagtttaccgggacgggtaacgggtaccgtaaagggttggaagtaacgtaccgaaaacggtaacgttggtacggtccgtacgaccaaccgtacttaccgttagttacccttcgtacgtttaccccg

SEQ ID NO: 226712 - DNA, 545 bp, Homo sapiens
  misc_feature: GYAE6OF01EMRUI.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggtttcagcagaaaccagggaaagacccaaaagtcctgatctctgccgcctctactttgcaagtcggggtcccatcaaggttcagcggcagtgatcgtgggacagaattcagtctcacatcagcacgcctgcagcctagacgtatttgactaacttactactcgaccaagtgacaataataactcgtagttcgggacgggagggaccgaagggtgggaacgtagtaacgaaaacggtacgtaggtacggcgtacggaccaaccgtactcgttagttcctttcctacgttcccccg

SEQ ID NO: 226713 - DNA, 597 bp, Homo sapiens
  misc_feature: GYAE6OF01B6KMH.15.28.C06.1.454.CMB.1.raw
  modified_base (361)..(361): a, c, t, g, unknown or other
  misc_feature (361)..(361): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggtgcctggttcagcagaaccgaggaaacgacccaaagtcctgatctctgccgcctctacttgacaagtcgggtacccatacaaggttcagcgcagtggatcgtgggacagaattcagtcncacatcagcagcctagcagcctagacgtatttcgactaacttactactcgacctaagtcgtacaattaacttaacgtacgttaacggtttccgggacgggtaacggggtaaccgtaaaggggttacggaacgtaaacgttaaccggaaaacggtaaccggttagggtacgggtcctacgggtaccctaaccgtacttcccggttacggttccctttaccgtaccgtttacccccgg

SEQ ID NO: 226714 - DNA, 626 bp, Homo sapiens
  misc_feature: GYAE6OF01BF7R6.15.28.C06.1.454.CMB.1.raw
  modified_base (180)..(180): a, c, t, g, unknown or other
  misc_feature (180)..(180): n is a, c, g, or t
  modified_base (207)..(207): a, c, t, g, unknown or other
  misc_feature (207)..(207): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (618)..(626): a, c, t, g, unknown or other
  misc_feature (618)..(626): n is a, c, g, or t
tcagtctacgtagccacgaccggtgctcgatttagagctcacgtattgggtttgggggggggtccctgagactctcctgtgaagcctctggattcaccttgagcactttattggatgacttgggtcccgccaggctccgaggggaaggggctggagtgggtggccaccataacaaaaagntggaagtgacacaacctatgtgaactntgtgagtgggccattcaccgtctccagagacgacgccaagaactcactacatctgacaaatgaacaacctgagagccgaggacacggctgtgtattactgtgtgagagtattgttcgtggtcgggttcggggacccgaaggggtaacccccgttgggtacccgaacccggttcctcccgtacaccgtcccctcccgaacccgaacggggcccctaagttcccggttaccctttccccccgtgggccccgtccccgttgcccttaccgagggacgcccacccgtccggaagacgcaaccgacggcccggcccgtgggcctcgccggtggtacgaaggtacctactccgtactacgtacgtacgtaggacggcgggcgtgggacgaacgggccgacgaggtacgngcngtacnnnnnnnnn

SEQ ID NO: 226715 - DNA, 499 bp, Homo sapiens
  misc_feature: GYAE6OF01E0UDA.15.28.C06.1.454.CMB.1.raw
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgctctactttgcaaagtggggtcccatcaaggttcagcggcagtggatctgggacagaattcagtctcaccatcagcagcctgcagcctgacgtattttgctaacttactactgaccaagtgacataataatctatttcggcggaggaccaaggtggagatacgaaacgaactgtggctcgcaccatctntcttcnttccc

SEQ ID NO: 226716 - DNA, 748 bp, Homo sapiens
  misc_feature: GYAE6OF01BCHS4.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgctagtcgtggtacggagacgagacgtccaccatcctacgttcggcccgggccagtcaaggtagttaattaacgtaaaagttcgggttcggtaccgttggtttacgaagcgaaacggaaaaccgaggggaaaccgaccccgtaaaagtccgtagacttacgtccgtacgccgtccttacttacgtttacggaccgtaaaggtcggggtaccctagtacgtaagggttcacggtcggactaggtaggtacgtcgtacgggaacgtaacggtaacttcgacggtctaccacctagtacgacgcaaccgtccgtacgactacgtaccgtacggtaacgttactttcggaacttaaccgttaacctacgtacgaaccgttaaggtacgtaactaagttaactaacgttacgtaacggttttaccggggaacggtaacggggtaaccgttaaggggtaaggtaaccgtaagttaaaacccggaaaacggttacgtagggtacgtaccggtaccgtaaccgtaacccgtacttacgtttacgttaccgtttaccgtcgtttaaccccccgg

SEQ ID NO: 226717 - DNA, 590 bp, Homo sapiens
  misc_feature: GYAE6OF01D53PS.15.28.C06.1.454.CMB.1.raw
  modified_base (416)..(416): a, c, t, g, unknown or other
  misc_feature (416)..(416): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccgggccagtcagagtattactaaatggttggcctggtttcagcagaaaccagggaaacgaccccaaaagtcctgatcctctcgccgccttactactttgacgtaaaggtcggggtacccataccgaaggttcagcggcagtggatcgtagggacagtaattcagtctcaccatcagcagctgcagcgtagacgtatttnactaactttactactgaccaatcgactaattaataattacgtaagtttaccgggacgggtaacgggtaccgtaagggtggaacgtaacgtaaccgaaaacggtacgttagggtacggccgttacggaccctaaccgtaacttccgtttagttaccctttctaacgtttcccccg

SEQ ID NO: 226718 - DNA, 540 bp, Homo sapiens
  misc_feature: GYAE6OF01B6AKP.15.28.C06.1.454.CMB.1.raw
  modified_base (399)..(399): a, c, t, g, unknown or other
  misc_feature (399)..(399): n is a, c, g, or t
  modified_base (528)..(540): a, c, t, g, unknown or other
  misc_feature (528)..(540): n is a, c, g, or t
tcagtctacgtagccacgaccggtgctcgatttagagctcacgtattggggtttggggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaaagaactcactacatctgacaaaatgaaacaacctgagagccgaggacacggctgtgtattactgtgtgagagatgttctggcggttgggccagggaaccctggtcaccgtctcctcagccctacgaccgaacgggcccagtccggtccttccccgngccgccctgcctcgaggcgcccaccgtccgagacgacacgcggccggccctgggctcgccgtggtacaaggtacctacgttccgcgtacgtagcgtgacggcggtcgtcggacgaacggcgactagcgnnnnnnnnnnnnn

SEQ ID NO: 226719 - DNA, 531 bp, Homo sapiens
  misc_feature: GYAE6OF01A7MPJ.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgacaaagtgggtcccatcaaggttcagcggcagtggatcgtgggacagaattcagtctcacatcagcagcctgcagcctgacgtattttgactaacttactactgaccaagtgacaattaataactactagtttcgggacggagggacctaagggtagagagtacgaaaccggtaacgtggtaggctcgaccactacttccgtagttccttccgattccccg

SEQ ID NO: 226720 - DNA, 528 bp, Homo sapiens
  misc_feature: GYAE6OF01AGXQI.15.28.C06.1.454.CMB.1.raw
  modified_base (456)..(456): a, c, t, g, unknown or other
  misc_feature (456)..(456): n is a, c, g, or t
  modified_base (477)..(477): a, c, t, g, unknown or other
  misc_feature (477)..(477): n is a, c, g, or t
  modified_base (522)..(522): a, c, t, g, unknown or other
  misc_feature (522)..(522): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttggctggttcagcagaaaccagggaaagccccaaaagtcctgatctctgccgcctctactttgctaaagtcgggtacccatcgaaggttcagcggcaggtggatctgggacagtatcagtctcaccatcagcacgcctgccagcctgacgttatttcgacctaacttactactacgacctaagtcgactaataatatacgtagtttccgggnggaacgggaccgagggtgganacgtacaaacgtagtggtcggctagaccacgtatctatcttcgtnttcccg

SEQ ID NO: 226721 - DNA, 670 bp, Homo sapiens
  misc_feature: GYAE6OF01EFHM4.15.28.C06.1.454.CMB.1.raw
  modified_base (106)..(106): a, c, t, g, unknown or other
  misc_feature (106)..(106): n is a, c, g, or t
  modified_base (210)..(210): a, c, t, g, unknown or other
  misc_feature (210)..(210): n is a, c, g, or t
tcagtctacgtagccacgaccggtgctcgatttagagctcacgtattgggttttggggggagtcagactcagtcaggacacagcatggacatggacgggtccccgntcagctccgtggggcctcctgctgctctggcctcccgaggtcgaccaaatgtagacatccagatcgacccagtcctccgtccacctgtctgcatctggtcgganacagactcacatcacgttcgccggcagtcagtattaacttaactaaagttggttcggccgtttggtttcagtaccaaacgaaaccgaacgggaaaccgaaccccgtaaaagtcctagactcctcgtcgcccgtccttcttacgttgacgtaacgggtcgggtaccagtacgaaggttcgagcggacgtagtggacgtcgtaggacagtactcacgtcacacatcgagacacgctgacacgctagtacgtttatttacgaccttaaccttactacgtcgacgtaagtcgtaactaattaattacgttaccttacggtttacccgggaacgggtacgggtaaaccgtaagggtacggtaaacgtaacgtaaaccgtaaaacggtacggttagggtacggtacgttacgaacccgtaacccgttattccgttaccttacctttacccgtaacgtttccccccg

SEQ ID NO: 226722 - DNA, 578 bp, Homo sapiens
  misc_feature: GYAE6OF01DEX8M.15.28.C06.1.454.CMB.1.raw
  modified_base (409)..(409): a, c, t, g, unknown or other
  misc_feature (409)..(409): n is a, c, g, or t
  modified_base (566)..(566): a, c, t, g, unknown or other
  misc_feature (566)..(566): n is a, c, g, or t
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttgctggttcagcaagaacagggaaacacccaaaagtcctgatctctcgccgtcctctactttcgactaaagtcgggtcccatacgaaggttcagcggcaggtggatcgtaggacaaggtaattcgagtctcaaccatacagcagcctgcacgctagtaacgttnttttacgcttaacttacctactcgtaccaagtcgactaataaacttaatacgtaacgttacgggacgggtacgggaaccgtaagggtagaggactaacgaaacggtaagtaggtacggtacgtacgacctaaccgtacttacgttacgttccttacnccgtttaccccg

SEQ ID NO: 226723 - DNA, 602 bp, Homo sapiens
  misc_feature: GYAE6OF01A39FL.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttgccgggccagtcagagtattactaatggttgcctggttcagcaagaaaccgagggaacacccgaaaagtcctgatctctcgccgtcctctactttgactaaaggtcgggtacccagtacgtaacggttcgaggcggacgaggtggatcgtagggacagtaactcgacgtctacacatacagcacgctgcagcctagtacgttagtttcgacttaacttacgtacgtcgacctaagtcactaattaacttaactcgtacgttacgggacgggaacgggtaccgaagggtaggaacgtactaaaccggtaaacggtacgttggtacggtctacggaccctaaaccgttacttaccgttacgttaccttttaaccgttcccgttaccccgg

SEQ ID NO: 226724 - DNA, 622 bp, Homo sapiens
  misc_feature: GYAE6OF01BHQIK.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaagtggttggcctggttcagcaagaaaccagggaaacgaccccaaaagtcctgactctcgtcgccgcctttctactttgactaaaggtcgggtcccatcgaaggttcagcggcagtgatcgtagggacagtattcagtctacaccatcagcacgctgcacgtcctagaccgttattttcgacttaaacctttacctacgtacgtaccctaagttacgactaaagttaaacttaacgtacgttaacggtttaccggggacgggtaaacggggaaccgtaaagggggtaggaacggtaaccgttaaaccggaaaaccggtaacgttgggtacggacgttcgaaccctacgtacttccgttacgttccttccgtacccgtttccccg

SEQ ID NO: 226725 - DNA, 734 bp, Homo sapiens
  misc_feature: GYAE6OF01BZ0XG.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctgggctcctgctgctctggctcccaggtgccaaatgtgacatccagatgacccagtcctccgtccaccctgtctgcatctgtcggagacagagtcaccatccacgttcgccggccagtcagagtattaactaatggttgccgtggttcagcaagaaaccgagggaaacgaccccaaaagtcctgactctactcgccgcctctacgtttgacgtaaggtcgggtacccagtacgtaacggttacgacgcggacgtaggtggacgttcgtagggaacctaaggtaactttcgacgttactacccgaacctaagtacaacggccgtaaacgtccccgttagacccgtaacggtacccgtacggtaaccgtttaacgtttttacggaaccctttaaaacccgtttaccgtaacgttaccggaacgttaaacggtcgtaaacttaattaaacgttaacttccgttaacggtttaccgggaacgggtaacgggaaccgtaaaggggtagggaaacgaaacgttaaaccgaaaacccggtaacggttacggttacggggtaccctacggaaccctaaccgtaacgtttacccgtttacggtttacctttccgtaaacccgtttccccccgg

SEQ ID NO: 226726 - DNA, 597 bp, Homo sapiens
  misc_feature: GYAE6OF01BXHN5.15.28.C06.1.454.CMB.1.raw
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggcctggttcagcagaaacagggaacgaccccaaaagtcctgatctactcgcccgtcctctactttgactaaaggtcggggtacccagtacaaggttcagcggcaggtggatcgtggacagaattcagtctacacatacagcacgcctagcacgcctagacgttatttagacctaacttacctacgttacgaccgtaagtcgacaattaaactaatcgttaagtttccggggacgggtaacgggaccgtaaagggtagggaacgtaactaaccggtaaaacggtaacttagggtacggtccgtacgtaccaaccgtacttcgttacggtttcttaccgtactttcccccg

SEQ ID NO: 226727 - DNA, 505 bp, Homo sapiens
  misc_feature: GYAE6OF01CETWF.15.28.C06.1.454.CMB.1.raw
  modified_base (494)..(505): a, c, t, g, unknown or other
  misc_feature (494)..(505): n is a, c, g, or t
tcagtctacgtagccacgaccggtgctcgatttagagctcacgtattgggtttggggggaagaggaagactgacggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcggttggggccagggaccctggtccaccgtctcctcagcctccaccgaacgggcccagtccggtccttccccctggccgcccctgcctccgaggacgccacctccgagacgccacgacggccggccccgtggggcctggcccgttgggtaccaacgggtaccttaccgttcccgcgttaaccgtagaccgtggacggcgggcgtgggcgaagggccgacagtgnnnnnnnnnnnn

SEQ ID NO: 226728 - DNA, 511 bp, Homo sapiens
  misc_feature: GYAE6OF01A6HYY.15.28.C06.1.454.CMB.1.raw
  modified_base (501)..(501): a, c, t, g, unknown or other
  misc_feature (501)..(501): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatcgtgggacgaattcagtctcaccatcagcagcctgcagcctgacgtattttgactaacttactactcgccaagtgctaataataatctagtttcggacggagggaccgaaggtggagatacgaaacgacgtggtggctgcaccatctagtcttcnttccgtcccg

SEQ ID NO: 226729 - DNA, 695 bp, Homo sapiens
  misc_feature: GYAE6OF01EW4O2.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaagtggttggccttggttcagcaagaaaccgagggaaacgaccccaaaagtcctagactctctcgccgtccttctactttgacgtaaaggtcggggtcccagtacgtaacggttcgaggcggacgtaggtggtactcggtacgggacaagtaacttacgacgttctaccaacctactacgaacgccgaacgtcctggaccgtacgtcccgttaggtacgttacgttttacgaaccttaaaccgtttaacctacgttaccggtaacccgtaaggttcggtaacctaaatttaaacttaaacgttaccgttaacggtttccggggaacgggtaaccggggtaaccgtaaggggtaggtaacgtaacgtaaccggtaaaacggtaaccgttaggttacgggtcctacggtacctaacccgtacgtttccgtagtttacccttacgtaccgtttaccccg

SEQ ID NO: 226730 - DNA, 520 bp, Homo sapiens
  misc_feature: GYAE6OF01EJDHL.15.28.C06.1.454.CMB.1.raw
  modified_base (360)..(360): a, c, t, g, unknown or other
  misc_feature (360)..(360): n is a, c, g, or t
  modified_base (513)..(513): a, c, t, g, unknown or other
  misc_feature (513)..(513): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttgccggccagtcagagtatactaaatggttgcctggtttcagcagaaaccaggaaacgccccaaaagtccctagatctctgccgctctactttgctaaagtgggtccatcaaggttcagcgcagtgatctggacagattcgagtcncaccatcagcagcctgcagtcctgacgtatttcgactaacttactactcggtactaagtgactaataataatcgtaagtttcggacggacgggtacaagggtagacgtaagtacaaacgtacgtgtacgctagacacctagtacttgtcttcngttcccg

SEQ ID NO: 226731 - DNA, 800 bp, Homo sapiens
  misc_feature: GYAE6OF01AKVCW.15.28.C06.1.454.CMB.1.raw
  modified_base (332)..(332): a, c, t, g, unknown or other
  misc_feature (332)..(332): n is a, c, g, or t
tcagtctacgtagccacgaccggtgctcgatttagagctcacgtattgggtttggaggtctcagagaggtagcccttagcccgtggactccgaaggccctttccacttggtgatcagtccactgagcacagaggacctcaccacggaattggggacttgagctgggttttccttgttgctatttagaacggtgtcctagtgtgagggtagcaactggtgagtcgtggggaggcctgtccaggcccggggggtcctggacgacctctccgtgtggaacgcctacgtcggacttccaccgttgacgctacttattggatgtacgttgggtaccnccgaggcctacccggaggggaacgggctgggaggtcgggttcggacgtttacgaaaaaggttaaaaacgtggaagtagggtaggtaaaggtaaaacgtagggaaccgttaacgggtcgtaccgaacccggttaaggaaaacgggtaaacgtaactttaccggaaaccctacgttaccgtaaccgaaaggaacgtaactttaaacgtaacgtaaaaaaccggtcggttaagttaagtttacgaactaaacgtaggaaaccgtaacgtacccgtaaggaaaacccgacggtaaccgtaccgtacggtacccgttaccgttaacgtttaccgtaacgtaacccgaactaacggtacgtttaaccgggaacggttagaaccgtaacgttaccggtaacgggtaaagggtcgggtacctaagttaccggttcgtttttagacgtttacgttcccgggtcggggtaacccccgg

SEQ ID NO: 226732 - DNA, 571 bp, Homo sapiens
  misc_feature: GYAE6OF01BRZXT.15.28.C06.1.454.CMB.1.raw
  modified_base (275)..(275): a, c, t, g, unknown or other
  misc_feature (275)..(275): n is a, c, g, or t
  modified_base (394)..(394): a, c, t, g, unknown or other
  misc_feature (394)..(394): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggtttcagcagaaaccagggaaacnccccaaaagtcctgatctctgccgcctctactttgacaagtcgggtccatcaaggttcagcggacaggtgatcgtggacagaatcagtctcaccatcagcagcctgcagcctagacgtntttcgactaacttactactcgacctaagtcgactaattaaatactcgtaaggtttccgggacgggtaacgggaccgtaaggggtcggaagtacgtaacgaaaaccggtacgttggtacgggtcctacggaccctaacccgtacgttccttacgttccctttcgaccgtttacccccg

SEQ ID NO: 226733 - DNA, 590 bp, Homo sapiens
  misc_feature: GYAE6OF01B1GAG.15.28.C06.1.454.CMB.1.raw
  modified_base (231)..(231): a, c, t, g, unknown or other
  misc_feature (231)..(231): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtntacaatggttgctgtttcagcagaaacaggaaacgccccaaaagtcctgactctcgtgcccgcttctactttgactaaagtcgggtccatcgtaaggttcaggcggacagtggactgtgggacaggtaacttcagtctccacatcagcagcctgcacgcctgacgttatttcgactaaccttactactgacctaagtcgactaattaagtaacttcgtacgttttacgggacggtaaggggaccgtaagggtcggtaagtaaccgtaacgtaaaacggtaccgttagggttacgggtaccttacgacccgtaaaccgtacttaccgttacggtttccctttagtacccgtttacccccg

SEQ ID NO: 226734 - DNA, 594 bp, Homo sapiens
  misc_feature: GYAE6OF01EECY1.15.28.C06.1.454.CMB.1.raw
  modified_base (439)..(439): a, c, t, g, unknown or other
  misc_feature (439)..(439): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(594): a, c, t, g, unknown or other
  misc_feature (586)..(594): n is a, c, g, or t
tcagtctacgtagccacgaccggtgctcgatttagagctcacgtattgggtttgggggggggtccctgagactctcctgtgaagcctctggattcaccttgagcacttattggatgacttgggtccgccaggctccagggaaggggctggagtgggtggccatcatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagtatgttctggcggttggggaccgaacgggaacccctggtaccacccggttcctccctcgacgccctacccaaccgaacgggcccctagtccggttcccctccccgtggcccgtccctcgcctccgaggcnccgaccctccggagcgacaccgacgcccggacccgtgggcctcggccgttcgggtacaacgggtaccttccgttccgcgttaacggtagtaccgtgggacgggccgggtcgtcgggaccgaacgggccgaacgtagtaggacngngnnnnnnnnn

SEQ ID NO: 226735 - DNA, 517 bp, Homo sapiens
  misc_feature: GYAE6OF01EP7Y6.15.28.C06.1.454.CMB.1.raw
  modified_base (506)..(517): a, c, t, g, unknown or other
  misc_feature (506)..(517): n is a, c, g, or t
tcagtctacgtagccacgaccggtgctcgatttagagctcacgtattgggtttgggggggtccctgagactctcctgtgaagcctctggattcaccttgagcacttattggatgacttgggtccgccaggctccagggaagggctggagtgggtgccaccatacaaaaagatggaagtgacacaacctatgtgaactctgtgatgggccattcaccgtctccagagacgacgccaagaactcactacatctgcaaatgaacaacctgagagccgaggacacggctgtgtattacttgtgtgagagatgttctgcggttggggccagggaacccctggtccaccgtctcctcagcctccaccaagggcccatccggtccttccccctggccaccctcctccaacgacgccacctcgtgggggcacgacgccggccctgggctcgcctggtcgaacggacttacttccgctacgtagactgaggcgggctgggcaagggcgcgatagnnnnnnnnnnnn

SEQ ID NO: 226736 - DNA, 680 bp, Homo sapiens
  misc_feature: GYAE6OF01BPET0.15.28.C06.1.454.CMB.1.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagtagtattaactaaagtggttggccttggttacagacaagaaaccgaagggaaacacccaaaagtcctagactctctcgcccgccttactactttgacgtaaaggtcgggtaccctagtacgtaaggttcgaggcggacaggtagggactcggtaggggaactaaggaaacttcgacgttcctacgtaaccatacgaacgacgtacgccgtacgacctacgtcccgttaggtaacgttactttttacgaaccgttaaacctttacctaaccgtacgaccgtaaagttacgaactaaagttaaacttaagtacgtaaggtttaccgggaaccgggtaacgggaaccgtaaggggtaggtaacgtaactaaacggtaaaccggtaacgttgggtacggtactcggtaacaacccgttacttacgttacgttacttccgtaacctttacccccgg

SEQ ID NO: 226737 - DNA, 476 bp, Homo sapiens
  misc_feature: GYAE6OF01APJTJ.15.28.C06.1.454.CMB.1.raw
  modified_base (362)..(362): a, c, t, g, unknown or other
  misc_feature (362)..(362): n is a, c, g, or t
  modified_base (468)..(476): a, c, t, g, unknown or other
  misc_feature (468)..(476): n is a, c, g, or t
tcagtctacgtagccacgaccggtgctcgatttagagctcacgtattgggtttggggggaagaggaagactgacggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctgggtcaccgtctcctcagcctccaccaagggcccatccggtcttccccctggccgcccctgcctccaggacnccacctccgagagcacgagccggccctgggctcggcctgggtcaagggtacctaccgttccgctacgtagacctggacggcggggctgggacaaggccgacatagnnnnnnnnn

SEQ ID NO: 226738 - DNA, 565 bp, Homo sapiens
  misc_feature: GYAE6OF01D2EBO.15.28.C06.1.454.CMB.1.raw
  modified_base (202)..(202): a, c, t, g, unknown or other
  misc_feature (202)..(202): n is a, c, g, or t
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagngtcacatcacttgccggcagtcagatattactaatggtgctggttcagcaagaaacaggaaacacccaaaagtcctagatctctgccgtctctacttgacaagtgggtccatacaaggtcagcgcagtgatcgtggacagaatcagtctacacatcagcagcctgcacgtctagacgtatttcacgtaacttactactcgaccgtaagtacgactaagtaacttaactcgttaaggtttcgggaacgggtaacgggaaccgtaaggggtacggtaaggtaactaaaccggaaaacgtaacgttggtacggtctacggacctaaccgtacttacgttacgttactttccgtacgtttacccccg

SEQ ID NO: 226739 - DNA, 588 bp, Homo sapiens
  misc_feature: GYAE6OF01D0D7F.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttcgccggccagtcagagtattactaagtggttggcctggtttcagctaagaaaccgagggaaacaccccgaaaagtcctagaactctcgtcgccgtcctctactttgactaaagtcgggtccagtcaacggttcagcggcagtgatcgtgggacaggtaatcgagtctcaccatcagcagcctgcacgtcgtagtacgtattttcgacttaacttactacgtcgacctaagtcgactaataacttaactaccgtaggtttaccgggcgggtaacgggaccgtaaggtacggaagacgtaacgaaacggtaccgtaggtacggtcgttaccgaccgtaaccgtagttaccgttgttaccgttcgtacttccccg

SEQ ID NO: 226740 - DNA, 719 bp, Homo sapiens
  misc_feature: GYAE6OF01CG79W.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccagtctccgtccaccctgtctgcatctggtcggagacagacgtcacctatcacgttcggccgggccagtcagagttaattaacgtaaatggttacggccgttggtttcagacgaacgaaaccgagggaaacgaccccaaaagtcctagaactctctcgtaccgtcctacttacgtttcgacgtaaaggttcggggaccctagtacgaaacggttcgacgcggtacgtaggtggacgtacgtcgggaacgaacgtaagttaccgtagtaccttaccgaaaccctagtacgaacggtcctaacggtcccgtgtaccgtacccgtaccgttaacggtaaccgtttagttttaccgaacctttaaacccgtttacgtaaccgtaccgtaaccctaagggttacctaacgtaaactttaaacgtaacttaccggttaacggtttacggggaccgggtaaacgggtacgtaaggggtacggtaagtaaccgaacgtaaacggtacgttaggtacggtcgtacgtccgaactacgttcttaccgttcgttccacgtttccccg

SEQ ID NO: 226741 - DNA, 691 bp, Homo sapiens
  misc_feature: GYAE6OF01A412R.15.28.C06.1.454.CMB.1.raw
  modified_base (383)..(383): a, c, t, g, unknown or other
  misc_feature (383)..(383): n is a, c, g, or t
tcagtctacgtagccacgaccggtgctcgatttagagctcacgtattgggtttggaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccgaggccgggggggtccctgacgacctcgtcctgtgaagcctcgtggattcaccgttgagcacttattggatgtacgttgggtccgccgaggctccggaggggtaacggggctagggaggttggggtcggcccgaaccaataaacgaaaaaagngtagggaaagtggaacacgaaaccttagtcggtagtaacttctaggtaggaagtcggggtacctaactttccgacccgttctaccgagacgaccgaccgaccaaagaacctccaactactataccgtacgaactaaacgtacgaaaccaacgtaggaacgaacggacccggtaagggaccgtacgggtacgtacggttagttaacgttacgttggttaggtaggaaggtagtacgtttcgttcgttgggtaccggggtttcggggaacccgtaacggggtaaccccgttgggtaacccgttaccccgg

SEQ ID NO: 226742 - DNA, 578 bp, Homo sapiens
  misc_feature: GYAE6OF01DEI0W.15.28.C06.1.454.CMB.1.raw
  modified_base (440)..(440): a, c, t, g, unknown or other
  misc_feature (440)..(440): n is a, c, g, or t
  modified_base (455)..(455): a, c, t, g, unknown or other
  misc_feature (455)..(455): n is a, c, g, or t
  modified_base (568)..(578): a, c, t, g, unknown or other
  misc_feature (568)..(578): n is a, c, g, or t
tcagtctacgtagccacgaccggtgctcgatttagagctcacgtattgggtttgggggggggggtccctgagactctcctgtgaagcctctggattcaccttgagcacttattggatgacttgggtccgccaggctccaggggaaggggctggagtgggtggccaccatacaaaaagatggaagtgacacaacctatgtgaactctgtgagtgggccgattcaccgtctccagagacgacgccaaagactcactacatctgacaaatgaaacaacctgagacgccgaggacacggctgtgtattactgtgtgagagattgttctggcggttggggaccacgggtaaccctggtccacccggttctcctcacgccctaccaaccgaacgggcccctagtccggtccttcccccgtggcccgtccctcgcctccgacggacnccaccgtcgacgacnccacgacggcccgggtcccgtgggccgtcgcccgtggtacgaaggacctttaccgtcccgtccttaacggtagtacgtggacggcgggcctgggaccgagggccgcgaagtgnnnnnnnnnnn

SEQ ID NO: 226743 - DNA, 477 bp, Homo sapiens
  misc_feature: GYAE6OF01AYHZ4.15.28.C06.1.454.CMB.1.raw
  modified_base (462)..(477): a, c, t, g, unknown or other
  misc_feature (462)..(477): n is a, c, g, or t
tcagtctacgtagccacgaccggtgctcgatttagagctcacgtattgggtttggggggaagaggaagactgacggtccgccaggctccagggaaggggctggagtgggtggccaccatacaaaaagatggaagtgacacaacctatgtgaactctgtgatgggccgattcaccgtctccagagacgacgccaagaactcactacatctgcaaaatgaacaacctgagagccgaggacacggctgtgtattactgtgtgagagatgttctgcggttggggccagggaaccctggtcaccgtctcctcagcctccaccaagggcccatcggtccttcccccgtggccgccctgctccgaggacgccacctccgagacgcacacggcggccctggggctgcctggtacaacggtactacttccgctacgtagactggacgcgggctgggacaaggcgacatcgnnnnnnnnnnnnnnnn

SEQ ID NO: 226744 - DNA, 564 bp, Homo sapiens
  misc_feature: GYAE6OF01DJZBV.15.28.C06.1.454.CMB.1.raw
  modified_base (398)..(398): a, c, t, g, unknown or other
  misc_feature (398)..(398): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaagtggttggccttggttcagacaagaaaccgagggaaacgaccccaaaagtccctagactctctcgccgtcctctactttgactaaaggtcgggtaccatcgaaggttcagcggcagtggatcgtggaacagtaatcagtctcaccatcagcacgctcgcancgtagtacgtatttgactaacgttactactacgacctaagtcgactaataattaactcgttagtttccgggacgggtaacgggacgtaagggtcggtaagacgtacgaaacggtacgtaggttacggcgtacgaccaactagttccttagtccttctacgttcccg

SEQ ID NO: 226745 - DNA, 604 bp, Homo sapiens
  misc_feature: GYAE6OF01CH8A3.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttcgccgggccagtcagagtattaactaaagttggttaggccttggtttacagcaagaaaccgaagggaaacgaccccaaaagtcctagatctctcgcccgcctctactttgacgtaaaggtcgggtacccatcgtaaggttcacggcggcaggtggatcgtgggtacgaattcgacgtctacaccatcgacgcacgcctgcacgcctagacgttatttcgactaacttactactgaccaagtcgactaataataacttacgtaagttccgggacgggtaacggtaacggaaggtacggaagtacgtaaccgtaaaacgtacggtacggtaggtacctaggacccaactaccgttcgtacgttaccttcctaccgttcccgttaccccgg

SEQ ID NO: 226746 - DNA, 539 bp, Homo sapiens
  misc_feature: GYAE6OF01EKCA6.15.28.C06.1.454.CMB.1.raw
  modified_base (175)..(175): a, c, t, g, unknown or other
  misc_feature (175)..(175): n is a, c, g, or t
  modified_base (527)..(539): a, c, t, g, unknown or other
  misc_feature (527)..(539): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccacatacaaaaagntggaagtgacacaacctatgtgaactctgtgatgggccgattccaccgtctccagagacgacgccaaagaactcaactacatctgacaaaatgaacaacctgagagccgaggacacggctgtgtattactgtgtgagagatgttctgcggttgggccagggaaccctggtcaccgtctcctcacgcctccaccgaagggcccagtccggtccttccccgtggccgccctgcctccgaggacgccaccgtccgagacgcacgagccggcccgtgggctcgcctggtacaaggtcctactccgacttaccggtagacgtgacggcgggcgtcgggacgaaggcgacgagtaggnnnnnnnnnnnnn

SEQ ID NO: 226747 - DNA, 601 bp, Homo sapiens
  misc_feature: GYAE6OF01AV7AA.15.28.C06.1.454.CMB.1.raw
  modified_base (387)..(387): a, c, t, g, unknown or other
  misc_feature (387)..(387): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagacgtcaccatcacttggccggcagtcagatattactaatggtgctggttcagcagaaccgaggaacgacccaaaagtcctagatctctcgccgtcctctactttgacgtaaacggtcgggtaccagtcgtaaggttcacggcggacgaggtcgagtcgtagggacaagtattcagtctacacctancgacgacagcctagcgacgtccgtagtacgttatttacgaccttaacttaccgtactcgaccagtcgaactaataacttacgtacgtacggttaccgggacgggtaacgggaaccggtaagggtacggaagtaacgtaaccgaaacggtaccgtaggtacggtcgtaccgacgtaaccgtacttaccgttaccgttcttccgtaccgttccccg

SEQ ID NO: 226748 - DNA, 568 bp, Homo sapiens
  misc_feature: GYAE6OF01AKFPR.15.28.C06.1.454.CMB.1.raw
  modified_base (557)..(568): a, c, t, g, unknown or other
  misc_feature (557)..(568): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctgggagtgggtggccaccatacaaaaagatggaagtgacacaacctatgtgaactctgtgatgggccgattcaccgtctccagagacgaccgccaagaactcactacatctgacaaatcgaacaacctgaagacgccgaggacacggctgtgtatactgtgtgagagatgtctgcgttgggccagggacctggtcaccgtctcctcacgcctccaccgaggcccatccggtcccttccccgtggccgtccctcgcctccgacggacgccgaccgtccgagacgcgacgacgccggcccgtcgggcgtcggtccgtacggtaccgaacgggtaccttaccgttcccggtaccgtaacggtacgtacgtcggaacgggtcgggcgtcgggcgaacgggccgagagtacggnnnnnnnnnnnn

SEQ ID NO: 226749 - DNA, 512 bp, Homo sapiens
  misc_feature: GYAE6OF01EIWR5.15.28.C06.1.454.CMB.1.raw
  modified_base (430)..(430): a, c, t, g, unknown or other
  misc_feature (430)..(430): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaaatggttggcctggtttcagcagaaaccagggaaagaccccaaaaagtcctagatctctgccgcctctactttgcaaaagtgggtcccatcaaggttcagcgcagtggatctgggacagaatcagtctcacatcagcagcctgcagcctgacgattttgcaacttactactgccaagtgcaataataatnatttcggacgagggtaccaagggtgagatacgaaaacgaactagtaggctaggccaaccctagtctgttcttcgaacttccc

SEQ ID NO: 226750 - DNA, 554 bp, Homo sapiens
  misc_feature: GYAE6OF01BFXQZ.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggttcagcagaacagggaaacgcccaaaagtcctgatctctcgccgcctctactttgacaaggtcgggtcccatcgaaggttcagcggcagtgatcgtggacagattcagtctcaccatcagcacgcctgcagcctgacgtatttcgacctaacttacctacgtagaccctaagtacgactaataaacttaactcgtaagtttcgggacggtaacgggaccgaagggtaggaacgaactaacgaaaccgtacgtggtacggacttcgacctacgtacttcgttagtccttcgactttacccccg

SEQ ID NO: 226751 - DNA, 548 bp, Homo sapiens
  misc_feature: GYAE6OF01D7BKO.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtatactaatgttggcctggttcagcaagaaaccaggaaacgaccccaaaagtcctagactctcgtcgccgcctctactttgacgtaaggtcgggtaccatacgaagtcgagcggcgagtggatcgtagggacagtaattcagtctacaccatacacgcacgcctgacacgtctagtacgtatttacgactaacttactactcgacaagtcactaattaactactacgttagttacgggacggtacgggaccgaaggtaggagtactaacgaaacgtacgtaggtaggctcgacacctatctagttccttcgcgttcccg

SEQ ID NO: 226752 - DNA, 609 bp, Homo sapiens
  misc_feature: GYAE6OF01CGKIP.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccagtcctccgtccaccctgtctgcatctggtcggagacagagtcaccatcacttgccgggcagtcagtagtattaactaaagttggttacggccgttggtttacaggacaacggaaaaccgaaggggaaaacgaccccgtaaaacgtcctaggactctccgtcgcccgtccctcttacgtttcgacgtaaacggtcggggtacccagtactaaggttcgacggcgacgaggtggactcgtgggacagtaattcgagtctcacatcacgcacgtcctgacacgtcgtacgtacgttacgtttcgaccttaacttacctactcgacctagtcgactaataatactctacgttcggacggtacgggacgtaagggtaggaacgacgtaacgaaacggtacgtggtacggtctacgtaccaacgtcgtactgttacttctcgttaccccg

SEQ ID NO: 226753 - DNA, 761 bp, Homo sapiens
  misc_feature: GYAE6OF01CRCSL.15.28.C06.1.454.CMB.1.raw
  modified_base (247)..(247): a, c, t, g, unknown or other
  misc_feature (247)..(247): n is a, c, g, or t
tcagtctacgtagccacgaccggtgctcgatttagagctcacgtattgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagngtctcctgtgtggcctctggattcactttcagtaatggctggatgaggttggtccgccaggctccgaggggaggggctgggagtggggttaggacgtttacgaaaagtaaatgatggtagaagaaaatgactacggtgaccaccggtagaaaggaatattacaaccatactacaagagaattaacttaacgaaaaacgtcgggttaagttaagttttagaacaaagttacggaaaacacggtacccgtaacggaaaaccggaacgggaacaaccgtaacggtcccggttaacttaagtttaaccgtacggttaaaccccaacgtacgggttaagtttaccgggtaaacgtgggaaaccgtaaggtaccggtaaaaccggggttaaaagggaacggggttacctttaaaggttcgggtttaacgtttttttcgggaaaacgttttacgttacccggggggttaacggggtaccccccggtaaaggggggtaaacccttaaagggtttcccggggg

SEQ ID NO: 226754 - DNA, 742 bp, Homo sapiens
  misc_feature: GYAE6OF01EFUH0.15.28.C06.1.454.CMB.1.raw
  modified_base (197)..(197): a, c, t, g, unknown or other
  misc_feature (197)..(197): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagatcaccatcacgttgccgggccagtcagtagtattactaatggttggccttggttcagcaagaaaccgagggaaacaccccaaaagtcctagatctcgtcgccgtcctcttacttcgacgtaaaggtcgggtaccctagtacgtaacggttcgacggtcggacgtaagggtacggtacgtcggtacgggtaacggtaattaccgtacgttcctaccgacctacgtacgacgtaccgacggtcccgtcgaccgtacggtcccgtaggtaaccggtttacgttttaccggaaccttaaacccgtttacgtaaccgtaccgtaacccgtaaggttacgtaaccttaaacttaaacttaacgttacgttaacgggtttaccggggaaccggggtaaccggggtaaccggtaaaggggtacgggtaaacggtaaccgtaaaccgtaaaaccggtaaccgttacgggtacggtaccgtacggtaaccctaacccgttacgttaccgttaccggtttaccttaccgttaccgttcccgttacccccgg

SEQ ID NO: 226755 - DNA, 758 bp, Homo sapiens
  misc_feature: GYAE6OF01EBM76.15.28.C06.1.454.CMB.1.raw
  modified_base (100)..(100): a, c, t, g, unknown or other
  misc_feature (100)..(100): n is a, c, g, or t
  modified_base (200)..(200): a, c, t, g, unknown or other
  misc_feature (200)..(200): n is a, c, g, or t
tcagtctacgtagccacgaccggtgctcgatttagagctcacgtattgggtttggggagtcagactcagtcaggacacagcatggacatgagggtccccnctcagctcctggggctcctgctgctctggctcccaggtgccaaatgtgacatccagatcgacccagtcctccgtcccaccctgtctgcatcgtgtcgganacagagtccacctatctacgttcggccgggaccagtcgagtagttaacttaacgtaagttggttacggccgttggtttacagtacgaaacgaaaaccgaagggaaaccgaccccgtaaaagtcctagactcctcgtacggcccgtcctactttacgttcgaacgtaagggtccgggtaccagttacgtaacggttcgacggtcggacgtaggtagtacgtcggtacggaactaggtaactcgtacgttaccacctaccgtaactaccgacgtaccgtaccgacgtcgaccgtaccgtaccgtacggttaacgtttacgtttacaacccgttaaaccttaccgttaccggtaaccgtaaccgttaagtcgtaaacgttaaacttaaacgttaacttacggttacggtttaaccggggacggggtaacgggaaccggtaaggggtaacggtaacggtaaccgtaaacggtaaaaccggttacgttgggtaccggttaccgaccggtaccctaaccgtttacttaccgttaccgtttacttacccgttccttaccccccgg

SEQ ID NO: 226756 - DNA, 458 bp, Homo sapiens
  misc_feature: GYAE6OF01BU5BE.15.28.C06.1.454.CMB.1.raw
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (416)..(416): a, c, t, g, unknown or other
  misc_feature (416)..(416): n is a, c, g, or t
  modified_base (443)..(458): a, c, t, g, unknown or other
  misc_feature (443)..(458): n is a, c, g, or t
tcagtctacgtagccacgaccggtgctcgatttagagctcacgtattggggtttgggggggaagaggaagactgacggtccgccaggctccagggaaggggctggagtgggtggccaccatacaaaaagatggaagtgacacaacctatgtgaactctgtgatgggccgattcaccgtctccagagacgacgccaaagaactcactacatctgcaaaatgaacaacctgagagccgaggacacggctgtgtattactggtgtgagagatgttctgcgttggggccagggaaccctggtcaccgtctcctcagcctccacaggcccatcggtcctccccnggcgccctgctcaggngccacctcgagagcacacgccggccctgggctgcctggtcaaggactactccgctacgtanactgagcggctgggacaaggcgcatgnnnnnnnnnnnnnnnn

SEQ ID NO: 226757 - DNA, 598 bp, Homo sapiens
  misc_feature: GYAE6OF01CUJ3L.15.28.C06.1.454.CMB.1.raw
  modified_base (130)..(130): a, c, t, g, unknown or other
  misc_feature (130)..(130): n is a, c, g, or t
  modified_base (151)..(151): a, c, t, g, unknown or other
  misc_feature (151)..(151): n is a, c, g, or t
  modified_base (161)..(161): a, c, t, g, unknown or other
  misc_feature (161)..(161): n is a, c, g, or t
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
  modified_base (316)..(316): a, c, t, g, unknown or other
  misc_feature (316)..(316): n is a, c, g, or t
  modified_base (384)..(384): a, c, t, g, unknown or other
  misc_feature (384)..(384): n is a, c, g, or t
  modified_base (429)..(429): a, c, t, g, unknown or other
  misc_feature (429)..(429): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (586)..(598): a, c, t, g, unknown or other
  misc_feature (586)..(598): n is a, c, g, or t
tcagtctacgtagccacgaccggtgctcgatttagagctcacgtattggggtttggggggggggtccctgagactctcctgtgaagcctctggattcaccttgagcacttattggatgacttgggtcccnccaggctccgagggaaggggntggagtgggngccaaccataaacaaaaagntaggaagtgacacaacctntgtgaactctgtgagtcgggcctattccaccgtctcgagagacgacgacaaagactcactacatctgacaaaatgaaacaactgagacgacgagacacggtctgtagtaattacgngtaggtagaacgagtattgttcgtggtcggtggggaccacggggtaaccctgggtaccaccgtctccncacgtccctaccgaacgaacggccctaggtcccgtctcccccggnggccctccgtgtccgacgacggccgaccaccgacgacgacgacgaacgcggcccggccgtcggtctccggtcgtaacggtaccgtaacgtacccgttaccgtaccgacgttaaccggaggaccgtggacggtcggcgacggacgaacgcganagngnnnnnnnnnnnnn

SEQ ID NO: 226758 - DNA, 864 bp, Homo sapiens
  misc_feature: GYAE6OF01BJI3K.15.28.C06.1.454.CMB.1.raw
  modified_base (176)..(176): a, c, t, g, unknown or other
  misc_feature (176)..(176): n is a, c, g, or t
  modified_base (293)..(293): a, c, t, g, unknown or other
  misc_feature (293)..(293): n is a, c, g, or t
  modified_base (852)..(852): a, c, t, g, unknown or other
  misc_feature (852)..(852): n is a, c, g, or t
  modified_base (859)..(861): a, c, t, g, unknown or other
  misc_feature (859)..(861): n is a, c, g, or t
  modified_base (863)..(864): a, c, t, g, unknown or other
  misc_feature (863)..(864): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatgggccgattcaccgtctccagagacgacgccaagaactcacctacatctgacaaaatgaacaacctgagagccgaggacacggntgtgtattacgtgtgtgagagtattgttcgtggtcgggttcggggacccgtaacggggtaaccccgttgggtaccctacccggttcccttcccgtaccgaaccgtccccgttaccccgaaaccccggaaaccgggggccccccttaacgggttccccgggtttccccctttccccccccggttcggggccccccgtccccccgttcggtcccccgttacccgggaacgggacccgtaccccgtaacccccgttaccccgggaaacgggaacccggacccgtaaacccggaaccggggtccccccggggtacccccgggttcgggggtacccccgtttccgggtacccccgggtttacggggtaaccccggtaaaaaccggggtttaaccccgttttaacccccggttttacccccggtaacccggtttaaaccccgggtttaaaccgggtaacccggtttacggggaaacccgggggtcccgggggttacccgttaccggggggaaccggtaaaccgggggcccggttaaccgaaaacgggttcggagtacggctacgngcgcgcnnngnn

SEQ ID NO: 226759 - DNA, 691 bp, Homo sapiens
  misc_feature: GYAE6OF01DAX2C.15.28.C06.1.454.CMB.1.raw
  modified_base (367)..(367): a, c, t, g, unknown or other
  misc_feature (367)..(367): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccagttgccaaatgtgacatccagatgacccagtcctccgtccaccctgtctgcatctggcggagacagacgtccaaccatccacttcggcccgggccagtcgagagttattaacctaaagttggttcggaccttggttcagacaagaaaccgaaggaaaccgacccgaaaagtcctagactctacctacccgctcttacgttcgactaaggtcggtacccagtccgaaggttcnggtcgacgtacggtgggtaactcgggtagggaaactacggtaacttaccgaggtttacctaccctaaacctagttccggagacccgtaaccgtcccgtacgacaccggtcccgtaggtaacgtttagttttacgaccttaaacgtttacctacctagaacccgttaagtccgtaactaaagttaacttaacttcgttaacggttccggggaacggaacgggtaaccggagggtaggtaaacgaacgtaacgaaaacgtacgtcggaggttactcgaccttaccgattcccggttatacttttccgtaccgtttcccgtaccccg

SEQ ID NO: 226760 - DNA, 521 bp, Homo sapiens
  misc_feature: GYAE6OF01B9KD7.15.28.C06.1.454.CMB.1.raw
  modified_base (368)..(368): a, c, t, g, unknown or other
  misc_feature (368)..(368): n is a, c, g, or t
  modified_base (495)..(497): a, c, t, g, unknown or other
  misc_feature (495)..(497): n is a, c, g, or t
  modified_base (499)..(521): a, c, t, g, unknown or other
  misc_feature (499)..(521): n is a, c, g, or t
tcagtctacgtagccacgaccggtgctcgatttagagctcacgtattgggtttgggggggaagaggaagactgacggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttgggccagggaaccctggtcaccgtctcctcacgccctccaccaacgggcccagtccggtccttccccctggccgcccctgcctcccgaggacnccaccctccggagacgccacgagccggcccctggggcctggcccgttgggtaccaagggtaccttaccgttcccgcgtaacgtagaccgtggaacgggccgggacgtgggaccaagggcacgatagnnncnnnnnnnnnnnnnnnnnnnnnnn

SEQ ID NO: 226761 - DNA, 710 bp, Homo sapiens
  misc_feature: GYAE6OF01AMX14.15.28.C06.1.454.CMB.1.raw
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (670)..(670): a, c, t, g, unknown or other
  misc_feature (670)..(670): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (684)..(684): a, c, t, g, unknown or other
  misc_feature (684)..(684): n is a, c, g, or t
  modified_base (689)..(693): a, c, t, g, unknown or other
  misc_feature (689)..(693): n is a, c, g, or t
  modified_base (695)..(700): a, c, t, g, unknown or other
  misc_feature (695)..(700): n is a, c, g, or t
  modified_base (702)..(710): a, c, t, g, unknown or other
  misc_feature (702)..(710): n is a, c, g, or t
tcagtctacgtagccacgaccggtgctcgatttagagctcacgtattgggtttggggggtaaggagggaaggactgacgggtccgccaggctccagggaaggggcgtgggaggtgggtggccaccgatacaaaaagatggaagtgacacaacctatgtgaactctgtgatgggccgattcgaccgtctccagagacgacgccaaagactcactacanctncaaatcgaacaacctgacgagaccgaggactacggctcgtagtacttacgtggtgtgagagacttggttctaggtcggttcgggggcctaacggggaacccgttgggtccctacccggttctccccgtcacggtccccgtccccaacccggaacggggcccctacggtttcccggggtttccccttccccccgtacgggggccccgtcccccttacggggtaccccttaccccgggaacgggaccggtccccgtaaccccgttaccccgggaaggacccgaccgaacccttaaccggggcccgggacccccgtcgggggtcccgttccgcccgggttcgggttaaccggaaacccggggtcttaaccccgttccggttaccttacgggtacctacggttaccggacgggtcggggtccgtcgggacgaacggggcctcgtaagtccggancgagcgncngtagntcgannnnngnnnnnncnnnnnnnnn

SEQ ID NO: 226762 - DNA, 572 bp, Homo sapiens
  misc_feature: GYAE6OF01AIX1I.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccgggccagtcagatattactaagtggtgctggttcagcagaaaccgagggaaacaccccaaagtccagatctctcgccgtcctctactttacgacaaggtcgggtacccatcgaacggttcaggcggcaggtggatcgtagggacagtattcgagtctcaccataccagcctagcctagcagcctagacgttatttcgctaaacttcctactcgactagtcgaactattaaactactacgttagttacgggacggaacgggaccgtaaagggtggaatacgtaacgaaacggtacgttggaggtcccgtacgtaccctaccgtacttacggttacttccttcgtccttaccccg

SEQ ID NO: 226763 - DNA, 660 bp, Homo sapiens
  misc_feature: GYAE6OF01DFYWG.15.28.C06.1.454.CMB.1.raw
  modified_base (198)..(198): a, c, t, g, unknown or other
  misc_feature (198)..(198): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccagtctccgtccaccctgtctgcatctggtcgganacagagtcaccatcacttcgccggccagtcagatattactaatggttgctgttcagcagaacgaggaacgcaaccgaaagtctagatctctgccgctcttacgtttgacgtaaagggtcgggtacctagtacgtaacggttcgacggtccggctaggtggtactcggtacgggaactaagtaactttccgaacgttcctaccaacctataccgaaggcctacggtccctagtaccacggtaccgtacggtaaccgtttattttacgaacccttaaaccgttaccgttacgttcggaacccgtaaaggttcgaacttaaacttaaagttaacgttaccgttaacggtttccggggaacgggtaacggggaaccgtaaagggtacgggtaaacaacgttaaccgaaaaccggtacgttggtacgggctacggacctaccgtaagttcttcgtccttagtacccg

SEQ ID NO: 226764 - DNA, 678 bp, Homo sapiens
  misc_feature: GYAE6OF01DHWKD.15.28.C06.1.454.CMB.1.raw
  modified_base (286)..(286): a, c, t, g, unknown or other
  misc_feature (286)..(286): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (670)..(670): a, c, t, g, unknown or other
  misc_feature (670)..(670): n is a, c, g, or t
  modified_base (673)..(678): a, c, t, g, unknown or other
  misc_feature (673)..(678): n is a, c, g, or t
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggttggacgtttcaaaagtaaaaatgatggtgagaaaatgactacggtgcacccgtgaaaggaagattcaccatctcaagagaataattacaaaaacgcggtgtatttgacaaatgaacagcctagaaaaccgngacacagccgtctattactgtaccacagattcggaagtgcagtacgacgtaagngctatntcttttgatagtcgtggggaccagggtactaagtcggtctcgtctcttcacgcctaccgaccgaacgggtccctacgttcccggtaccttcccccgtggtacccctaaccccgtccgtaaccccgaaagtaaccggtcccgtaacccggttcccggtacggggggaccctaaccggaacggggtcccggtacccggtggggtccctcggtacccgtagggtaccgtaaacgggtaccctttaaccgttcccgtacgttaaccggtacgaccggttcggacggtccggggacttacgggccggaaagggtccgacgaagtaggcncgnnnnnn

SEQ ID NO: 226765 - DNA, 661 bp, Homo sapiens
  misc_feature: GYAE6OF01DXW7R.15.28.C06.1.454.CMB.1.raw
  modified_base (102)..(102): a, c, t, g, unknown or other
  misc_feature (102)..(102): n is a, c, g, or t
tcagtctacgtagccacgaccggtgctcgatttagagctcacgtattgggtttgggggagtcagactcagtcaggacacagcatggacatgagggtccccgntcagctcctgggctcctgctgctctggctcccaggtgccaaatgtgacatccagatgacccagtcctcccgtccaccctgtctgcatctgtcggagacagagtcaccatcacgttcggcccgggcagtcgaagtagttattaacgtaagttggttcggtccgttggtttacagacaacgaaaccgaagggaaaccgaccccaaaagtcctagactcctcgtcgccgtccttcttactttgacgtaaggtcgggtacctagtacgtaacgtcgacggcgacgtaggtggtacgtcggtacgggaacgtattcgacgtcctacactatacgacgccgacgtcctcgcacgtcctagtacgttatttacgacttaactttactacgtacgacctagtacgtactaattaacttacgtacgttacgggttaccgggacgggtaacgggacgtagggtacgaacgtaacgtaaaccggtaaacggtacgttcggtcgtaaccgtcgaacccgtaccgttacgttaccgttacgtttacccttccgtaccgtttcccgtaccccg

SEQ ID NO: 226766 - DNA, 687 bp, Homo sapiens
  misc_feature: GYAE6OF01AW6AD.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgccccaaaagtcctgatctctgcctcctcctactttgcgaacgtacgggtcccgtactacaacggttacgacggcggcgaggtacggtagtacgtgggaacgtaagtaacgtttactacgtacgtcctaaccaacttacacgaccgaacgtcctacggaccacggtaccttacggtaacgttacgttttacggtaccttaaacctttaccgttaacctaccggtaccgtaacggttacgtactaaacttaaaatttacgtaaccgttaacggttttaaccgggtacggggaaacggggtacccggaaagggttaggggaacgtaacgtaaaccgtaaaccggtaaagttgggtacgggtccgtagacccgtaaccgtacttacgttcggttaccttccgttactttaccccg

SEQ ID NO: 226767 - DNA, 571 bp, Homo sapiens
  misc_feature: GYAE6OF01BJEPT.15.28.C06.1.454.CMB.1.raw
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtatactaatggtggcctggttcagcagaaccgaggaaacgaccccaaaagtcctagatctctgccgctctactttgcaaagtgggtccatcaagttcagcgcagtgactgtggacagaattcagtctcacatcngcagcctgcancctgacgttatttgctaaacgttactactcgacctaagtgtacctaattaaacttaatacgtagttttccgggaacggtacggggaaccgtaaagggttgggagtaacgtaccgaaaaacggttaccctagggtacggtccgtcgtaccgtaaaccccctagttcccttaaggttccctttcgtacttttacccccg

SEQ ID NO: 226768 - DNA, 563 bp, Homo sapiens
  misc_feature: GYAE6OF01BE9H4.15.28.C06.1.454.CMB.1.raw
  modified_base (346)..(346): a, c, t, g, unknown or other
  misc_feature (346)..(346): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccgggcagtcagagtattaactaatggttaggcctggtttcagcagaaaccgagggaaacgaccccaaaagtcctagactctctcgccgccttctacttgactaaggtcgggtccatcaaggtcagcgnagtgagtcgtgggacagtacttcgagtctacacatacagcagcctgacacgtcctagtacgtatttcgactacttactatcgtacctaagtgtactaattaactattcgtaacggtttcggacgggacgggtaaccgtaggggagtacgtacgtaacgaaacgtacgtggtaggtccgtagccctacgtactcgtacgttcttcgacccgtttcccg

SEQ ID NO: 226769 - DNA, 566 bp, Homo sapiens
  misc_feature: GYAE6OF01B9ZD1.15.28.C06.1.454.CMB.1.raw
  modified_base (539)..(540): a, c, t, g, unknown or other
  misc_feature (539)..(540): n is a, c, g, or t
  modified_base (542)..(566): a, c, t, g, unknown or other
  misc_feature (542)..(566): n is a, c, g, or t
tcagtctacgtagccacgaccggtgctcgatttagagctcacgtattgggtttgggggggaagaggaagactgacggtcctgccacaggtggtgctggagtgggtggccaccatacaaaaagatggaagtgacacaacctatgtgaactctgtgatgggccgattcaccgtctccagagacgacgccaaagaactcactacatctgcaaatgaacaacctgagagccgaggacacggctgtgtattactgtgtgagagatgttcgtgcggttggggaccacggggtaaccctgggacaacgtctccctcacgccctccaccgaacgggcccagtccggttccttcccccgtgggcccgtcccgtcgcctaccgaggacgcacccgtccggagacgccacgacggccggccccgtgggcctcggtcccgtgggtacccgaaacgggtaccctaaccgtttcccggtacgttaaaccggtacgaaccgttcgggtaacgggccgggggtcgtacggggagtaacggggccgactagtacgnngnnnnnnnnnnnnnnnnnnnnnnnnn

SEQ ID NO: 226770 - DNA, 676 bp, Homo sapiens
  misc_feature: GYAE6OF01CBKUS.15.28.C06.1.454.CMB.1.raw
tcagtctacgtagccacgaccggtgctcgatttagagctcacgtattgggtttggggagtcagactcagtcaggacacagcatggacatgagggtccccgctcagctcctgggctcctgctgctctggctcccaggtgccaaatgtgacatccagatgacccagtctccgtccaccctgtctgctatctgtcggagacagagtcaccatcacgttcggccggccagtcagagtattaactaaagttggttggtccgttggtttacagacgtaagaaaccgaagggaaacgaccccaaagtcctagatctctcgcctcctcgttacgttcgacgtaaacggtcgggtacctacgtacgtaacggtcgaggcggtacgtaggtggacgtcggtagggaacgtaagtaacgttccgtacgttccgtacctaccaagtaccaacgtcaccgtccgtaggacctacgtaccgtacgtaacgtttacgttttacgaacccttaactttaacctacgtacaccgtaagtacgtaactaacttaacttaacgttacgttaacggtttccgggaacgggtaacgggaccggtaagggttacggaagtaacgtaaaccggtaaacgtacggtaggtacggtcgtacgacctaacgtacgtcgttagttcttccgtacgttcccccg

SEQ ID NO: 226771 - DNA, 723 bp, Homo sapiens
  misc_feature: GYAE6OF01C6N9O.15.28.C06.1.454.CMB.1.raw
  modified_base (180)..(180): a, c, t, g, unknown or other
  misc_feature (180)..(180): n is a, c, g, or t
  modified_base (266)..(266): a, c, t, g, unknown or other
  misc_feature (266)..(266): n is a, c, g, or t
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (709)..(709): a, c, t, g, unknown or other
  misc_feature (709)..(709): n is a, c, g, or t
  modified_base (712)..(712): a, c, t, g, unknown or other
  misc_feature (712)..(712): n is a, c, g, or t
  modified_base (714)..(723): a, c, t, g, unknown or other
  misc_feature (714)..(723): n is a, c, g, or t
tcagtctacgtagccacgaccggtgctcgatttagagctcacgtattggggtttggggggggggtccctgagactctcctgtgaagcctctggattcaccttgagcacttattggatgacttgggtccgccaggctccgagggaaggggctggagtgggtggccaccaataacaaaaagntaggaagtgacacaacctatgtgaactctgtgagtgggccgtattccgaccgtctccgagacgacgacgaccaaagaactcactanatctgacaaaatagaaaccaacctagagacggccggaaggaccgacggnttgtagttattacgtggtagtagaaggaagtnttcggtttcgtgggtccgggttacgggggacccgtaaaccggggtaaccccgttggtaccctaacccggttcctacccgtacgaacccgtccctaacccgaaaccgaaccgggcccctaacggttcccggtttcccttcccccggcggcccctcccgtaggccccgtaccgaggtaccgacccacccgtacgaaggacgacctaacggaccggcccgggtacccgggtcgggtccgtcgggtcccgtacgggtaacctaacgggttacccttacccggttcccgtaacccgttaacggtaaccggtacgtacggggacgggtacccgggtcgtaccgggacgaaccgggcgaacctaaggangangnnnnnnnnnn

SEQ ID NO: 226772 - DNA, 657 bp, Homo sapiens
  misc_feature: GYAE6OF01BGEVW.15.28.C06.1.454.CMB.1.raw
  modified_base (377)..(377): a, c, t, g, unknown or other
  misc_feature (377)..(377): n is a, c, g, or t
tcagtctacgtagccacgaccggtgctcgatttagagctcacgtattgggtttggaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccaggccggggggtcctgagactctcctgtgaacgcctcgtggattccaccttgagcactttattggatgacttgggtccgccaggctccgagggaagggctggagtgggtggcacatacgaaaaagcgtaggaagtgacacaacctagngtgaactcgtgtagagtcgggcctattcccgtaccgtcttaccaggtacgaccgaacgacccaaagtaacccgtcaactacaacgttccgtacgacaaacgttagaaaccgtaaccctaggaacggacggacccgggaaggaccggtaaccggtcgtttaggtacgttaacggttacttgggtaggttacggaagtacgtagttcggtttacgtccggtttacgggttacgggggcccgtaaacgggggtaaccccctttggggtccccgttaaccccgg

SEQ ID NO: 226773 - DNA, 565 bp, Homo sapiens
  misc_feature: GYAE6OF01B4DJO.15.28.C06.1.454.CMB.1.raw
  modified_base (455)..(455): a, c, t, g, unknown or other
  misc_feature (455)..(455): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttcggccgggccagtcagagtattactaaatggttgcctggtttcagcaagaaaccgaggaacacccaaaagtcctgatctctcgccgcctctacttgacaaggtcgggtaccatcgaagttcaggcggcaggtggactcgtacgggacagtaacttcgacgttctccacctatcacgccacgccgtagcacgcctaggacgttacttttcgaccttaacgttacctactgaccaagtcganaattaatatacgtacgttcgggacggtaacgggacgtaaggtggaacgtataaccgaaagtacgtggtacggctggacccacgtactcttagtcttacgccgttaccccg

SEQ ID NO: 226774 - DNA, 701 bp, Homo sapiens
  misc_feature: GYAE6OF01B1FWH.15.28.C06.1.454.CMB.1.raw
  modified_base (181)..(181): a, c, t, g, unknown or other
  misc_feature (181)..(181): n is a, c, g, or t
  modified_base (210)..(210): a, c, t, g, unknown or other
  misc_feature (210)..(210): n is a, c, g, or t
  modified_base (480)..(480): a, c, t, g, unknown or other
  misc_feature (480)..(480): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (694)..(696): a, c, t, g, unknown or other
  misc_feature (694)..(696): n is a, c, g, or t
  modified_base (698)..(699): a, c, t, g, unknown or other
  misc_feature (698)..(699): n is a, c, g, or t
  modified_base (701)..(701): a, c, t, g, unknown or other
  misc_feature (701)..(701): n is a, c, g, or t
tcagtctacgtagccacgaccggtgctcgatttagagctcacgtattggggtttgggggggggggtccctgagactctcctgtgaagcctctggattcaccttgagcacttattggatgacgttgggtccgccaggctccgagggaaggggctgggagtgggtggccacataacaaaaagntggaagtgacaacaacctatgtagaactntggtgagtgggcctattccaccgtctccagagacgacgaccaaagactcaactacatctgacaaatagaaacaacctggaagacgccggaaggaccacggtctaggttgttaacttacgtggtggtaggaagaggtatttcggttcgtcgggtcgggtttcggggacccggtaacggggtaccccgttgggtaccctaccggttcctcctcgaccgccctacccgaacccggaccgggtccctacggttcccgttccccgttcccccggngggccccgcccgtcgcctcccggaggccacccgtaccgtccgagacgaccacggacggcccgggtcccgtgggtccgtcggtacccgttcgggtaaccgtaacggtacccgttaccgttccggaccgttaccggtacgtaaccggtgggtccgggtaccgggtcggtaacgggacgggaaccggccggaacgtaacggtggctagcganancgnnncnngn

SEQ ID NO: 226775 - DNA, 775 bp, Homo sapiens
  misc_feature: GYAE6OF01AFBNJ.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccagtcctccgtccacctgtctgcatctgtcggagacagacgtcaccatcacgttcgccggaccagtcagtagtattaactaagtggtcggtcttggttcagacgaagaaccgaacgggaacacccaaaagtcctagtactctctcgcccgtctcttacttcgacgtaacgggtcggtaccagtacgtaacggtcgacggcggacgaggtggacgtcggtacggaactaacgtaatccgtacgtacctaccgaaccgtacgtaccgtacgccgtacggtcccgtacgtaccgtacggtaccgttacggtacgtttaccgtttaccgaacctttaaaccgttaccgtaccgtaccgtaacccgtaaggtacccgtaacttaaacttaaaccgttaccgttaccggtttaaccgggtttacccgggggtaaaccggggtaacccgggtaaccgggttaaggggtaaccggggtaaacgttaaacccggtaaaaccggttaaaaacccgggtttcgggttagggtacggttaacccgaccgggttaacccctaaaccggttcgtttaacccggtttaccttacccgtttacccgttaacccggtttaacccccccg

SEQ ID NO: 226776 - DNA, 673 bp, Homo sapiens
  misc_feature: GYAE6OF01EZVMJ.15.28.C06.1.454.CMB.1.raw
  modified_base (659)..(660): a, c, t, g, unknown or other
  misc_feature (659)..(660): n is a, c, g, or t
  modified_base (662)..(665): a, c, t, g, unknown or other
  misc_feature (662)..(665): n is a, c, g, or t
  modified_base (667)..(673): a, c, t, g, unknown or other
  misc_feature (667)..(673): n is a, c, g, or t
tcagtctacgtagccacgaccggtgctcgattttagagctcacgtattgggtttggggggggggtccctgagactctcctgtgaagcctctggattcaccttgagcacttattggatgacttgggtccgccaggctccaggggaaggggctggaggtggggtggccaccataacaaaaaagatggaagtgacacaacctatgtgaactctgtgagtgggccgattccaccgtctccagagacgacgccaaagaactcaactacatctgacaaatgaaacaacctgagagccgaggacacggctgtgtattactggtgtgagagtattgtttcgtgtcgggttcggggaccgaacggggtaaccctggtccacccgttcctcctcacgccctaccgaaccgaacgggcccctacgtccggttcccttcccccgtcgggcccgtcccgtcgcctacccgacgggaccgcccaccccgtaccgggaagaccggaccaacggaccgggccccgggtccccggttcgggggcccttccgggtcccggttacggggtacccggtaaaccgggttacccttacccggttcccgtaccgttaaccggtaacgtaccggtcgggacgggtccgggtcgtacgggacggaacggccgacgtagtacggnngnnnngnnnnnnn

SEQ ID NO: 226777 - DNA, 575 bp, Homo sapiens
  misc_feature: GYAE6OF01BRWCQ.15.28.C06.1.454.CMB.1.raw
  modified_base (178)..(178): a, c, t, g, unknown or other
  misc_feature (178)..(178): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (430)..(430): a, c, t, g, unknown or other
  misc_feature (430)..(430): n is a, c, g, or t
  modified_base (470)..(470): a, c, t, g, unknown or other
  misc_feature (470)..(470): n is a, c, g, or t
  modified_base (540)..(540): a, c, t, g, unknown or other
  misc_feature (540)..(540): n is a, c, g, or t
  modified_base (564)..(575): a, c, t, g, unknown or other
  misc_feature (564)..(575): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccgaggggaagggctggagtgggtggccaccataacaaaaagntggaagtgacacaacctatgtgaactctgtgagtgggccgtattccaccgtctccagagacgacgccaagaactcactacatctgacaaaatcgaaacaaccgtgaaggacgaccggagacgacgctgtatattactggtgngagagtnttggttctggtcggttacggggcccaaggggtaccctgtcctaccgtcctacctcgacgccctaccaaccgacgggcccctagttccggtcccctttccccgnggcccacccgtgaccctcgagacctccaccgtccgagacnccacgacgcccggccgtggcctcggctcggactaacggtcttccgtccgacgttacgagtcgtcggacgngggacgtaggacgaggccatacgnnnnnnnnnnnn

SEQ ID NO: 226778 - DNA, 569 bp, Homo sapiens
  misc_feature: GYAE6OF01ER44U.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggtttcagcagaaaccagggaaacgaccccaaaagtcctagatctctgccgcctctactttgactaaagtcgggtccatacgaaggttcaggcggcgagtggatcgtggacagaattacagtctcacatcagcacgcctggcacgtcctgtaacgtattttgacctaaacttactactcgacctaagtcgactaataactaatacgtacgtttcgggacggtacgggaccgtaagggtaggagtaactaaccgaaaacgtacgtaggtcggcgtacgacgaaccctattaccgttagttacccttcgtaccgtttcccg

SEQ ID NO: 226779 - DNA, 696 bp, Homo sapiens
  misc_feature: GYAE6OF01DYSFG.15.28.C06.1.454.CMB.1.raw
tcagtctacgtagccacgaccggtgctcgatttagagctcacgtattgggtttggggagtcagactcagtcaggacacagcatggacatgagggtccccgctcagctcctgggctcctgctgctctggctcccaggtgccaaatgtgacatccagatcgacccagtcctccgtcccacccttgtctgcattctggtacggagacagacgtcacctatcacgttcggcccgggcagtcaaggtagttaattaacgtaaagttggttacggtccgttggtttacaggtacgaacgaaaccgaagggaaaccgacccctaaaagtccgtagactcgtcgtcgccgtaccttcgttacttcgacgtaacggtcgggtacctagtacgaacggttcgacggcgacgtaggtaggtagtacggtacgggaacgtagtaacttcgtacgttaccctacgaacctactacgacgtacgacgtccgtacgcgtaaccgtcgtacgttacgtttaacgttttacgtaactttaccgtacgtacgaccgtagtactaacgtaattaacgtacttacgtacggttacgggaacggtaacggtacgtaagggtacggaacgtaacgtaaaccgtaaacggttacgtcggtacgactccgacgtacctacgttccgttacttacccgttaccttacgtccccgttacccg

SEQ ID NO: 226780 - DNA, 551 bp, Homo sapiens
  misc_feature: GYAE6OF01BXJRE.15.28.C06.1.454.CMB.1.raw
  modified_base (410)..(410): a, c, t, g, unknown or other
  misc_feature (410)..(410): n is a, c, g, or t
  modified_base (532)..(532): a, c, t, g, unknown or other
  misc_feature (532)..(532): n is a, c, g, or t
  modified_base (544)..(544): a, c, t, g, unknown or other
  misc_feature (544)..(544): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgcctggttcagcagaaaccagggaaactccccaaaaagtcctagactctactcggcctcctcctaacttttgactaaaaggttcggggtaccccatcgtaaacggttcgagcggcaggtggactcgtgggacaggtaattccgaagtctcgacatcagcagcctgntagctgaccgtatttcgacaactttacgactgccaagtcgacattaatatactagtttaccggcggtaacgggacctaagggtggaagtagtacgaaacgaacgtggcgtcgtgacacctanccttagtctcgntttcccg

SEQ ID NO: 226781 - DNA, 593 bp, Homo sapiens
  misc_feature: GYAE6OF01DGF83.15.28.C06.1.454.CMB.1.raw
  modified_base (261)..(261): a, c, t, g, unknown or other
  misc_feature (261)..(261): n is a, c, g, or t
tcagtctacgtagccacgaccggtgctcgatttagagctcacgtattgggtttggggagtcagactcagtcaggacacagcatggacatgaggtccccgctcagctcctgggctcctgctgctctggctcccaggtgccaaatgtgacatccagatgacccagtcctccgtccaccctgtctgcatctgtcggagacagatcaccatcacttgccggcagtcagagtatactaagtgtgctgttcagcaagaacaggaacncccaaaagtcctgactctcgtcgccgccttactactttaggaccgtaaggtcgggtacctatcgaaggttcaggcgtcgagtggacgtcgtaggacagtacttcgacgtctaccaacatcgacgcgacgtcctagccgagcctagtagtactttacgaccttaaacttactaccgtacgtaacgaacgttatacgaattaaactaagttccgttaacgtttacgggacggtaacgggaccgtaagggtacggacgtaacctaacgaaacggtacttggtacggtcgttacgaccgtaacgtacttacttcggttacttcgccgtttaccccg

SEQ ID NO: 226782 - DNA, 715 bp, Homo sapiens
  misc_feature: GYAE6OF01DC5K8.15.28.C06.1.454.CMB.1.raw
  modified_base (183)..(183): a, c, t, g, unknown or other
  misc_feature (183)..(183): n is a, c, g, or t
  modified_base (697)..(698): a, c, t, g, unknown or other
  misc_feature (697)..(698): n is a, c, g, or t
  modified_base (705)..(706): a, c, t, g, unknown or other
  misc_feature (705)..(706): n is a, c, g, or t
  modified_base (708)..(708): a, c, t, g, unknown or other
  misc_feature (708)..(708): n is a, c, g, or t
  modified_base (710)..(713): a, c, t, g, unknown or other
  misc_feature (710)..(713): n is a, c, g, or t
  modified_base (715)..(715): a, c, t, g, unknown or other
  misc_feature (715)..(715): n is a, c, g, or t
tcagtctacgtagccacgaccggtgctcgatttagagctcacgtattggggtttggggggggggtccctgagactctcctgtgaagcctctggattcaccttgagcacttattggatgacttgggtcccgccaggctccgaggggaaggggctgggagtgggtggcccaccacaacaaaaagntggaagtgacacaacctatgtgaactctgtgatgggcctattccaccgtctccgagacgacgacgaccaaagaacctcactacatctagacaaatgaaaccacctgagacgccgaggacacggctgtagtattacgtggtgtagagagtattggttctagggtcgggttcgggggaccgtaacggggtaaccccttgggtacccctacccggtccctaccccgtacgaccccgtacccgaacccgaacccgggtacccggtaaccgttacccgggttccccggttttccccccgtcccgggtccggcccccgttccgtaccggtaccccgtaccgggaacggtaacccgtaccccgtaaccccggtacggacggaccgacccgaaccggtaccgggccccggttcgggcgtccgtccgtacgggttacgtacggtaaccgtaccttaccgtccgtacggtaacggtacgtgtacgggaccgggtcgtcggacggaacggacggactacgtaggnntagcagnntnannnngn

SEQ ID NO: 226783 - DNA, 805 bp, Homo sapiens
  misc_feature: GYAE6OF01A4LDO.15.28.C06.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagatcacntcacgttgccggcagtcagagttattaacgtaatggttggcctggtttcagcagaaccgaggaacaccccaaaagtcctagactctcgtcgcccgtccttcttacctttaggaccgtaaagggttcggggtacccctagttaccgtaacgggtttcaacggtccggacgtaggtacgggtacttcggtagggaaccaaggtaacgtttaccgaaggttcctacaacccgtaagttccgtaacggtaccgtaccgtccgtacggtacccgaacgttacccgttacggtaacccgtttactttttacgggaaccctttaaaccggtttaaacccttacgttaccgaacccgttaaagggtaccgtaacgttaaagtttaaacttaacggttaccgtttaaccgggttttccggggaaaccggggttaacggggaacccgttaaaagggggttacgggtaaacggtaaaccgtttaaaccgggtaaaacccggtaaccggttaagggtaccggggtaaccgttaccgggtaacccctaacccgttaacgtttacccggtaacgtttttcccgttaaccgtttaaccccgtttacccccgg

SEQ ID NO: 226784 - DNA, 980 bp, Homo sapiens
  misc_feature: GYAE6OF01ARPEE.15.28.C06.1.454.CMB.1.raw
  modified_base (100)..(100): a, c, t, g, unknown or other
  misc_feature (100)..(100): n is a, c, g, or t
  modified_base (966)..(966): a, c, t, g, unknown or other
  misc_feature (966)..(966): n is a, c, g, or t
tcagtctacgtagccacgaccggtgctcgatttagagctcacgtattgggttgggagtcagactcagtcaggacaccagcatggacagtgacggtccccntcgagctccgtggctctgctgctctggcctccgaggtcgacctaaagttcgtacgactacgtccgaagtactacgacccgtagttcccgttaccccggttacccctaacccgttggtaccgtcggtaacctacgttaccgttcgggaccggtaagaccgtaaggtaccgtaccgtaacctaacgtccgtacgttccgggacccggtacgtacgtacgagttaacgttaacttaacgtaggttcggttacgtaccgttaggttacacgtacgaacggtaaaccgacggtaaaccgacccgtaagtcgtacgacgttccgtacgtccgaccgttccgtacgtttacgtacgacgttaacggtccggtactaccggtacgttacggtccgaggtccggttacgacggttagtaccgttaacggggacgtaacggttaaacttaaccggttcgtaaacccgtttaccgaacccgttaaccgttaccgtaacccgtacggtacccgttaaacgtccggtaccgttaaacccgtcccggtaaccgttaacggttacccgttttaagtttaaccccgtacgtttaaacccggttacccttaagggttaaacccgttaccgtttaaacggacccgttttaaagttttaaacccgtaccgggttaaaaccgtttcccgggttacccggggttaaacgggaaccgggtttaaaccccgggtaaacgttttaacccgggaggttttaaacccaaaacccgggttttaacccgtaaacggggttacccgttaacgggtacccgggtaaactttaccccgggaaccctttaaacgggttccctttacccggtttaacccgttccgttaaccccccggtntttaaccccccggg

SEQ ID NO: 226785 - DNA, 531 bp, Homo sapiens
  misc_feature: GYAE6OF01EQ56P.15.28.C06.1.454.CMB.1.raw
  modified_base (498)..(498): a, c, t, g, unknown or other
  misc_feature (498)..(498): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcaagaaaccaggaaacgaccccaaaagtcctgatctctgccgcctctactttgcgaaagtcgggtccatctaaggttcagcggcgagtggatcgtggacagaattcagtctcacctatcgagcacgcctgcacgcctagacgtattttcgacttaacttactactgacctaagtcataataataatctagtttcgggacggacgggaccgaagggtgaggactacgaaacggtactggngcagacacctaactctacgtcttcgtcttcccg

SEQ ID NO: 226786 - DNA, 820 bp, Homo sapiens
  misc_feature: GYAE6OF01BO264.15.28.C06.1.454.CMB.1.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccggccagtcagagtattactaagtggttggctggtttcagcaacgaaaccgaagggaaacgacccccaaaagtcctagtactcctcgtcgcccgtaccttccttacttttcggaccgtaaacggttcgggggtacccctaagtacgtaacgggtttccgaacggccggtacgtaagggttagggtaacgtttaccggtaggggaaaccgtaacggtaaacgtttccgtaaggttcccgttacccaacccgtaacgttccaacggtacccgacggtccccgttaggacccgacggtacccgttaacggtaaccggtttactttttaacggaccctttaaaacccttttaaccgttaaccgttaccggtaaccccgttaaacggttcgtaaccttaaactttaaaaccgttaaactttacgggttaaaccgttttaccggggggaacgggtaaaccgggggtaacccggtaaagggggttacgggaaaacgtacgtaaaccgtaaaaccgggtaaccgttacgggttaccgggtactaccggtaccccgtaaccgtaacgttacccgtaggttttacccttacccgtaacgtttaccccccgg

SEQ ID NO: 226787 - DNA, 841 bp, Homo sapiens
  misc_feature: GYAE6OF01DGZG3.15.28.C06.1.454.CMB.1.raw
  modified_base (103)..(103): a, c, t, g, unknown or other
  misc_feature (103)..(103): n is a, c, g, or t
  modified_base (138)..(138): a, c, t, g, unknown or other
  misc_feature (138)..(138): n is a, c, g, or t
  modified_base (152)..(152): a, c, t, g, unknown or other
  misc_feature (152)..(152): n is a, c, g, or t
tcagtctacgtagccacgaccggtgctcgatttagagctcacgtattggggtttgggggagtcagactcagtcaggacacagcatggacatgagggtccccgntcagctcctgggctcctgctgcctgtcgcctccgnggtcactaatgtanacactaccagataccgaccctagtccctcccgtacccacccgttgtcgtagctacttcgtaggtacggaagacgagtacgtaccaacctattacctacgttccgggacccggtactacgtaccgaagtaagtttacttaacgttaaggttcggttcggtcggtttcggttacacggaccgtaaacggaaaccggaacggaaacccgtaacccgtaaacgttcctagtaccttccgtacgtccgtcccgtaccttacgtttacgttacgaacggttaacggggttacccggtacctaacgtaacggttacggtacgacggtaccggtacgttagggtacggtacgttacggggtaacggaacgtaagttaccgttcgtaccgttacctaacccactacgtacgacgtaccgacgtccgtagaccgtacgttaccgtaacgttaacgtttacgttacgtaaccttaacgttaccgtaccgtacgtaacgtaagtacgtaacttaaacgttaacgttacgttacggttacggggttaccggggaacgggtaaccgggtacgggtaagggttacgaaaccgttaaacgtaaaaccggtaaaccggttggttacggggaacgttcccgtaacccggtaccttaacggttacctttacggttccttaccgttacccttaccccgtttacccccgg

SEQ ID NO: 226788 - DNA, 940 bp, Homo sapiens
  misc_feature: GYAE6OF01DHAXO.15.28.C06.1.454.CMB.1.raw
tcagtctacgtagccacgaccggtgctcgatttagagctcacgtattggggtttgggggagtcagactcagtcaggacacagcatggacatgacgggtccccgctcagcctccgtggggctcctgctgctctggcctccgaggtcgacaaatgtagacatccagatcgacccagtcctcccgtccaccctgtctgcattcgtggtacggagacaggactccactactccgtacgttcgggcccgggtaccaggtcgtaagtagtttatttaaccgttaaaggttcggttcggtccggtttacgggtttacaacggacgaaaccggaaacccggaacggggtaaaaccctaacccccggaaaacggttacccgttaacgtaccgtaccttaccggttacccgtcccggttacccttactttaaccgttttacggaaccggtaaaacggggttcccgggtacctaacgtaacggtaagggttccgacggtacggtacgtaagggttacggtaacgtttacgggacggtaacgaacggtttaacgtttaccgaaccggttcttaacccgaccgttaacgtccgaacggaccgtaccggtccgtaggtaacccgtacgttacccgttaagggtaaccgttttacgtttaacggttaacccttaaacccgggttttactacccgttacgggaacgtttaaccgggtactaactttaaggttaaacttaacgttaccggtttaacgggtttaccgggggaacccggggtaaacgggtaacccgggttaaaggggtaaacggtaaccgggtaaaccgttaaaaccggtaaaaccgggtaacggttgggttaaccgggtaacccggtttaccggtaaaccccgttaacggtttacgggttacccttacccgggtttttaactccccgggtttaaccttcccccccggg

SEQ ID NO: 226789 - DNA, 648 bp, Homo sapiens
  misc_feature: GYAE6OF01AM945.15.28.C06.1.454.CMB.1.raw
  modified_base (512)..(512): a, c, t, g, unknown or other
  misc_feature (512)..(512): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgagacagagtcacatcacttcggccggccagtcagtagtattaactaagtggttcgcttggttcagactaacgaaacgaggaaaccacctaaaagtcctagactcgtctcgccgtctcttacgtttcgacgtaacggtcgggtacccagtacgaacggttcgacgcggacgtaggtgtacgtcggtacgggacagtaacttcgacgttctaccacgactacgacgacgtacgtacctacggacctacgccgttaacgtacgtttaactttacggtaaccctttaacgttaaccgttaaccttaccggacgttaaacgngtaaccttaataaacttaacgtacgtttacggttacgggaacggtaccggtaacgagggttaacgagtactaaaccggtaacgtacgtggtacgcgtaccgactaactgttaccttagtaccttgtcccttacccg

SEQ ID NO: 226790 - DNA, 713 bp, Homo sapiens
  misc_feature: GYAE6OF01BWPYZ.15.28.C06.1.454.CMB.1.raw
  modified_base (100)..(100): a, c, t, g, unknown or other
  misc_feature (100)..(100): n is a, c, g, or t
  modified_base (197)..(197): a, c, t, g, unknown or other
  misc_feature (197)..(197): n is a, c, g, or t
tcagtctacgtagccacgaccggtgctcgatttagagctcacgtattgggtttgggagtcagactcagtcaggacacagcatggacatgagggtccccgntcagctccgtggggctcctgctgctctggctcccaggtgccaaatgtgacatccagatcgacccagtctccgtccaccctgtctgctatctgtcganacagatcacatcacgtcgccggcagtcagagtatactaagtggtgctgttcagtacagaaacgaggaacgaccctaaagtcctagatctctcgccgcttctacttgacgtaagttcgggtccctatacgtaaggttccgagtcggacgtaggtgaacttcggacggaactagtaaccttcgagttcctacgacctagtacacgtacgtaacgcctacgaccgtacggtaccgtaggttaaccgttatttaccgaccttaaaccgttactaccgtacgtaccgtaacgtacgtaacctaaatttaaacgtaacttaccgtttaacgggtttaccggggaaaccggtacgggtaaaccgttaaagggggtacggtaaaacgtaaccgttaaaaacccggtaaaaccgggttaacggttacgggaaccggttacccgggttaacccgtaaaccgttaaccccgttacggtttaccgtttaccgtttacccctttaaccggtacccctttaccccccggg

SEQ ID NO: 226791 - DNA, 671 bp, Homo sapiens
  misc_feature: GYAE6OF01CQZQC.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctgggctcctgctgctctggctcccaggtgccaaatgtgacatccagatgacccagtcctccgtccaccctgtctgcatcgtgtcggagacagctaccacctatcacgttcggccggcagtcagtagttattaacgtaagtggttcgccgttggttcagacgaagaaaccgagggaaaccgaccccaaaaggtcctagactcctcgtcgcccgtccttaccttacgtttcgacgtaacggttccggggtacccagttaccgtaacggttcgacggtccggtacgtaggtggtacttacggtacgggtaactaaggtaacttcgtacgttacctacccaaccgtaactaccgacgtaccgacgactacgtacgccgacggtcctagtcgttattttccgaaccttaacgttctacctcgacgtaacgtcgtaacttaattaattacgttacgtacgggtttaccgggaacgggtacggtaaccggtagggaacggacgtacaacggtaaaacgtcggtaggttgccgttagacctacgttatccgtctttccgtcgttacccg

SEQ ID NO: 226792 - DNA, 899 bp, Homo sapiens
  misc_feature: GYAE6OF01BDNN2.15.28.C06.1.454.CMB.1.raw
  modified_base (198)..(198): a, c, t, g, unknown or other
  misc_feature (198)..(198): n is a, c, g, or t
  modified_base (883)..(883): a, c, t, g, unknown or other
  misc_feature (883)..(883): n is a, c, g, or t
  modified_base (887)..(887): a, c, t, g, unknown or other
  misc_feature (887)..(887): n is a, c, g, or t
  modified_base (891)..(891): a, c, t, g, unknown or other
  misc_feature (891)..(891): n is a, c, g, or t
tcagtctacgtagccacgaccggtgctcgatttagagctcacgtattgggtttggggggggggtccctgacgactctcctgtgaagccgtcaggattcgcctttcgctatctatcgccatgacctgggtcccgccaggctccgagggaacgggctggagtggatctcagctattagtggagtggtagtggtagaaacncatattaccgcgaggctaccgtaggaaacgggccgcttccaacctagtcctaccaagtacgaactaacgttacccaaacaacacttaacttttatccttacaaaagttcgaaacctagtcccgttgaccggtaacgcccggaagggaaccgaaccgggccccggtttaagtaaccgttaacccgtaggttcgggaccggtaacggtaaacggttaccgttaccgggtaaaccgaacggggtccccccggttaagggggaaccgtcccccggtttaggaaccctaaccggttcgggggaacccctaagggggaaccccttgggtacccacccgttaccgtccctaaccgtaaaccccttcccggaaaccccgaaacgggggtaccccctaaggtttaccccgggttaccctttaccccccccggtacggggtaccccctaacccccgttaccccgtacccggtaaacggtaccgacccgtaacccgttccgggttaccggggggacccttaaccggaaccgggtacccgggtccccggtacgggtccgttaccggacccgtttccgggtaaccgaacggtaccctttacccgttacccgtacgtaacccgggtaacgtaaccgtcggtaacggtccggggtaccgtacgggaccgtaacggggccgaccgtaaggtaccgcgtacncganacgngctaacgg

SEQ ID NO: 226793 - DNA, 625 bp, Homo sapiens
  misc_feature: GYAE6OF01BL8J3.15.28.C06.1.454.CMB.1.raw
  modified_base (275)..(275): a, c, t, g, unknown or other
  misc_feature (275)..(275): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttcgccggcagtcagagtatactaagtggtgctgttcagcagaacgaggaacacccaaagtcngactctctcgccgtcctactacttgacgtaacggtcgggtacccagtacgaaggttcacggcggacgtagtacggagtcgtaggactagtaacttcgacgtctaccaactatacgaacgctacgtccgtcgaccgacgtccgtacggtaacgtttacgtttacgaaccttaaccgttacgtacgtacgaccgtaagttcgtaactaagttaaacttaacgtacgttacggttacggggaacgtacggggtaaccgaagggttacggaacgtaacgtaaccggtaaacgtacgttaggcggtaccgtacgtacccaacgtacgtcgttagttcccttagtccgttaccccg

SEQ ID NO: 226794 - DNA, 603 bp, Homo sapiens
  misc_feature: GYAE6OF01EZLND.15.28.C06.1.454.CMB.1.raw
  modified_base (101)..(101): a, c, t, g, unknown or other
  misc_feature (101)..(101): n is a, c, g, or t
  modified_base (197)..(197): a, c, t, g, unknown or other
  misc_feature (197)..(197): n is a, c, g, or t
  modified_base (411)..(411): a, c, t, g, unknown or other
  misc_feature (411)..(411): n is a, c, g, or t
  modified_base (488)..(488): a, c, t, g, unknown or other
  misc_feature (488)..(488): n is a, c, g, or t
  modified_base (533)..(533): a, c, t, g, unknown or other
  misc_feature (533)..(533): n is a, c, g, or t
tcagtctacgtagccacgaccggtgctcgatttagagctcacgtattgggtttgggggagtcagactcagtccaggacacagcatggacatgaggtcccgntcagctcctggggctcctgctgctctggctcccaggtgccaaatgtgacatccagatgaccctagtctccgtccaccctgtctgcatctgtcgganacagagtccaccagtcacttgccgggccagtcagagtatactaatgtgctggttcagcagaacaggaaactccccaaaagtccctagatccgtcttgacccgtcgttactactttgacctaaaggtcgggtcccattaccgaaggttcaaggcggcagtgaatcgtggacagtatttacagttcctacgacctatcagtcaagtcccgtgaccncgaccttacggactttacctttcgacttaaacttacctattacggaccctaaaggtcgaactaattaaaccgttaanccgtttaagtttcccgggagtacgggaacctaaggggtcggtaanacgttaaccggaaacgtaaactggtaacggcgtagtaccactattcctaggttcttaacgcgttaacccc

SEQ ID NO: 226795 - DNA, 786 bp, Homo sapiens
  misc_feature: GYAE6OF01BRICZ.15.28.C06.1.454.CMB.1.raw
  modified_base (127)..(127): a, c, t, g, unknown or other
  misc_feature (127)..(127): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctntggcctccaggtgccaaatgtgacatccagatcgacccagtcctccgtcccaccctgtctcgcacttcgtgtaccggagaccagtacgtccaacctactcctacgttcggcccggacctagtccgaagtagttaattaacgtaaagttgggttcggtcccgtttagggtttaccaagtaccgaaacggaaaaaccggaaacgggaaaaccgaacccccgtaaaaaggttccccgttaggtacctttaccgttcccgtacggtcccccgttaccctttaccgtttaaccgtttacggtaaccggtaaacgggttcccggggtacccctaagttaaccgtaacggttccgaacggtcggtacgtaggtcggtacgtggtacgggaacctaaggtaacgtttctacgttacctaccgtaccacgttaccgacgtcctacggtacccgtgccaacggttcccaaggttaaccgttacgtttcgaaacctttaccgttaaccgtacgccgtaagtaacctgtaacctaatttaaacgtcgtaaccggttagttaccgggaacggtaacggaacgtaacgggtaggaactacgtaaaccaaacggtacgtggacggtataccgaacctaccgtattcccgttagttcccttgtacccgtttcccg

SEQ ID NO: 226796 - DNA, 721 bp, Homo sapiens
  misc_feature: GYAE6OF01EBQHL.15.28.C06.1.454.CMB.1.raw
  modified_base (102)..(102): a, c, t, g, unknown or other
  misc_feature (102)..(102): n is a, c, g, or t
  modified_base (199)..(199): a, c, t, g, unknown or other
  misc_feature (199)..(199): n is a, c, g, or t
tcagtctacgtagccacgaccggtgctcgatttagagctcacgtattgggtttgggggagtcagactcagtcaggacacagcatggacatgagggtcccccntcagctcctgggctcctgctgctctggctcccaggtgaccaaatgtgacatccagatgacccagtcctccgtccacccgtgtctgcatctgtcgganacagagtcaccatcacttggccggccagtcagtagttaattaactaagtggttacggccgttggtttcagacaagaaaccgaagggaaaccacccgaaaagtcctagactcgtctcgcccgtccttacttacgttcgacgtaaaggttcgggtaccctaagttacgtaaaggttcgaacggtcggtacgtaaggtggtacgttcggtagggaaacaagttaacttaccgagttacctaaccgacctaataccgagaccacgtccgtacggacctacgtccgttaggtaacgttacgttttacgaacctttaaacctttaccgtaccgttacgaaccgttaaggtaccgtaactaaaattaaccgttaacttacgttaacgggtttacccggggacgggtaacgggaaccggtaagggtaacggtaaacgtaacgtaaacggtaaaaccggtacgttaggtacggtactaaccggacctaaccggttacttacgttaccgttcctttacgtccgtttaccccc

SEQ ID NO: 226797 - DNA, 535 bp, Homo sapiens
  misc_feature: GYAE6OF01A1FHU.15.28.C06.1.454.CMB.1.raw
  modified_base (274)..(274): a, c, t, g, unknown or other
  misc_feature (274)..(274): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (516)..(516): a, c, t, g, unknown or other
  misc_feature (516)..(516): n is a, c, g, or t
  modified_base (523)..(523): a, c, t, g, unknown or other
  misc_feature (523)..(523): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattacaaatggttggcctggtttcagcagaaaccagggaaanacccaaaagtcctgatctctcgccgcctctactttgactaaagtggggcccatacaaggttcagcggcagtggatcgtagggacaggaattcaggtctacacctatcagcagtcctgacagtcctagacgtatttcgacaactttacaactggaccaaggtntacaagttaataactntacgtttcggngtaagggaccaagggtgaagagttacgaaaacgtactgtagggctcgacacgntacgttntctcgattcccg

SEQ ID NO: 226798 - DNA, 572 bp, Homo sapiens
  misc_feature: GYAE6OF01ARQ9R.15.28.C06.1.454.CMB.1.raw
tcagtctacgtagccacgaccggtgctcgatttagagctcacgtattgggtttgggggaggtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccgggccagtcagagttataactaatggttggctggttcagcaagaaaccagggaacgaccccaaagtcctagactctctcgcccgtcctcttactttcgacgtaaaggtcgggtcccagtcgtaaggttcgacggcggcgtaggtggactcgtagggacaagtaacttcgtaagtcctcacctatcacgcacgtctcgcacgtccgtagacttagttttcaccgtaacttacgtactacgctaagtcgtaactattaacgtatacgtagtttccgggacgggtaacggacggtaaggtggataactacgaaacggtcttggagcacgtacgactgtctattcctgtcttcccg

SEQ ID NO: 226799 - DNA, 635 bp, Homo sapiens
  misc_feature: GYAE6OF01BODOO.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccagttgccaaatgtgacatccagatgacccagtctccgtccaccctgtctgcatctgtcggagacagagtcaccatcacgttcgccgggccagtcagagttattaactaaagtggttggccttggtttcagcaagaaaccgaagggaaacgaccccaaaagtcctgactctctcgccgtcctcttactttgacgtaaaggtcgggtacccatacgaacggttcaggcggcgagtggatcgtagggactaagattcgaactcaccaccgtactacgagtaccacgtcccgtgacgtacggcccgtagtaacgttaacttttcgaaccttaactttaacctaccgtagtaaccctaaggtacgaacttaaactaaagttaaacttcgtaacggtttaccgggacgggtaacgggaaccgtaaggggttacgagtaacgtaacgaaacgtacgtaggttggtcgtcgacctacacgttcctagtttacctgtaccgttaccccg

SEQ ID NO: 226800 - DNA, 571 bp, Homo sapiens
  misc_feature: GYAE6OF01CW5DV.15.28.C06.1.454.CMB.1.raw
  modified_base (182)..(182): a, c, t, g, unknown or other
  misc_feature (182)..(182): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (364)..(364): a, c, t, g, unknown or other
  misc_feature (364)..(364): n is a, c, g, or t
  modified_base (429)..(429): a, c, t, g, unknown or other
  misc_feature (429)..(429): n is a, c, g, or t
  modified_base (559)..(571): a, c, t, g, unknown or other
  misc_feature (559)..(571): n is a, c, g, or t
tcagtctacgtagccacgaccggtgctcgatttagagctcacgtattggggtttgggggggggggtccctgagactctcctgtgaagcctctggattcaccttgagcacttattggatgacttgggtccgccaggctccgaggggaaggggctggaggtgggtggccaccataacaaaaagntggaagtgacacaacctatgtgaactctgtgagtgggccgattcaccgtctccagagacgacnccaaagactcactacatcngacaaatgaaacacctgagagccgaggacacggctgtgtattactgtgtgagagatgttctggcggttggggaccagggaccctggtccaccgtctcctnacgccctccaaccgacgggccctagtccgtcccgtcccccgtggccgccctgccctccgaggccnccaccgtccgaggacgcaacgacggcccggccgtcgggtctcggccgtggtacgaacggtaccttaccgttaccgacgttacgtacgtcgtaggacggcgggtcgtcgggacgacggtcgacgagtacgnnnnnnnnnnnnn

SEQ ID NO: 226801 - DNA, 681 bp, Homo sapiens
  misc_feature: GYAE6OF01BVZ6T.15.28.C06.1.454.CMB.1.raw
  modified_base (102)..(102): a, c, t, g, unknown or other
  misc_feature (102)..(102): n is a, c, g, or t
tcagtctacgtagccacgaccggtgctcgatttagagctcacgtattgggtttgggggagtcagactcagtcaggacacagcatggacatgagggtccccgntcagctcctggggctcctgctgctctggctcccaggtgccaaatgtgacatccagatgacccagtcctccgtccaccctgtctgcatctgtcggagacagagtcaccatcacgttcgccgggccagtcagtagtattaactaagtggtgccttggttcagacgaacgaaacgaggaaccaacctaacgtcgtagactctacgtcgccgtctacttacgtagacgtacggtcggtacctagtacgtagtcgacggcgagtagtgtacgtcggtacggaactaagtactacgtacgttacctaccgtacctacgtacgacgaccgaccgtccgtcgacctaccgtccgtacgtaacgtttacgtttacgaaccgtttaaaccttacctacggtaccgtaacgtacggtactaagttaaattaactacggttacgttaacgggttacggggaacggtaacgggaaccgttaggggtaagtaaacgtacgaaaaccggtaaacgtacggttacggtacggtaccgaacgtacccgtaacttcgttacccgttacctttcgttaaaccgtccgtttaacccccg

SEQ ID NO: 226802 - DNA, 786 bp, Homo sapiens
  misc_feature: GYAE6OF01CUC6Z.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccagttgccaaatgtgacatccagatgacccagtcctccgtccaccctgtctgctatcgtgtacggagactagacgtaccaccatcctacgttcggccggctagtcagtagtattaacgtaagtcggttcggtcgttgttcagacgaacggaaaaccgacgggaaaccgaaccctaaagtccgtagtacgtcctcgtccgccgtacccttaccgttacgtttacgaaccgttaaacgggttccgggtaccctagttacggtaacggttcgaacggtcggtaacgtaggtaggacgtacggtacgggtaacgacgttaacgtcgtaacgttacctacctaaaccgtacgtacgaaccggacctacggccgtagaccgtaccgtacgttacggtaaacgtttcgtttaaccgtaacctttaacccgttactaccggtcctaaccgaagttactacgttaaacttaattaaccgttacggttaaccggttccggggaaacgggtaaccggggtacgggttaaacggtaggtaaaaccgtaccgtaaaaccggttaaaccgtaagggttcggttaaaccgggtcttaaacccggtaccttaacccgttaccggttactttacccgttaacccgtttcgtacccccgttttacccccg

SEQ ID NO: 226803 - DNA, 724 bp, Homo sapiens
  misc_feature: GYAE6OF01A6UMR.15.28.C06.1.454.CMB.1.raw
  modified_base (637)..(637): a, c, t, g, unknown or other
  misc_feature (637)..(637): n is a, c, g, or t
  modified_base (676)..(676): a, c, t, g, unknown or other
  misc_feature (676)..(676): n is a, c, g, or t
tcagtctacgtagccacgaccggtgctcgatttagagctcacgtattgggtttgggggagtcagactcagtcaggacacagcatggacatgagggtccccgctcagctccgtggggctcctgctgctctggcctcccaggtgccaaatgtgacatccagatcgacccagtcctccgtcccaccctgtcctgcatctgtcggagacagagtcaccatccacttcggccggccagtcagtagtattaactaagtggttcggcttggtttcagacaacgaaaccgaagggtaaacgaccccgtaaaagtccgtactacgtcctacgtcgcccgtacccttcgttaccgttcggtaacgtaaacgggttccggggtaacccctacgtacgttaacgggttacgacgggacggagtacggtacggtacggtacggttacgggaacgtaacgtaacgtttaccgtacgttacccgtaacccaaccctacgtaccgtaacggaccctaccggtacctacggcccgtaccgtaccgtagtaaccgtttagtttccgaaccttaacgttacctacgtcgaacgtacgtcgtaactaactaattacgtgtaccggtttacgggacgggtacggacgttaacgggganaaggtaaacctacggaaccgttacggtacggtaggtccncccggtacacccgttagttactccgtttactccccgttacgttccccg

SEQ ID NO: 226804 - DNA, 730 bp, Homo sapiens
  misc_feature: GYAE6OF01BCA5I.15.28.C06.1.454.CMB.1.raw
tcagtctacgtagccacgaccggtgctcgatttagagctcacgtattgggtttggggagtcagactcagtcaggacacagcatggacatgagggtccccactcagctcctggggctcctgctgctctggctcccgaggtgaccaaatgtgacatccagatcgacccagtcctccgtccaccctgtctgcatctgtcggagacagagtcaccatcacgttcgccggacagtcagacttataacgtaaagtggttcgtccgttggtttcagacgaagaaaccgaagggaaacgacccgaaaagtcctagactctacgtcgccgtccttactacttcgacgtaacggtcgggtaccaacgtacgtaaggttcgacggtcggacgtaggtaggacgttacggtacgggaacgtaaggtaactttacgtacggttaccaccgtaacctaacgtaccaacggacacgtccgtgaccgtacgtccgtaacggttaacgttacgttttacgtaacctaaacgtttacgtaaccgttacggaaccctaaggtacgtaactaaacttaaaacgttaacgtaaccggttaacgttaccggggaacgggtaacggggtaaaccgtaaggggtacgtaaacgtaaacggtaaaccgtaaaaccggtacgttacgggttaccggtacgtaaccggtaacctacgttacttaccgttaaggttcccttaagtcccgtttaccccg

SEQ ID NO: 226805 - DNA, 1039 bp, Homo sapiens
  misc_feature: GYAE6OF01BR419.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgaccaaatgtgacatccagatcgacccagtcctccgtccacctgtctgctatcgtgcggagacagagtcacactcacttcggccggaccagtacgaggtacgtattaacgtaaagttgggttcggtccgttgggtttacacggaccgaaacggaaaaccgaaggggaaaaccgaaccccgtaaaaacggttcccgtacggtaaactttccgtaccgttcggcccccggttacccgtttactttaaccggttttcggaaaccgttaaaacgggggttccgggggttaaccccctaagtttaaccggtaaaacgggttcccggtaaacgggcccgggtaacgtaacggggtaacgggtaacgtttaccggggtacggggtaaaacccgttaaaggttaacctttaacgggtacccgttaaccgtacccgtaaacccttacgttacccgggaacggtaccgtaaccggtaccccgttacgggtaacccgtaaccgggttacccgttaacgggtttaaacccggtttaacggttttttaacccgggtaaacccttttaaaacccggttttaacccgtttaaacccgggtttaacccggaaaccccggtttaaaaccgggtttcccggtaaacttaaaaccgttttaaaacgttaaaccgttttaccgggtttaaaccggggttttacccggggaaacccgggggttaaacggggtaaacccccggttaaggggggttacgtaaaaccggtaaaccgggttaaaccccggtaaaaaacggttacccggggtttagggtaaccccgggttaacgtttacccgggaaaccccttaaaccgggtttaacccgtttacgggttttaaacccttttcccttaacccggtttaacccgtttaacccccccgg

SEQ ID NO: 226806 - DNA, 773 bp, Homo sapiens
  misc_feature: GYAE6OF01B71RY.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccacctgtctgctatcgtggtcggagacgagacgtacaccatcctacgttcggccgggccagtcaagtacgttaattaacgtaaagttggttcggtccgttggtttacagtacgaacgtaaaccgaagggaaacgacccctaaagtcctagtactccgtctcgccgtacctcttacgttgacgtaacggtccgggtacctacgtacgtaacggttcgaacggcggtacgtaggtagggacgttcggtacgggaactaacgtacgtttaccgacgttctacccgtacacgttacgacgtccaacgtccgtcgaccgagtacccgtaggtaacgttaacgttttacgaaacccgtttaaaccttaaccgttaacggtccgtaaaccgtaacggttaccgaactttaaacgttaaacgtttaaccgttccggttaaacgggtttaccgggggaaaccgggtaacggggttaaccgtaaacgggttagggaaaccgttacggtaaaccgtaaaacccggtaaggttccgggacgggttaccctacggtaccctaaaccgttaccgttcgttaacccggtttctttaaccccgtacgtttaccccg

SEQ ID NO: 226807 - DNA, 926 bp, Homo sapiens
  misc_feature: GYAE6OF01EX5I2.15.28.C06.1.454.CMB.1.raw
  modified_base (101)..(101): a, c, t, g, unknown or other
  misc_feature (101)..(101): n is a, c, g, or t
  modified_base (622)..(622): a, c, t, g, unknown or other
  misc_feature (622)..(622): n is a, c, g, or t
tcagtctacgtagccacgaccggtgctcgatttagagctcacgtattgggtttggggagtcagactcagtcaggacacagcatggacatgacgggtccccntcagctccgtggggcctcctgctgctcgtcggcctcccgaggtcgacctaaattgtacgaacactaccgagatccgaccctagtccctcccgtacccacccgtgtctgctagtcgtggtacggacgtacgagtaccgtaccaccgtactccgtaccggttccggaccccgggtactagtacgaaggttaagttaaccttaaagttaacggttgggttaccggtccgtttaggtttaccaacggtaacgaaaccggaaaaccggaacgggtaaaacccgtaaccccgtaaaacggttcctacggtaccttaccgttaccgtccggaccccgttacctttaccgttaccggtttacggaaccggttaacccggggttaccgggtaaccctaacggttaaccggttaacggtaccggacggaccggtacggtaagggtacgtaacggtaccgggtaacggtaaacgtaacgttaacggtttaccgaccgtttaacccaaccgtaaccgtaagtacccggtaacncccgggtaaccgtccttaaccgggacttacccggtaaccgttacggttaccgtttaacgttaccgggtaaccctttaaaccgggttactaacccggttacgtaacgttacgtaacgtaacttaagttaaccttaccgtttcgggtaacgggttacccgggtaagggtaaccgggtacggtaacgggtaggtaaaccgttacccgaaaaggttaaccgggttcggttacggtacccggttaacgtcccgacccgttaaacgtttcggttaaccgttacctttacccttacgccccgtttaacccg

SEQ ID NO: 226808 - DNA, 909 bp, Homo sapiens
  misc_feature: GYAE6OF01C5BZD.15.28.C06.1.454.CMB.1.raw
  modified_base (101)..(101): a, c, t, g, unknown or other
  misc_feature (101)..(101): n is a, c, g, or t
  modified_base (207)..(207): a, c, t, g, unknown or other
  misc_feature (207)..(207): n is a, c, g, or t
tcagtctacgtagccacgaccggtgctcgatttagagctcacgtattgggtttgggggagtcagactcagtcaggacacagcatggacatgagggtccccntcagctccgtgggctcctgctgctcgtggctcccgaggtgaccaaatgtgacatccagatcgaccctagtcctccgtccacctgtctgcctatctaggtcgggaanacgagtacgtccaacctagtacctacggttcgggcccgggacctaggtacgaacggtaagtttaacttaaaccgtaaagttcggggtttacggacctttagggtttaccaacggtaccgtaaaacgggaaaacccggtaaggggaaaaccctaaaccccggtaaaagttccccgtaagtacccgtttaccgtaccgtccggtaccccgtaccctttaccgttccggttttaacggaaccgtaaacggggttccgggtaacccctaggttaacggtaacggttccgacggaccggtaggtaacgggtacggtacgtacggggtaagggtaaccgttacttcgacgttacaaccgtacacgtcgacgtacgtacgtcctagggacctacgtaccggtcgttacgtttaaacgttcaaccctttaacggtttaccaccgggtaactacccggttaaagtaccctaacgttaaaagttaaccgttaacggttacgtttaaccggggtttaacgggggaaccgggtaaacggttaacccgggttagggtaaacccgtaacgggttaaacctaaaacccgggtaaaccggtttacgggttaccggggtaccggtaaacccgttccgggtaaaaaccctccgtttaaaccgtttccccggggtaatttttaaacccgccccggtccgttttccccggttaaacccccgg

SEQ ID NO: 226809 - DNA, 807 bp, Homo sapiens
  misc_feature: GYAE6OF01D7AKF.15.28.C06.1.454.CMB.1.raw
  modified_base (101)..(101): a, c, t, g, unknown or other
  misc_feature (101)..(101): n is a, c, g, or t
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
tcagtctacgtagccacgaccggtgctcgatttagagctcacgtattgggtttgggggagtcagactcagtcaggacacagcatggacatgagggtccccntcagctccgtggggctcctgctgctcgtggctcccaggtcgaccaaatgtagacatccagatcgacccagtcctcccgtccaccctgtctgctatcgtggcgganactagacgtcactactctacgttcggcccggacngtacagtattataactaagtggttacgtcgttgttanagacaagaaaccgaggaaaccaccgtaaagtcctagacttccgctcggtccctactaccttacgttacggaacgtaacgggttccgggtaccctaagttaaccggtaacgttacggaccggtacggtacgtaagggtacgtacgtacgggtaggaaaccgttaagttaaccgtacgtacgttaccctaccctaacgtagtaccgacggactaaccggtctaccggtaccgtacggtacccgttaaggttaccgtttacgtttaaccggaaccctttaaaccgtttaaccggttaccgttaaccggtaaacccgttaagtacccgttaaaacgttaacttaaaccgttaacggttacccgtttaaacggggttacccgggaacggggttaaacggtaacccgggtagggtaaccggttaaacgaccggtttaaaccgtaaaacgggttccgttaagggcggttaaccctaccggtacctaacccgtttcggttaccttacccggtttaccttaccgttacccggttacccc

SEQ ID NO: 226810 - DNA, 824 bp, Homo sapiens
  misc_feature: GYAE6OF01C8AL2.15.28.C06.1.454.CMB.1.raw
tcagtctacgtagccacgaccggtgctcgatttagagctcacgtattgggtttggggagtcagactcagtcaggacacagcatggacatgagggtccccgctcagctccgtggggctcctgctgctctggctcccaggtgaccaaatgtgacatccagatcgacccagtcctccgtccaccctgtctgacacttcgtggtacggagaacagtacgtaccaacccagttcctaccgttcgggacccgggcctaagtcgaaggtagttaagtttaacgtaaagttggttcggtaccgtttggtttcgaacgtaaccgaaacggaaaacccgaacggggtaaaacccgaacccccgtaaaaacgttcccgttaacgtacgttaccctcgtcccggaccccgttacccttaccgttttacgtttaacggtaaccggttaaaacggggtttccccggggtaaccctaacgttaccggtaaacgggttccgacgggaccggtacggtacgggtacggtacgtaccggtagggaaaccgtagttaacgttaccgtacgtacctaaccgtaacctacgtacgacgtaccgtacccgtacgtccgacggtaccgtccgtaacggttaaccgtttctttaccgaaccttaaaccgtttaaccgtcccgttaaggtaaccctaacggtctaaacttaaacttaaacttacgtacggttacgtacggggaacggtaacggtacggtaagggtaacgagtaaccgtaagaaccgttacggtgtacggtccgtacgacccttacgtacgttactacgttaccacgttcccgttacccg

SEQ ID NO: 226811 - DNA, 758 bp, Homo sapiens
  misc_feature: GYAE6OF01BNGJR.15.28.C06.1.454.CMB.1.raw
  modified_base (202)..(202): a, c, t, g, unknown or other
  misc_feature (202)..(202): n is a, c, g, or t
  modified_base (739)..(739): a, c, t, g, unknown or other
  misc_feature (739)..(739): n is a, c, g, or t
  modified_base (743)..(743): a, c, t, g, unknown or other
  misc_feature (743)..(743): n is a, c, g, or t
  modified_base (745)..(746): a, c, t, g, unknown or other
  misc_feature (745)..(746): n is a, c, g, or t
  modified_base (748)..(748): a, c, t, g, unknown or other
  misc_feature (748)..(748): n is a, c, g, or t
  modified_base (750)..(754): a, c, t, g, unknown or other
  misc_feature (750)..(754): n is a, c, g, or t
  modified_base (756)..(756): a, c, t, g, unknown or other
  misc_feature (756)..(756): n is a, c, g, or t
  modified_base (758)..(758): a, c, t, g, unknown or other
  misc_feature (758)..(758): n is a, c, g, or t
tcagtctacgtagccacgaccggtgctcgatttagagctcacgtattggggtttgggggggggggtccctgagactctcctgtgaagcctctggattcaccttgagcacttattggatgacgttcgggcccgccagggcctccggaagggggaagggggctggggaggtggggtcggcccaaccaataaaacgaaaaaaggngtagggaagtacgaaccaacctaacctatgtagaaccttcgtggtgaggtcgggccgtaacttcccaccggtcaccgaaggaacgaccgaccgaccaaacgactaccaacctacgatctagaacaaacgtacgaacaacgtagacggacggaccggaggaccgaccggtgttgtacgttacgttacgtggttgaggacgtagtacctgggtttcgtggggtccggttaccggggaaccgtacccgggtacgtccggtacctccgtcctccgcacccgccacccgaccggaccgggcctacggtcccgttcccctcccgacgtccccgccgtcgtcccgaccgacgaccgacccgtacccgacggacgaccgaccgaccggtaccgggaccccgggtccgggtccgggtcccgtccggttacccggacggtaccggtaccgtaacccgttacccgtacccggttaaccgttacggtaaccggtcgggtacccggcgggtaccgggtacggaccggtagggacccggtacgacgtaggnacgngnncncnnnnngngn

SEQ ID NO: 226812 - DNA, 777 bp, Homo sapiens
  misc_feature: GYAE6OF01DKL0R.15.28.C06.1.454.CMB.1.raw
  modified_base (104)..(104): a, c, t, g, unknown or other
  misc_feature (104)..(104): n is a, c, g, or t
tcagtctacgtagccacgaccggtgctcgattttagagctcacgtattggggtttgggggagtcagactcagtcaggacacagcatggacatgagggtcccccntcagctccgtgggctcctgctgctctggcctcccgaggtgaccaaatgtgacatccagatcgaccctagtcctcccgtccaccctgttctgcattcgtgacggagacagacgtcaaccattcacgtcggcccggactagtcaagtagttattaacgtaagttcggtacgtccgttgttacagacgaaacgaaaccgaacggaaaccgacccgtaaaagtcctagtacgttccgtcgtcgtccgtcccttacttacgtttacggaaccgttaaacgggttcccggtacctaacgttaaccggtaacgggttcgaccgggacggtacggtaaggttaacgggacgttacgggtaacgggtaacgtaagttaacgtacgttaactacctacccgtaaccgtacgttacgacgaccgaccgtccgtacgacgtaccgtacgttacgttaccgtttacgtttaccgtaaccttaaccttaaccgttaaccgtaccgtaacgttaacgtacgtaactaaacttaaacttaacgttaccggttacggttaccgggtaacgggtaacgggtacggtaacgggtaacgtaacgtaaccgtaacgtaacggtaacggtacggtacggtcgtaaaaaaaaccgtctaaccgttacgttacttacttccttcgttaccttacccg

SEQ ID NO: 226813 - DNA, 731 bp, Homo sapiens
  misc_feature: GYAE6OF01CJ0DU.15.28.C06.1.454.CMB.1.raw
  modified_base (403)..(403): a, c, t, g, unknown or other
  misc_feature (403)..(403): n is a, c, g, or t
tcagtctacgtagccacgaccggtgctcgatttagagctcacgtattgggtttggaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccgaggccggggggtccctgacgactctccgtgtgacgcctgtggacttcaccgttgacgcctactttagttggtatgtaccgttcgggtcccgccgacggcctcccggaagggggaacggggcgtaggggtacggtggggtccggacccaaccgaagtaaaaccgtaaaaaaggngtaaggggaaacgtcggaaacctaacccgaaacccttaagttcggtaacgtaaccgttcgttggttacggacgtacggggacccgtacgtttacccgaccccggttactacccgtaaggacggtaacccgaacccgaccaaacgtaacctcgaacctacgacttccgtagactaaatccgaaaccacgtacggaagccggaaccgacgggaccacgggtacgttagtagttacgtttacgcgttagtaggaacgtagtacgtttcgttcgcgggttaccgggttacggggacccgtacggggtaaccccttgggtaccccgtccccgg

SEQ ID NO: 226814 - DNA, 658 bp, Homo sapiens
  misc_feature: GYAE6OF01B8C4A.15.28.C06.1.454.CMB.1.raw
  modified_base (101)..(101): a, c, t, g, unknown or other
  misc_feature (101)..(101): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (627)..(627): a, c, t, g, unknown or other
  misc_feature (627)..(627): n is a, c, g, or t
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
tcagtctacgtagccacgaccggtgctcgatttagagctcacgtattgggtttgggggagtcagactcagtcaggacacagcatggacatgagggtccccntcagctcgtgggctcctgctgctcgtggctcccgaggtcgacctaaatgtacgacactccgaagatcgaccctagttcctcccgtaccctacccgttggtcctcgctaacttcgtggtacggagacagtacgtacctaacctactaccgtacggttcggaccggcctagtacgagtacgtttaataacgtaagttcggttggtccgttgttacgacgtacgaaacgaacgaacggaaccgaaccgtaaacgtcgtacgtactccgtacgtccgtaccgtccttacgttacgttacgacgtaacggtccgtacctatacgtacgtacgacgcggtactacggtgtacgtacgacggaacgtagtacgtntaaccgtnaccactaccgtagacgacgacgtcgacgtacgaccggtctaacggtactttacgtacgtaaccttaacgttacacgttaccgagttaactacgataacttaatcgtagtttacggaacggtaggaccgtagacggtagacagacgtacgntcgtgcncgtacntacttcagtctgcctccg

SEQ ID NO: 226815 - DNA, 713 bp, Homo sapiens
  misc_feature: GYAE6OF01BWT4T.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggcctcccaggtgccaaatgtgacatccagatgacccagtcctccgtcccaccctgtctgcatctgtgagacagagtccaccgtatcacgttcggcccggaccagtaccagtagttaacttactaaagttgggttacgccggtttcggtttacacggtaccaacggtaaaacccggaacgggtaaaccaacccccgtaaaagtccctacgaacttccgttaccgtccgtccgtccctaccgtttacttgaccggtaacggtcgggtacctagttaccgtaacggtcgaacggtcgagtacggtaggtactacggtcgggaatacgtaacttacgacttcgaccactatacgacgtcaccgtcgacgtacgaccgtccgtacgtacgttacgttactaaccttaacttctacgtacccgaacgtagtacctagttaacttaagttaccacgtttcggtacggggccggaacggtaccggtaagggttacgacgttaaaccggaacggttaacccggagggttcgacggtaccgtacgacccttacccggtatttacggttaccgtttccttacctcccgttccccg

SEQ ID NO: 226816 - DNA, 798 bp, Homo sapiens
  misc_feature: GYAE6OF01BSBB4.15.28.C06.1.454.CMB.1.raw
tcagtctacgtagccacgaccggtgctcgatttagagctcacgtattgggtttggaggtctcagagaggagccttagccctggactccaaggccctttccacttggtgatcagcactgagcacagaggacctcaccatggaagttggggctgagcgtggttttccttgttgcttattttagaaggtgtccagtgtgaggtgactaacgtggtcggagtcggtgggggacgtccgtccgtccggacgggtcccggggggtccctggacggtacctcctccgtgtacgaacgtcccgttcgtggtacttcctaccgttggacgcttacgtttaagttggtacttcggacgtttcggggcccgtacgtacggtccgtaccgggaggggacgggtcgtagggtagggttcgggtaccggacccaacgtaacgaaaacggtaaaaaggtcggtaaggtaacggtacgaaaccgaaaccgtaaaccgttaagtacgtaacgtaaccgttcgtaggtacggtaagtccgggaccttacgttacccgtaccggttacccaccggtaaacggaccgaacgggtaactaacccaaggtaaccctacctaacgtaccgttaacgtaccgttacgaaacgtaaacgtacgtaaaacccgtaacgttgggaaaccgtacgggacccgaaggtaccgtaacggtcgttaaggttccgtattacgtttggagttacggacgttagtacgtttcggtagtcgggttaccgggtacgggaccggttaaccggtaccgttcggtaaccgtacccgg

SEQ ID NO: 226817 - DNA, 838 bp, Homo sapiens
  misc_feature: GYAE6OF01A727P.15.28.C06.1.454.CMB.1.raw
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
tcagtctacgtagccacgaccggtgctcgatttagagctcacgtattgggtttgggggagtcagactcagtcaggacacagcatggacatgagggtccccgctcagctccgtggggctcctgctgctcgtggcctcccgaggtcgccaaatgtgacatccagatcgacccatccnccgtccacctgtctgctatctggtcgganacagactcacntcattcgccgcagtcagagtattaactaagtggttacgtcgtggtttcacgataacgaaaccgacgggaaacgaaccccgaaaagtccgtaagcttaccgtactccgcccgtcctaccgtttacttcgacgtaacgggttaccggtacccgtataaccggtaacggttacgacggacggtagtaacgtcggtaccggttaggtacggggaaacttaacgggtaactttaacccgtacgggttaccttaacccgaaccgttaaccttaccgacccggttaacgacccgttaccgtaccgggcgtaaccccgtaccggttaacgttcccgggtttaatttacggtaaccgttaaaccgttttaacccgtaacgtacccggtacccggttaaagtaaccgtaacgtaaacttaaacttacggttaaccggttaccggttacgggggacgggttaaaaccccggggaaacgggttagggtaaacggtaacgggtaaccgtttaaaaccgggaaaaaccgtttcgggaaggtttccccggggaacttacggggttaaaccccctacggttacccgtttacgtttaccccgtttcccggttaaaacttccccggttttaaaccccccgg

SEQ ID NO: 226818 - DNA, 821 bp, Homo sapiens
  misc_feature: GYAE6OF01B58EN.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctcccgtcccaccctgtcctgctatcgtgtcggagacagagtccaccatcaccgttcggccggccagtacagtagttattaactaagtggttcggccgttggtttcagacgaagaaaccgaggaaacgacccctaaaagtccctagactcgtcgtcgcccggtcctccttacgtttcgaacggtaacgggttaccgggtacccctaagttaccgtaacgggtttacgaacggcggtaccgtaggtaggtacggttacggtacgggtaactaacggtaactttcgtaacttaccgtacctaacctagtaccgaagaccgtacgccgttacgaccgtacgtaccgtagtaaccgtactttttaccgaactttaaaccttccgtaaccgtacgtaaccccgttaaagtaaccgttaacttaacggttaacctagtttaaacccgtttccccggttacgggggtttaaccgttaaccccggggtttacccggggaaacccggttaaacccggggggtccgggttaaacggggttaaccggggtaaaccgtttaaccgtaaaccgggtaaaacccggttaccgggttaggtaccgggtaccggttaaccccgtacggttaaacccctacggttaaccccggttttcggtttaccccc

SEQ ID NO: 226819 - DNA, 594 bp, Homo sapiens
  misc_feature: GYAE6OF01D5N3I.15.28.C06.1.454.CMB.1.raw
  modified_base (178)..(178): a, c, t, g, unknown or other
  misc_feature (178)..(178): n is a, c, g, or t
  modified_base (205)..(205): a, c, t, g, unknown or other
  misc_feature (205)..(205): n is a, c, g, or t
  modified_base (317)..(317): a, c, t, g, unknown or other
  misc_feature (317)..(317): n is a, c, g, or t
  modified_base (404)..(404): a, c, t, g, unknown or other
  misc_feature (404)..(404): n is a, c, g, or t
  modified_base (453)..(453): a, c, t, g, unknown or other
  misc_feature (453)..(453): n is a, c, g, or t
  modified_base (581)..(581): a, c, t, g, unknown or other
  misc_feature (581)..(581): n is a, c, g, or t
  modified_base (583)..(586): a, c, t, g, unknown or other
  misc_feature (583)..(586): n is a, c, g, or t
  modified_base (589)..(594): a, c, t, g, unknown or other
  misc_feature (589)..(594): n is a, c, g, or t
tcagtctacgtagccacgaccggtgctcgatttagagctcacgtattggggtttggggggggggtccctgagactctcctgtgaagcctctggattcaccttgagcacttattggatgacttgggtccgccaggctccgagggaaggggctggagtgggtgccaccataacaaaaagntggaagtgacacaacctatgtgaactntgtgagtgggccgattccaccgtctccagagacgacgccaagaactcactacatctgacaaatgaacaacctgagagccgagacaggctgtgtattactggtgtagagagtnttgttctggtcggttgggccagggaccctggccaccgtctcctcacgcctaccgaacacgggccctagttccggtcccttcccccgnggccctacccgtgccgtccgacggacgcccaccgtcgaagcgaccgacncggcccggtcccgtgggcctcgtccgtggtacgtaacggtaccttaccgttcccgtacgttaccggtacgtacgttacgggacggtcgggtacgtcggggaccgaacgggtccgactaaggtacgagngnnnntcnnnnnn

SEQ ID NO: 226820 - DNA, 806 bp, Homo sapiens
  misc_feature: GYAE6OF01EHHR5.15.28.C06.1.454.CMB.1.raw
  modified_base (123)..(123): a, c, t, g, unknown or other
  misc_feature (123)..(123): n is a, c, g, or t
  modified_base (170)..(170): a, c, t, g, unknown or other
  misc_feature (170)..(170): n is a, c, g, or t
  modified_base (198)..(198): a, c, t, g, unknown or other
  misc_feature (198)..(198): n is a, c, g, or t
  modified_base (550)..(550): a, c, t, g, unknown or other
  misc_feature (550)..(550): n is a, c, g, or t
  modified_base (775)..(775): a, c, t, g, unknown or other
  misc_feature (775)..(775): n is a, c, g, or t
  modified_base (781)..(781): a, c, t, g, unknown or other
  misc_feature (781)..(781): n is a, c, g, or t
  modified_base (787)..(787): a, c, t, g, unknown or other
  misc_feature (787)..(787): n is a, c, g, or t
  modified_base (789)..(789): a, c, t, g, unknown or other
  misc_feature (789)..(789): n is a, c, g, or t
  modified_base (800)..(800): a, c, t, g, unknown or other
  misc_feature (800)..(800): n is a, c, g, or t
  modified_base (802)..(802): a, c, t, g, unknown or other
  misc_feature (802)..(802): n is a, c, g, or t
  modified_base (804)..(804): a, c, t, g, unknown or other
  misc_feature (804)..(804): n is a, c, g, or t
tcagtctacgtagccacgaccggtgctcgatttagagctcacgtattgggtttgggggtccctgagactctcctgtgaagcctctggattcaccttgagcacttattggatgacttgggtccnccaggctccgagggaggggctggagtgggtgccacataacaaaaagntggaagtgacacaacctatgtagaactntgtgagtcgggacctattccgaccgtctaccgaagacgaccgaccgaccaaagaacctcaactacatcgtagaactaaagtacgaaacctaaccgtaggaacggaccgaccggaaggaaccgtacgggtcttaggttaacgtttaactttacggttggtacggtaaggaaggtaacggttcgtttggtttaccggtcgggtccgggggtttacggggaaccccgtaaacgggggttaccccttgggtacccctaacccgttccctaccgttaccgaacccgtaccctaaccccggaaccggtaaccgggtcccccttaacggtttcccccggttcccccgttaccccccggngggtcccccgtaccctccggtacccgtaccggacggtaccctacccgtacccgtacggacggacctacccgaacggccgggccccggtaccggtcgggtccttacggtacccggtacggtaaccgtaaccggttcccttaaccgttcccgtaacgtaccggtagtaccggtacggaccggggccggttacggaccggaaccggtaacgggtcccgtaaaggtaancgggtnagtcgnanccgttgagccncngncg

SEQ ID NO: 226821 - DNA, 638 bp, Homo sapiens
  misc_feature: GYAE6OF01DEARF.15.28.C06.1.454.CMB.1.raw
  modified_base (178)..(178): a, c, t, g, unknown or other
  misc_feature (178)..(178): n is a, c, g, or t
  modified_base (198)..(198): a, c, t, g, unknown or other
  misc_feature (198)..(198): n is a, c, g, or t
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
  modified_base (623)..(623): a, c, t, g, unknown or other
  misc_feature (623)..(623): n is a, c, g, or t
  modified_base (629)..(630): a, c, t, g, unknown or other
  misc_feature (629)..(630): n is a, c, g, or t
  modified_base (632)..(638): a, c, t, g, unknown or other
  misc_feature (632)..(638): n is a, c, g, or t
tcagtctacgtagccacgaccggtgctcgatttagagctcacgtattggggtttggggggggggtccctgagactctcctgtgaagcctctggattcaccttgagcactttattggatgacttgggtccgccaggctccgagggaaggggctgggagtgggtgccacatacaaaaagntggaatgacacaactatgtnaactctgtgagtgggccattccaccgtctcagcgacgacgccaagaactcaactacatctgacaaatcgaaacacctagacgagccgaggacaggctggtntatactggtgtgagagattcgttcgnggtcgggttcggggcctaacggggtaaccctggtacctaccgttcctacctcaccgtccctacccgaaccggaacgggcccctaacgttcccggttccccttcccccggtgggccccgtaccctcgaccgtaccgaggtaccgccgtacccgtcgaacgacgaccacggtacggcccggtcccgtgggccttcgtccggttacggtacgtaacggtaccttaccgtaccggtaccgttaacgtacgtacgtacgggcgggaccgggtcgtcgggacgaacgggtccgactacgtagcntcgacnncnnnnnnn

SEQ ID NO: 226822 - DNA, 723 bp, Homo sapiens
  misc_feature: GYAE6OF01AE78Q.15.28.C06.1.454.CMB.1.raw
  modified_base (177)..(177): a, c, t, g, unknown or other
  misc_feature (177)..(177): n is a, c, g, or t
  modified_base (701)..(701): a, c, t, g, unknown or other
  misc_feature (701)..(701): n is a, c, g, or t
tcagtctacgtagccacgaccggtgctcgatttagagctcacgtattgggtttgggggagtcagactcagtcaggacacagcatggacatgacgggtccccgctcagctccgtgggctcctgcgtgctctggacctccagggtcaccaaatggtacgacactccagactcgaacccngtcctccgtccacctgtcctagcattcgtcgtacggatacacggactccaccagtcacgtcggcccggactagtccgaagtacgttattaacgtaagttcggtacggtcgttcggttacagacgaaacgtaaacggaacggtaaaccgacccgtaaagtccgaacgtacttccgtctcgcccgtctacgttacgttacgacggtaacggtccggtacctacggttacggtaaccggttagaccggaccggtagtacgggttacgtaccgttacgggcggtaacgtaacgtacttaccggtactaccggttccaaacggtctaaccggactcggaacgtaccgttcggaaccgtaccgtaacgttaccgtaatttaccgtaacgtaaccttaaccgttaactacggtcgtaaacgtcgtaacgtacttaacgtaaattcgtaaccgttaggtaccgggtacggaaccgttaagacggtaagtacgtaaccgaaggttccaagtcgacgctacgaacctcgtaacncttacgtccttagcccgtaccg

SEQ ID NO: 226823 - DNA, 672 bp, Homo sapiens
  misc_feature: GYAE6OF01CM9QG.15.28.C06.1.454.CMB.1.raw
  modified_base (281)..(281): a, c, t, g, unknown or other
  misc_feature (281)..(281): n is a, c, g, or t
  modified_base (627)..(627): a, c, t, g, unknown or other
  misc_feature (627)..(627): n is a, c, g, or t
tcagtctacgtagccacgaccggtgctcgatttagagctcacgtattggggtttggggagtcagactcagtcaggacacagcatggacatggacgggtccccgctcagctccgtggggctcctgctgctcgtggctcccgaggtcgaccaaagtgtagacatccagatcgaccctagtcctccgtcccacctgtctagcatcgtgacggagacagactacacatctacgtcggccggtcagtcagtagttaattaacgtaagttggtcggtcgttggttanagacgaaacggaaaccgaacgggaaaccaaccctaaacggtctacgtacttccttcgccgtcccttacttaccgttaacgtttacggaacgttaaacgggtccgggtaaccctagtaacggtaacggtacgacgggcggtacgtaagggtcggtacgtacgggtacggacgtaagtaacgttcgacgtaccactaacacgacacgcgtacgccgtagaccgtacgaccttaaggtacctttagtttaaccaactttaacctacgttacgacgtaacgagttacaactaataactagtacgtaggtacggagaacgggacgaggagtacgaacgtaagaacggtcgngtacgtcgaccgacttacgtcgttacttcgttctactccgtcccg

SEQ ID NO: 226824 - DNA, 814 bp, Homo sapiens
  misc_feature: GYAE6OF01BZBFZ.15.28.C06.1.454.CMB.1.raw
  modified_base (220)..(220): a, c, t, g, unknown or other
  misc_feature (220)..(220): n is a, c, g, or t
tcagtctacgtagccacgaccggtgctcgatttagagctcacgtattgggtttggggagtcagactcagtcaggacacagcatggacatgagggtccccgctcagctccgtggggcctccgtgctgctcgtcggcctcccgaggtcgaccctaaagtcgtagacactaccgatagtccgacccctagtcccgtccccggtccctacccgtgtcctcgacnctcgttcggcggagacgagactaccgactatccgtacgttccggacccggtcaaggtcgtaacgtaacgttaacgttaaacgttaggttggttacggtcgtttacggttacgaacgtaaccgaaaccggaaaccggtaaacgggaaaaccccgtaaacccgttaaaccgtaccgtacgttaacccgtcgtacccggttacccgcccgttacctttaccgttaccggtttaacgaaccgttaaacgggtccccgggttaacctaacggtacgtaaccgggttccgacggtccggtaacgtacggtaggtacgtacggcggtaactaggtaacttcgtacgtcttaaccgacctacgtacgagtcccggacgtaccgacgacgaccgttaacgtcgttaacgttctttaccgtaacctttaaccgttacctacgtaccgtaacgacggttacaaacgtttaataaccgttaacgttaccgtttagggaaccgggttaacgggtacgggtaacgtaagggtacgaaagtaaccgtaacgaacgtcgtaggtacacgtacgtactacgttctacgttctacgttccctacgttccccg

SEQ ID NO: 226825 - DNA, 703 bp, Homo sapiens
  misc_feature: GYAE6OF01CNBKG.15.28.C06.1.454.CMB.1.raw
  modified_base (102)..(102): a, c, t, g, unknown or other
  misc_feature (102)..(102): n is a, c, g, or t
  modified_base (362)..(362): a, c, t, g, unknown or other
  misc_feature (362)..(362): n is a, c, g, or t
tcagtctacgtagccacgaccggtgctcgatttagagctcacgtattgggtttgggggagtcagactcagtcaggacacagcatggacatgagggtccccgntcagctccgtgggctcctgctgctctggctcccaggtgaccaaatgtgacatccagatgacccagtcctccgtccacccgtgtctgctatctgtcggagaccagacgtcacgatcacgtgccggcagtcagagtattacgtaagtggttgcgttgttcagacgaagaaaccgaggaaacacccgaagtcctagactcctcgtcgaccgtcctacttactgacgtaaggttccgggcctacgtacgtaacggtcaggccgngtagtacggatacggtacggaacgtacgttacgttactagtccgtacacctagtacgacgaccgacgtctcgaccgtacgtacccgtaagtaacgttatttaccgaaccttaaacgtttaaccctcgggtacccgtaccgttaagtaccgtaattaacgttaaacgttaacggttaccgttaacgggtttcccggggaaacggggttaacccgggtaccggttaaaacggggtacggaaacgttaaaccggtaaacgtaaaacccgtagggtcgggttaacccggtcgtacgtaccccgtacgttactacctttcggtaccctttacgtccctttaccccg

SEQ ID NO: 226826 - DNA, 761 bp, Homo sapiens
  misc_feature: GYAE6OF01BCX91.15.28.C06.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (742)..(742): a, c, t, g, unknown or other
  misc_feature (742)..(742): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (754)..(754): a, c, t, g, unknown or other
  misc_feature (754)..(754): n is a, c, g, or t
  modified_base (757)..(759): a, c, t, g, unknown or other
  misc_feature (757)..(759): n is a, c, g, or t
tcagtctacgtagccacgaccggtgctcgatttagagctcacgtattggggtttggggggggggtccctggagactctcctgtgaacgcctctggattcaccttgagcacttagtggatgacttgggtccgcaggcctccgagggagggctggagtgggtggccacataacaaaagntggaagtnacacactatgtgactntgtgatggctattccaccgtcncagacgacgacgacaagactcactacatcgtagactaaagtacgaaacctacgtaggaacgacggaccggaacggaccgacggtcgttaggttagttaacgttacggttggttaggtaggtaaggtacggttacgtttcggtttccggtcggggttaccgggggttaccggggaccgggtaacccggggttaacccgttccggtaccccgtacccgttcccctaccgtacccgtacccgtaccccgtacccggaaccgggtacccggtccccgttaccggtttccccggttcccccgttccccggccgggtccccgtcccggtccgtacccgtaaccggacggtacccgacccgtaccggtaccgaacgaccgaccgaccggcccggtacccggtccgggtcggtaccgtccggtacgtaccgggtaccgtaaccgttaccgttaccggtccgtaacgtaccggtacgtaccggtcgggaccggtcgggtcgtacggaccggtcgacgtacgtagtcgnacgtcngncgtncannngc

SEQ ID NO: 226827 - DNA, 785 bp, Homo sapiens
  misc_feature: GYAE6OF01BB2F9.15.28.C06.1.454.CMB.1.raw
  modified_base (656)..(656): a, c, t, g, unknown or other
  misc_feature (656)..(656): n is a, c, g, or t
tcagtctacgtagccacgaccggtgctcgatttagagctcacgtattgggtttggaggtctcagagaggagccgttagccctggactccaaggcctttccacttggtcgatcagcactgagtcacagaggactcaccatggaacttggggctgagctgggttttccttgtgctatttagagtgtccagtgtgaggtgcgaacgtggtggagtcgtaggggagcctcgtccgacggccgggggtcctgagactctacagtcgtagaacgcctcgtacggtacttccgtaccgttgaacggtcctaactttagttaggtaacgtcggtaacgttcggggtacccgaccgtacgggtccctaccgggaacggggtaagggtccgttaggggacgggtggggtaccggtacccgaacgtaacgtaaaccgaaaaaggcgtaaggtaaagtacggaaaccaaaccgtaaccgttagttacggtacgtaaacttcggttaggtacgtacggtacgggtaccgttaacgttcccgtacccgtacgtacccgaaggtaacccgaacggaaccggaacccaaaggtacctaccaacgtttacacgttaccgtagtaaactaacacgtaaaccaacgtaggaacggacgtaccgtaacggaacccngggtacttaaggtcgttaactacgtaggttacgtaggtaaggtaacgttcgtttaacggttcggtacgggttaccgggggtttaccggaacccggttaacccggggttacccggtggtttaacccccgg

SEQ ID NO: 226828 - DNA, 810 bp, Homo sapiens
  misc_feature: GYAE6OF01E5ZUC.15.28.C06.1.454.CMB.1.raw
tcagtctacgtagccacgaccggtgctcgatttagagctcacgtattggggtttggaggtctcagagaggagccttagccctggactccaaggtcctttccacttggtgatcagcactgagcacagacggactcaccatggaattggggctgagcttggttttcctgttgcttatttagaaggtctccgagtgtgaggtgcacgtggtggagtcggtggggacgtcctacgtaccggacgggtcccgggggtcctagacgtacctccgtcgtgtacgaacgtcctgtcggtacttccaccgttgaacggtcctaacgtttagtaggtatacggtacgtttccggggtcccgcggtacggtcctacccgggaaggggtacggggtccgttaggggtagggtcggggttaccggacccgtaaacgtaaactaaaacgtaaaaaacggtgtaccggggtaaagtcggaaacctaaccgtaaaaccgtagttcggtaccgtaaacgtttcggttaggtacggtaaggtccgggtacgtaacttccgtacccgttacgaaccgtaggacccgtagaaacccgaaccgaacgtaccgtactaacctacgtactaccgtaagaacctaaacgtaccgaaacgtaacgtggaaccggacgacccgggaacgtaacgggtccgttacgttcggtaaacgttgttaccggttacgtgggtaaacggtacggttaggaccggttttcggaccggtttaagggtcccgggtacggggaccccggttaaacgggtcccgtacgggttcccccgttaacccggg

SEQ ID NO: 226829 - DNA, 723 bp, Homo sapiens
  misc_feature: GYAE6OF01BS21V.15.28.C06.1.454.CMB.1.raw
  modified_base (130)..(130): a, c, t, g, unknown or other
  misc_feature (130)..(130): n is a, c, g, or t
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
  modified_base (576)..(576): a, c, t, g, unknown or other
  misc_feature (576)..(576): n is a, c, g, or t
  modified_base (585)..(585): a, c, t, g, unknown or other
  misc_feature (585)..(585): n is a, c, g, or t
tcagtctacgtagccacgaccggtgctcgatttagagctcacgtattgggtttgggggagtcagactcagtcaggacacagcatggacatgacgggtccccgctcagcctccgtgggcctcctgctgctntcggcctacccgaggtcgaccaatgtacgaactactcccaagtactcgaaccccgtagtccctcccgtaccctaccctgtctgcctatcgtaggtaccggaagacagactccaaccgattccgtacgttccggaccggactagtcgaagtacttacgttaacgttaaggtggttaccgtcgttacgttacgaagacgtaaaacgaaaccggaacggtaaaacccgaccccgtaaaggtcctggaaccttcgtaccgtccgacccctacttaccgtttacttacggaaccggtaacgggtcccggtaaccttacggtacgttacggtaccgagggtccggtgtaaggtacggcgttacggtacggtaaactagtcttacgacttcgtacaacgtgacancctagctagaccncgtatacgtacttcgttactaccttactactacgngtaaacctnaactaacttaatacgttacgttagtaacggtaccgggagggtaacccgtagaagggttacgacaaaccggtaacgtaacgtgttcggccttaaacggctaaccctcttacgtccttagtccctaagtccctaccccgg

SEQ ID NO: 226830 - DNA, 665 bp, Homo sapiens
  misc_feature: GYAE6OF01C7ZTI.15.28.C06.1.454.CMB.1.raw
  modified_base (104)..(104): a, c, t, g, unknown or other
  misc_feature (104)..(104): n is a, c, g, or t
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (403)..(403): a, c, t, g, unknown or other
  misc_feature (403)..(403): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
tcagtctacgtagccacgaccggtgctcgatttagagctcacgtattggggtttggggagtcagactcagtcaggacacagcatggacatggacgggtccccgntcagctccgtgggctcctgctgctcgtggacctccgaggtcgaccaaagtggtacgactacgtaccaagatccgaaccctgtcccgtacccgtccctacccgtgtcctgactacgtcgtaggtacggacgacaggtactacaccgtatccgtacgtcggccggaacngtacgaagtacgtattaacgtaggtcggttcgtcgttggtanacgacgaacggaacgacggaaccaccaagtcanctcncgtcacctcttcgttacgtacgaacgtagggtcccgactacgtagtacgtcgngcgagagtgacgtagtacggatagtctagactcgacacgtancgacgtcgntaccgngtaccgtcggtactgtaacgttagtaaccaccgttataacgtacgtacaacgtacgtataaacctagttaaccgtacgtaccggttaaggttaccgggacgttacggtaaggaaccggttaaggaccgtaaacgtaaccggtaacggtcggtgtacgtccgtaccgtactaccgtcgtacgttacttcctaaccgtcgtaccccg

SEQ ID NO: 226831 - DNA, 661 bp, Homo sapiens
  misc_feature: GYAE6OF01BK89L.15.28.C06.1.454.CMB.1.raw
  modified_base (102)..(102): a, c, t, g, unknown or other
  misc_feature (102)..(102): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (368)..(368): a, c, t, g, unknown or other
  misc_feature (368)..(368): n is a, c, g, or t
tcagtctacgtagccacgaccggtgctcgatttagagctcacgtattgggtttgggggagtcagactcagtcaggacacagcatggacatgagggtccccgntcagctcctggggctcctgctgctctggctcccaggtgccaaatgtgacatccagatgacccagtctccgtccacctgtcctgcatctgtcggagacagagtcacagtcacttgccggcagtcagagtatactaatgtgctgttnagnagaacaggaacgaccaaaagtcctgatcnctcgccgcctntacttnactaagtcggtaccatacaacggtcagcggtacgagtgatgtacgggacaaggtattacgagtcttacaccntaccgagaccgtagcctggacccgagtccgtagtaaccgttagttttcggaactaaacccgttacgttaacgtaccggtaactaaacgggtacctaaagtaactttaaaactaacgtttaccgttaacggttttacccgggggaacgggttaaaccgggacccgggttaaaggggttcggaaacgggaaaccttaacggtaaaaaccggtacggttagggtacggggtacctacgggtaacccgaacccttacgggttaccttacgttacctttccgttacctttacccccgg

SEQ ID NO: 226832 - DNA, 698 bp, Homo sapiens
  misc_feature: GYAE6OF01B122R.15.28.C06.1.454.CMB.1.raw
  modified_base (294)..(294): a, c, t, g, unknown or other
  misc_feature (294)..(294): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccagttgccaaatgtgacatccagatgacccagtcctccgtccaccctgtctgcatctgtcggagacagagtccacatcacttcgccggccagtcagagtattactaagtggttggccttggttcagcaagaaaccgaggaacgaccccaaaagtccgtanactctctcgccgtccctcttacgttgaccgtaaaggttcgggtacccatacgtaacggttcgaggtcggacgtagggtacggtactcggtagggaaccaaggtaacgtttaccgaggttcctaccgaccctagtaccgacggaccgtacgtccgtacgaccgtacggtacccgtaggtaaccgtttatttaccgaaccttaaaccgttacctaccgtacgtaccctaaggttcaaccttaagtaaacttaacgttacgtacggtttccggggaaccgggtaacgggtaaccgtaaggggtacggaagtaaaccgtaaaccgtaacggtaacggttacgggtacggtcgtacgaccgtacccgtacgttaccgtttacgtccgtttaccgtccgtttaccccccg

SEQ ID NO: 226833 - DNA, 807 bp, Homo sapiens
  misc_feature: GYAE6OF01AJYM0.15.28.C06.1.454.CMB.1.raw
  modified_base (780)..(780): a, c, t, g, unknown or other
  misc_feature (780)..(780): n is a, c, g, or t
tcagtctacgtagccacgaccggtgctcgatttagagctcacgtattgggtttgggggaggtcgagactcagtcaggacacagcatggacatgagggtccccgctcagctcctgggctcctgctgctcgtggctcccaggtcgccaaatgtcgacatccagatcgacccagttcctcccgtccacccttgtcctagctacttcgtggtcggaagacaggtacgttccacctatctacgttgcccgggaccagtcaagagttaacttacgtaaacgttggttacggtccgttagggtttaccgaagtaccgaacggaaaccggtaacgggtaaacgacccccgtaaaacggtcctacggtaacttccgtccgtaccggacccgtaccgttacccgtttacgttacggtaccggtaaaacgggttccggggtccctaacgttacggtaacggttccgaacggtccggtacgtaacgggttcgtaccggttacggtacgggtaacgtaattaaccggttcctaaacggtttccctaaccgaccgttacgtacgacggtacctaacggtccccgtgaaacccgttcggtacccttaacggtaacccgtttactttaccggacctttaaaccgttaccgtaacgccgtaaccgagttaccgaacttaaactaagttaaccgttcttaaacgggttccgggaaggttaccggaacgtaaggttacgaacgtaaccgaaggtaaacgtccgtagggaccgtcgtaccgtacaaccgttgttaacccngggttttactccgtaccgtttaccccg

SEQ ID NO: 226834 - DNA, 748 bp, Homo sapiens
  misc_feature: GYAE6OF01DU2Q9.15.28.C06.1.454.CMB.1.raw
  modified_base (104)..(104): a, c, t, g, unknown or other
  misc_feature (104)..(104): n is a, c, g, or t
tcagtctacgtagccacgaccggtgctcgatttagagctcacgtattgggtttggggagtcagactcagtcaggacacagcatggacatggacgggtcccccgntccagcctccgtggggcttcctgcctgctcgtcggcctcccgaggtcgaccaaagtcgtgaaccacgtaccgaaggtacttaccgaacccgtaggtcccttccccgtaccccaccccgttggtaccttcggacctacttaccggttcgggtaccgggaagaccgttaaggacgtacccacctacggtacctacggtccggcccggactagtacgaacgtattaacgtttagaacgttcggtacggtccgttcggttacgagaccgaaacggaaaccggaacggaaaccgaaccgtaaaccgtcctagtaacctccgtctacggtccctaccttactttacgtacgtacggtaacggtccgggtaacctagtccgtaagtaccgcgaggaccgagtacggactagacgggactacgtatccgttacgactacaacgtcacgtacgaccgcgcgcgtacgactcgtagtacttagttacccgactaaaccgtttccaacgtcgaacgttagaccgaaattattaacgtaccgttacgtaggtaccgggtaacgggaaccggtaacgggacgtaggaacgtaacgaacgtaaggaccggtagcgtcgtacgacccttctaacgcgttactttcgtacctccgtaccg

SEQ ID NO: 226835 - DNA, 720 bp, Homo sapiens
  misc_feature: GYAE6OF01DUB40.15.28.C06.1.454.CMB.1.raw
  modified_base (654)..(654): a, c, t, g, unknown or other
  misc_feature (654)..(654): n is a, c, g, or t
tcagtctacgtagccacgaccggtgctcgatttagagctcacgtattgggtttggggagtcagactcagtcaggacacagcatggacatgagggtcccccgctcagctcctggggcctcctgctgctctggctcccaggtgccaaatgtgacatccagatgacccagtctccgtcctaccctgtctgcatcgtgtcggagacagacgtcaccatcacgtgccggccagtcagtatattaactaagtggtggcttcgttcagacaacgaaaccgaaggaaccaacccgtaaagtcctgactcctcgccgtccgccttcttacttgaaccgtaacgggtcggtacccagtacgtaacggtcacggtcggcgtagtacggtactcggtacgggaactaggtaactcgtaaacgtcctaccgacctactcggaaccgtaccacgggtacctcgaccgttaccctccgtacggttaaccgtttagttttaccgaacttaaacccgtttaacgcccttaaccgggaccttaagggtaccctttaagaaatttaacctaacgtttggttaccccggttaggggacccggtaacgggtaaccgggaagggttaccggaaattaccggtaaaaccggtaaaccgttcgggtaagggttcccgngggtaaacccctcgtaacccccttattccgggtttacttaccccttgttaacccctttcccccggg

SEQ ID NO: 226836 - DNA, 788 bp, Homo sapiens
  misc_feature: GYAE6OF01ELCLU.15.28.C06.1.454.CMB.1.raw
  modified_base (183)..(183): a, c, t, g, unknown or other
  misc_feature (183)..(183): n is a, c, g, or t
  modified_base (209)..(209): a, c, t, g, unknown or other
  misc_feature (209)..(209): n is a, c, g, or t
  modified_base (427)..(427): a, c, t, g, unknown or other
  misc_feature (427)..(427): n is a, c, g, or t
  modified_base (768)..(768): a, c, t, g, unknown or other
  misc_feature (768)..(768): n is a, c, g, or t
  modified_base (779)..(779): a, c, t, g, unknown or other
  misc_feature (779)..(779): n is a, c, g, or t
  modified_base (784)..(784): a, c, t, g, unknown or other
  misc_feature (784)..(784): n is a, c, g, or t
  modified_base (788)..(788): a, c, t, g, unknown or other
  misc_feature (788)..(788): n is a, c, g, or t
tcagtctacgtagccacgaccggtgctcgattttagagctcacgtattggggtttggggggggggtccctgagactctcctgtgaagcctctggattcaccttgagctactttattggatgacgttgggtccgccaggctccgaagggaaggggctggagtgggtcgccacataacaaaaagntaggagtgacacaactatgtgaactntgtgagtcgggaccgtattccgaccgtctacgaaggacgaccgacgacaaagactcaactacatcagaacaaaagtgaaaccaaccgtgaacgacgccgaaggacctacgggcttggtactactttaacgtggtagtaggaacgtagtacgtttggttcgtaggtcgggttaccgggggacctaaacgggggtaacccttggtccccaaccggtttcncccgttacaaccggtccctaacccggaaaccgaaacggggtcccctaacgttcccggtttacccttaccccccggagggtccccgtccccgttacgggtacccgttaacccgtaacgggaccgtaccccgtaacccggtaacccggtaaggaacccggaccgaaaccggtaaccggtcccgggtacccgttacgggtcccgtaccggtacccgttaccgggtaacggtaaaccggtaaccgtttaacccgttcccgtaaccgttaacggttaacgacgttacggacgggtaccggacggttacggacgaccgggtacgaagtacgtaggactagcgagacngtacgtacganacgtncgtn

SEQ ID NO: 226837 - DNA, 803 bp, Homo sapiens
  misc_feature: GYAE6OF01EU7HL.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctcgtggcctcccgaggtgaccaaatgtgacactccaagatcgacccagtcctcccgtccaccctgtctgctatctggtcggagacagacgtaccaacctatccgtacgttcggcccgggaccaagtcaaggtaacgtttaacttaacgtaaaggttcggttacggtccgtttaggtttacagaccgtaaacggaaaaccggaaacgggtaaaaccccgaaccccgtaaaacggttccgtacacgttcctccgtacgcccgttccttacttacgttacgaacgtaagggttccgggtacctaacgtaccggttaaggttcgacggcggtacgtaggtacggtacgttacggacgggaactaacgtacgttacgtacgttaccactaaccgtagtaccgaacgtacccgtacgtcgtacgtaccgtacgttaccgtaacgttacgttttaacgttacgttaaccttaaaccgttacgttaccggaacgttaacgtaacgtaccgtaaacttaagttaaaccgtactttaacggttaaccgggttacggggaaaccgggtaaccgggtaacgttaaaggggacgtaaacgtaacgtaaaccggtaaaccggtagttaccgggtaagtccgtaacgtccgtaaccttcgttacgtttacttcccgttaagtcccgttaacccg

SEQ ID NO: 226838 - DNA, 755 bp, Homo sapiens
  misc_feature: GYAE6OF01E2GMM.15.28.C06.1.454.CMB.1.raw
  modified_base (615)..(615): a, c, t, g, unknown or other
  misc_feature (615)..(615): n is a, c, g, or t
tcagtctacgtagccacgaccggtgctcgatttagagctcacgtattgggtttggaggtctcagagaggagccttagccctggactccaaggccctttccacttggtgatcagtcgactgagcaccagacggacctcaccagtggtaagttggggctgagtcttgggttttccttgttgtcttattttagagtcgtaccagtgtggaggtgactaacgtggggtggacggttcgggtgggggacgtccgttccggtaccgacgggggtcccggggggtcctaggacctaccgttcctcgtagtgaaccgtcgttcgtagtacttcgtacgttagctacgttattaggtcggtacgtcggtaccggttccgggcccgaccggtacggtccggacggggtagggggtacgggtcggtaggggtcgggtccggtacgaaccctaaacgtaacgtaaaacggaaaacgtcggtaacggtacgtaacgtaaccgaaaccgttaacgttacgtacggtaacgtacgttcgtcggtaggtacggttcggacctacgtcccgtacgtaccgtacgacggaacgtaccgaccctacgtaaaccgtactacgtactactacgtanactaactaacgactaacgacggcgtaacgcggtacgaccggttaagcgttacgtagtagttacgtggtggtaagtagacggttagttcgtgttcgggtggtacgggtcccgggtaacgtacccggttctaccgcccttcg

SEQ ID NO: 226839 - DNA, 857 bp, Homo sapiens
  misc_feature: GYAE6OF01A0BA6.15.28.C06.1.454.CMB.1.raw
  modified_base (101)..(101): a, c, t, g, unknown or other
  misc_feature (101)..(101): n is a, c, g, or t
tcagtctacgtagccacgaccggtgctcgatttagagctcacgtattgggtttggggagtcagactcagtcaggacacagcatggacatgagggtccccgntcagctcctgggctcctgctgctctggctcccaggtgccaaatgtagacatccagatcgaccagtcctccgtccacctgtctgctatctgtcggatacagacgtcaccatcacgttcgccggcagtcagtagtattaacgtaagtggttaggtccttggttcacgtacgaacgtaaaccgaggaaaccgaccccgtaaaagtcctagtacgtactcgtcggccctacgttaccttacgttacgaacgtaagggtaccgggtacctactaccggtaacggttacgaccggtaccggtactacggtacggtacgttacggtacgggaaccttaaggttaaacgttcgtaaaccggttacctaacccgtacccgtaacgtaccgtaagtaccccgtaacggtccccgtacggtaccgttacccgtaccgttacggttaaccggtttaacgtttaccgggtaacccttaaacccggtttaaaccgtttaaccggtacccgtaccgggttaaacttaccgtaaaccggtttaaactaaacgtttaaacgttacccgggtttaaacggtttacccggggtaacccgggtaaaccggggtaacccgtaaaacggggtttccggaaaacgggttacccgtttaaaaccggaaaacccgggtttaacggttcggggttaaccgggtaccgttaaccggttaccctaaaccgttaatttccccgggttaactttccccggttaaaccgttaccgttttcccccggg

SEQ ID NO: 226840 - DNA, 793 bp, Homo sapiens
  misc_feature: GYAE6OF01CU4DF.15.28.C06.1.454.CMB.1.raw
  modified_base (190)..(190): a, c, t, g, unknown or other
  misc_feature (190)..(190): n is a, c, g, or t
  modified_base (351)..(351): a, c, t, g, unknown or other
  misc_feature (351)..(351): n is a, c, g, or t
  modified_base (726)..(726): a, c, t, g, unknown or other
  misc_feature (726)..(726): n is a, c, g, or t
  modified_base (771)..(771): a, c, t, g, unknown or other
  misc_feature (771)..(771): n is a, c, g, or t
  modified_base (775)..(775): a, c, t, g, unknown or other
  misc_feature (775)..(775): n is a, c, g, or t
  modified_base (788)..(788): a, c, t, g, unknown or other
  misc_feature (788)..(788): n is a, c, g, or t
tcagtctacgtagccacgaccggtgctcgatttagagctcacgtattggggtttggggggggggtccctgagactctcctgtgaagcctctggattcaccttgagcacttattggatgacgttggtcccgccaggctccgaggggaaggggctgggaggtgggtgcccaaccgtaataaaccaaaaaagntagggaagtagaacaacaaacctatgtagaactcgtgtagacgtgggaccattacaccgtctccaagagaccgacgaccaaagaactcaactacattctagacaaaagtgaaaacctacgtagacgacgaccgaggaccgaacgcttagtagtaattacgnggttgagtaagaagtcttgttaccgtggtgggtaccgggaccgtaaacggggtaacccttggtacccgtaccttcgttacccctagtacccgtccctaaccggaaacccggaacgggtaaccccctaagttcccggttaccccttacccccgtgggaaccccgttcccgtagcccgtaccggaacggaaccggaccctaacccgtaccggaacgtaacgacccgaaacgaacccgggtcccgggaacccggttcggggtaccgttaccggacccgttaacggggtaaaccggaacgttaacccgtttaacccgtttacccgacgtttaaaccggtaaaccggtacgtacggggaaacgggtcccgggtaaccggnggtaaacccggtaaacgggccgtaaacggtaccgtaagacgaganaganagtacacgagagngatac

SEQ ID NO: 226841 - DNA, 695 bp, Homo sapiens
  misc_feature: GYAE6OF01EKKQL.15.28.C06.1.454.CMB.1.raw
  modified_base (102)..(102): a, c, t, g, unknown or other
  misc_feature (102)..(102): n is a, c, g, or t
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagtctacgtagccacgaccggtgctcgatttagagctcacgtattgggtttgggggagtcagactcagtcaggacacagcatggacatgagggtccccgntcagctcctggggctcctgctgctctggctcccatgtgccaaatgtnacatccagatgacccagtcctccgtccaccctgtctgctatcgtggtcggaanacagtacgtcaacctatcgacttcggccggccagtcagtagtaattacgtaaagtggttcggcttggttcagacaagaaaaccgaggaaaccgacccaaaacgttccngactctacgtcggcctccgtacttacgttcgacgtaaagggttcgggtaccctaagtaccgtaaggtacacggcgtacgtaggtggaacgtttcgggtaagggaacgtaacgttaaagttccgtaaggttaccctacgtaaccagttccaacggccaacggccgtacggaccgtaacggccccgttaggtaaccgtttagtttacgtaaccgttaaacctttacctacgtacgtaaccgtagttacaacctaattaaacgtattaacggtacgtttacgggacgtaaccgggaaccgtaagggtcggtaaacagtaaacccgtaaccggtattacgggtcgtacctacgacctaactcgttacttcgtaacctttccgtaacccg

SEQ ID NO: 226842 - DNA, 685 bp, Homo sapiens
  misc_feature: GYAE6OF01B4XTS.15.28.C06.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
  modified_base (383)..(383): a, c, t, g, unknown or other
  misc_feature (383)..(383): n is a, c, g, or t
  modified_base (450)..(450): a, c, t, g, unknown or other
  misc_feature (450)..(450): n is a, c, g, or t
  modified_base (651)..(651): a, c, t, g, unknown or other
  misc_feature (651)..(651): n is a, c, g, or t
  modified_base (676)..(676): a, c, t, g, unknown or other
  misc_feature (676)..(676): n is a, c, g, or t
tcagtctacgtagccacgaccggtgctcgatttagagctcacgtattggggtttggggggggggtccctgagactctcctgtgaagcctctggtattcaccttgagcacttattggatgacgttgggccgcaggctcgagggagggctggagtgggngccacataacaaaagntaggaagtgacacaacctatgtnaactctgtagacgtggccgattccaccgtcncgagagacgacgacaagaacctnactanatcganacaatagaacaacgnganacgcgtagactacggctgtagtactaagtgtanagaggtacgagttgttccgtaggtcgggtaccggggaccaaacggggtacctcgggacccttacccgttcnccgtacgaaccgtccctaccgaaaccgaccgggtacccctagggtttcccgtccccgtttacccggngtacccggtcccacgttacccgtacaacgggacctaccgacccgtacgacgacgaccgacgaaccgggcggccccgtagggtcctacggtccgtacggtaccgaaccggtactaccgttaccgacgttaacgaaccggtacgtacggtacggaccggtaccggtacggaaccgaacgggacccgtaagacggtaaaccggnacgaatacgacgacgtaacgacganagtatgacg

SEQ ID NO: 226843 - DNA, 784 bp, Homo sapiens
  misc_feature: GYAE6OF01AXM90.15.28.C06.1.454.CMB.1.raw
  modified_base (178)..(178): a, c, t, g, unknown or other
  misc_feature (178)..(178): n is a, c, g, or t
  modified_base (772)..(772): a, c, t, g, unknown or other
  misc_feature (772)..(772): n is a, c, g, or t
tcagtctacgtagccacgaccggtgctcgatttagagctcacgtattgggtttgggggtaggtcgagactcagtcaggacacagcatggacatgagggtccccgctcagctcctcggggctcctgctgctcgtcggctcccaggtgccaaatgtgacatccagtatcgacctagtccnccgttcccaccctgtcctcgactctctggtacggacgaccaggactccaacacgttcctacttccgggcccgggaccctaggtccaagtacgtttaaatttacgaaagttgggtttaccggcctttgggtttacgaacgtacgaaacggaaaacccggtaagggaaaaccggaacccccctaaaacggttcccgtaaggtcctttaaccgtccggtaccgtacccccgtccgtttaacttacccttttacggaacgtaaaacggtttccgggtaccctaagttaccgtaaagggttccacgggtccggaatagggttaccgggattcggtaccggaattaacgacttacgacgttccctaccaacccgttatcccgacgtaccgaaccgtccgtacgcgtaccgaccgtagtaccggttactttacgaccgtttaactaccttactcgtaacacgtacgtaactaattaactataccgttacggttacggaacggtaccgggaaccgtaacgggtagtagtaaccgtaacgtaaactacggtgaccgggtagttaccgaaccgttacccgtaaagtccggttatccccgtttanccggtttacccc

SEQ ID NO: 226844 - DNA, 823 bp, Homo sapiens
  misc_feature: GYAE6OF01B61Z7.15.28.C06.1.454.CMB.1.raw
tcagtctacgtagccacgaccggtgctcgatttagagctcacgtattgggtttgggggagtcagactcagtcaggacacagcatggacatgacgggtccccgctcagctccgtgggcctcctgctgctcgtcggcctccccgaggtcgaccaaagttcgtagaacctactacccaggtactacgacccgacgttcccgtcccgtcccacccgttgtcgtcgcctagttccgtgggtaccggagaccgaggtacctacccaacctacgtcctaccggttccgggcccgggacctagtacgtaacggttaacgttaacttaaaccgtaaaggttcgggttaccgggttcccgtttcggttttacgaacggtaaccggtaaaccggaaaaccggtaaacggggaaaaccccgtaaccccgtaaaacggttccctacggtacttaaccgtccgtccgtcccggtaccttacgtttaccgttacgaacggtaaccgggttccgggtacctacgtaacggtaacggtccgacggcggtacggtaggtacggtacgtacggtacggaactaagtacgttacgtccgtacctaccaccgacgtacgtacgcgtaccggtcctaggtaccgacgtacccgtaggttaaccgtttacgttaccgtaaccgttaacttaccgtaccgtacgtaaccgtagtacctaataacgttaactaccgtaacgttcggtaaccgggagggtacggacgtaacggaggtactacgaaacgtacgtacggtagacgtccgagtacccactacgttacttaccttcgtacttcccgtaccccg

SEQ ID NO: 226845 - DNA, 732 bp, Homo sapiens
  misc_feature: GYAE6OF01A7K10.15.28.C06.1.454.CMB.1.raw
  modified_base (103)..(103): a, c, t, g, unknown or other
  misc_feature (103)..(103): n is a, c, g, or t
  modified_base (172)..(172): a, c, t, g, unknown or other
  misc_feature (172)..(172): n is a, c, g, or t
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (264)..(264): a, c, t, g, unknown or other
  misc_feature (264)..(264): n is a, c, g, or t
tcagtctacgtagccacgaccggtgctcgatttagagctcacgtattggggtttgggggagtcagactcagtcaggacacagcatggacatgagggtccccgntcagctccgtggggctcctgctgctctggcctccgaggtgaccaaatgtgacatccgagatcgaacccngtctccgtccacctgtctagcatctgtacgganacngacgtcactatctactggccggacagtcagatatactaagtggtgctgtacacganaacgaaacgaggaaacacccgaaagtctagactcgtcgtacgccgtccttactacgtttacggaacgtaacgggtccggtacgtaatacggtaaggttccgaacggtcggacggtaaaggttcgggaagtttaccgggaggtaaaccgtaaggtaacttaccgtacgttaccgtaaccaaccgattacggacgtcggtaaccgtccgttacggaacctacgggtacctaagggtacttacgttttaccgaactttaaccgttaacctcgtaaacggacctaggtaacctaataataaaccgttacgtaccgttaacgggttacccggaacggggtaaaccggtaacgtaacgggggtaaacgtaaagtaaccgtaaaaccgggtaaaacgtacggtttacggaacggactttaccgaccgtttaaacgtactttacggttcgttaacccttcgttaccgttacccccg

SEQ ID NO: 226846 - DNA, 955 bp, Homo sapiens
  misc_feature: GYAE6OF01CODBQ.15.28.C06.1.454.CMB.1.raw
  modified_base (105)..(105): a, c, t, g, unknown or other
  misc_feature (105)..(105): n is a, c, g, or t
  modified_base (889)..(889): a, c, t, g, unknown or other
  misc_feature (889)..(889): n is a, c, g, or t
tcagtctacgtagccacgaccggtgctcgatttagagctcacgtattggggtttgggggagtcagactcagtcaggacacagcatggacagtggacgggtccccnctcagctccgtggggctcctgctgctcgtcggcctcccgagggtacgaccaaagttcggtacgaacctactacccgaagtacgtaccgaccccgtacgtcccctcccgtaccctcccgttgtctcgactacgttcgtggtacggagtacgtacgtactaccaacctactccgtaccgtaccggcccggtaccgtacgtaccgaagttaacgttaacttaacgtaacggttcggttaccggtccgttaggttaccaacggtaaccgaaaaccggtaaaccgggtaacggaaaaccccgtaaacccgttaacgtacccgtacgtaccgttcccgttaccgtcccgtacccgttaccctttaaccgtttaccggttacggaaaccggttaaccgggttccggttaacccgacgttaacggtaacggttaccgaccggggtacggtacggtaggttacggtacgttcggtaacgggaacgtaacgtttaacgtaccgggttactacccgtaaccgaaccgtactacggacccgtaccggtcggtaaccccgttacggacccgtacgggttaccgttaacgttaaagtttcccgtttaacggaaccctttaacgttacccgtacggtaccgttaacgtcgttaacgtaacttaaacgttaaccgttaccgttaccggggttacgggtaacccggggttaaaccgggtaaccggggtacggtaaacgggtaccgggttaaaccgtaaaccgtaacccgggtaacggtaaccgggttggtaaacccgggtnttaaccccggaaccgtttctacggtttacctaacccggtttccgttaacccctccgttacccccgg

SEQ ID NO: 226847 - DNA, 739 bp, Homo sapiens
  misc_feature: GYAE6OF01ANZEH.15.28.C06.1.454.CMB.1.raw
  modified_base (101)..(101): a, c, t, g, unknown or other
  misc_feature (101)..(101): n is a, c, g, or t
tcagtctacgtagccacgaccggtgctcgatttagagctcacgtattgggtttgggggagtcagactcagtcaggacacagcatggacatgaggtccccgntcagctccgtggggctcctgctgctctggctcccgaggtgccaaatgtgacatccagtactcgacccagttcctcccgtccgacctggtctgcacttcgtggtccggacgacgacgtactcaaccgtatcgtaccgttcggcccggcctagtcaggtaacgttaacttaactaacggttggttcgtccgttaggtttcaaggacgaacggtaaacgaacggaaaccgtaacccgaaacgtccgtacgtacgtccgtcgtccgaccgtcctacgttacgttacggaacgttaacgggttccggtaccgtaacgttaccggaaggttccggaacggaccggtagtacgggtacggtacgtaccgtacgggaaccgtagtaacgttccgtagtacccgtcgacgtaacgtacgcgtacgacggttccacgtaccgacgttccgtacgtaacggtttacgttacgtaccttaaaccttcgtaacgtaccgtacgttaacgtcctaacgtaataacggttacctagtacggttcgggaaccgggttagaccggtaggtccggtaatacgtaactaacggcgttacggtcgtaacgccggtaaatcccgtacggttacttagtacccttcgtaacccgttcccg

SEQ ID NO: 226848 - DNA, 936 bp, Homo sapiens
  misc_feature: GYAE6OF01D365O.15.28.C06.1.454.CMB.1.raw
  modified_base (140)..(140): a, c, t, g, unknown or other
  misc_feature (140)..(140): n is a, c, g, or t
  modified_base (208)..(208): a, c, t, g, unknown or other
  misc_feature (208)..(208): n is a, c, g, or t
tcagtctacgtagccacgaccggtgctcgatttagagctcacgtattgggtttgggggagtcagactcagtcaggacacagcatggacatgagggtccccgctcagctccgtggggctcctgctgctctggctccaggtnaccaaagtgtcgacatccagtatacgacccagtcctccgtccacccgtgtctgctactcgtggtcganaccaggtactccaacctattccgaaccgttcggaccccgggtaccctaagtccgaaggtaagtttaacttaaccgttaaaaggttgggtttacgccgtttagggtttacaacgtaccaaacggaaaacccgaaggggaaaaccgacccccgtaaaaacgttcccgttacgtaacgttccgtccgttaccggtaccccgtacccgtttacccgtttaacgttttacggaaccgtaaacggggttcccggggttacccctaaacgttaccggttaaacggtttaccgacggggtaccggtaaccgtaacgggttacgggtaacgttaccggggtaaacggggaacgtaaacggttaacgtttacccgtacggttacccttaaccgtaaacccgtaacgtaccgtaacggacccgtaccggtaaccgtcggaacctacccgggttaccgttaacgggttaaccgttttaaccgttttacccggttaaaccctttaaacccgtttaaccggtttaaccgtaccgtaaaccggtaacggttacgtaaacttaacgttaaaacgttacccgtttagtaaaccggtttccggggaaacgggttaaccgggtaaccgaaggggttaacgaacgttaaacccgaaacggaaacggttaccggtaagttaccgggtacgtaccgtaacccgtactaccgtttaccgttaacgttacccgtttcgtccgttaacccccg

SEQ ID NO: 226849 - DNA, 676 bp, Homo sapiens
  misc_feature: GYAE6OF01E4U6Y.15.28.C06.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (315)..(315): a, c, t, g, unknown or other
  misc_feature (315)..(315): n is a, c, g, or t
tcagtctacgtagccacgaccggtgctcgatttagagctcacgtattgggtttggggagtcagactcagtcaggacacagcatggacatgagggtcccccgntcagctcctggggctcctgctgctctggctcccaggtgccaaatgtgacatccagatgacccagtctccgtccaccctgtctgcatctggtcgganacagagtccaccatcacgttcggccgggccagtcagtagtattaactaaagtggttggcctggtttcagcaagaaaccgaagggaaaccaccccaaaagtcctgactctctcgcccnccttcttacttgaacctaaggtcgggtacccatacgaaggtcgacggcggactaggtggactcggtaggactaagtaacttcgacgtactccaaccctagtaccgacggacccacgtcccgtagcccgaacggtacccgttaggtaaccggtttaacttttacgaacctttaaacccttaacctaccgttacgaacccgtaagtccgtaactaattaaacttaacgtacgttaacgtttccgggaacgggtacggtaacgtaagggtaggtacgtaaacgtaaccgaaaacgtcgttagggtacggcgtacggtaaccctaccgtacttcggttacctttaccttacgcccgtttaccccg

SEQ ID NO: 226850 - DNA, 679 bp, Homo sapiens
  misc_feature: GYAE6OF01BE28J.15.28.C06.1.454.CMB.1.raw
  modified_base (62)..(62): a, c, t, g, unknown or other
  misc_feature (62)..(62): n is a, c, g, or t
  modified_base (214)..(214): a, c, t, g, unknown or other
  misc_feature (214)..(214): n is a, c, g, or t
  modified_base (274)..(274): a, c, t, g, unknown or other
  misc_feature (274)..(274): n is a, c, g, or t
  modified_base (609)..(609): a, c, t, g, unknown or other
  misc_feature (609)..(609): n is a, c, g, or t
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
  modified_base (647)..(647): a, c, t, g, unknown or other
  misc_feature (647)..(647): n is a, c, g, or t
  modified_base (654)..(654): a, c, t, g, unknown or other
  misc_feature (654)..(654): n is a, c, g, or t
  modified_base (665)..(665): a, c, t, g, unknown or other
  misc_feature (665)..(665): n is a, c, g, or t
  modified_base (672)..(672): a, c, t, g, unknown or other
  misc_feature (672)..(672): n is a, c, g, or t
  modified_base (676)..(676): a, c, t, g, unknown or other
  misc_feature (676)..(676): n is a, c, g, or t
  modified_base (679)..(679): a, c, t, g, unknown or other
  misc_feature (679)..(679): n is a, c, g, or t
tcagtctacgtagccacgaccggtgctcgatttagagctcacgtattgggtttggggggaanaggaagactgacggtccgccaggctccagggaagggctggagtgggtggccaccatacaaaaagatggaagtgacacaacctatgtgaactctagtgatgggccgattcaacccgtctccagagacgacgccaaagaacctcactacatccngcaaatgaacacctgagagccgaggcacggctgtagtattactgtgtgagagatgttacnggtcggttcggggccacgggaaccctgggttaccaccggtcctacctcaccgtcctaccaaccgaacgggccccaagtccgggttccctttcccccggtaggtccccgtaccctcgtccgtccgaacgggccgtaccaaccccgttccgaaggcgtaccaccgtacggacccgggtccctacgggggtcctaccggccgttacgggtaaccgaaacgggtaccctttacccgtttacccggtaccggtttaaccgtaaacggtacccgtggggtaaccgtccggggtaacgtccgggggaacctaacgggggtaccctaccggtaggtaaccgcncgagaaccgtgactcggatcgcganacgtcngtcgacngactagnctacgtacgcncacacanctgngtn

SEQ ID NO: 226851 - DNA, 760 bp, Homo sapiens
  misc_feature: GYAE6OF01BTQHH.15.28.C06.1.454.CMB.1.raw
tcagtctacgtagccacgaccggtgctcgatttagagctcacgtattggggtttgggggagtcagactcagtcaggacacagcatggacatgagggtccccgctcagctcctggggctcctgctgctctggctccaggtgccaaatgtgacatccagatcgacccagtcctccgtccaccctgtctgcatctggcggagacagagtcaccatctacgttcggccgggccagtcagtagttattaacgtaagtggttacggtccgttggtttacagacgtaacgaaaccggaagggaaaccacccgtaaagtcctagactccgtcgtcgtcccgtccttacttacgttacgacgtaacggtcgggtacctagtacgtaacggttcgaggccggtagaggttacggtacgtcggtaagggtactaacggttaacgttacgacggttaccaccctaactacgtacgaaccgtcgaaccggtccgtcgaccgtacggttaccgtacggttaaccgtttacgttttaccggaacctttaaaccgtttaccgtaaccgttccggaaccgttaaaggttcgaaacctttaattaaacgttaacttaccggtttaacgggtttaaccgggggaccgggttaacgggaaccggtaaacggggttaaggtaacggtaaactaaaccgggtaaacggtacggttagggacgggtactaccgaacccggtacttacggttcgttaccgtttaccttcgtaccttacccccgg

SEQ ID NO: 226852 - DNA, 726 bp, Homo sapiens
  misc_feature: GYAE6OF01D18BK.15.28.C06.1.454.CMB.1.raw
  modified_base (101)..(101): a, c, t, g, unknown or other
  misc_feature (101)..(101): n is a, c, g, or t
  modified_base (438)..(438): a, c, t, g, unknown or other
  misc_feature (438)..(438): n is a, c, g, or t
  modified_base (712)..(712): a, c, t, g, unknown or other
  misc_feature (712)..(712): n is a, c, g, or t
tcagtctacgtagccacgaccggtgctcgatttagagctcacgtattgggtttggggagtcagactcagtcaggacacagcatggacatgagggtccccgntcagctccgtgggctcctgctgctcgtcggcctcccgaggtcgacctaaagtgtacgacactccaagtatcgaccctagtcctcccgtccctacccgtgtctgctacgtcgtggtacggagacgagacgtccaacctactcgtacgttcggccggtacctagtacgagtaacttataacgtagtggttcgtcgttggttcacgacgaacggaacggaacggaacctaacccgtaagtccgtagtaccttccgtccgtccggtcccttccttaccgttacgttacggaacgttaacgggttccgggtacctacgtacggtacggtcggacggtccggngtaggtcgtacgtcggacgtaagtaacgtatacgtacctacgtaccacgtacgtacgagcctacgcctcgccgtaacgtcgtaagtacgttaccgtttacgaacccttaactccgttacgtctaacgtacgtacgtaactaacgttaactacgttagttaccgggtacggtacgggaaccggtaagtacgggaacgtaagtaaccgtaaaccggtaacgtacggttacggtacggaccgtacaaccgttccggtacttcggttacctttaccgnttaacccggtcccc

SEQ ID NO: 226853 - DNA, 740 bp, Homo sapiens
  misc_feature: GYAE6OF01DRYXC.15.28.C06.1.454.CMB.1.raw
  modified_base (102)..(102): a, c, t, g, unknown or other
  misc_feature (102)..(102): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (436)..(437): a, c, t, g, unknown or other
  misc_feature (436)..(437): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (668)..(668): a, c, t, g, unknown or other
  misc_feature (668)..(668): n is a, c, g, or t
tcagtctacgtagccacgaccggtgctcgatttagagctcacgtattggggtttggggagtcagactcagtcaggacacagcatggacatgagggtccccgntcagctccgtggggctcctgctgctctggcctcccgaggtcgaccaaattgtagacatccagactcggaccctaggtccctcccgtaccacccgtgtctagctacttcgtggtacggaagacaggacgtaccaaccctatccgtaacgttccgggcccgggtcctaaggttacgaaggttaacgttactttaaacgtaagttcgggttcgtccgtttcggttacaagaccgaaagtaaacggaacgggaaacctaccaaacgtcctagactcctcgcgccgtcctcttacgtgaacgtaggtccgtaccagtacgtaggtcnggtcgngaggtnntcgagactagtactntactccactcntacgacgtcacgtctagacgtccgtacgtacgtagttacgtttacacctttaacgtaccgtaccgttacgggaactacgttaaccgtaacgttaactttaaacgttaacgtcggggttttaaccggaacggggttaccggggaaccggtaacggaacggggtttaccaaggtaaacccgtaccgggaaacgttaaccggggtttnaccggtaaccacccgtacctaaccgtttacgttacccgttgtttaaccctacccggttacccgttaccccgg

SEQ ID NO: 226854 - DNA, 449 bp, Homo sapiens
  misc_feature: GYAE6OF02G7QAS.15.28.C06.1.454.CMB.1.raw
  modified_base (441)..(449): a, c, t, g, unknown or other
  misc_feature (441)..(449): n is a, c, g, or t
tcagtctacgtagccacgaccggtgctcgatttagagctcacgtattgggtttgggggaagaggaagactgacggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaacccctggtcaccgtctcctcagcctccaccaagggcccatcggtcttcccctggcgccctgctccaggagcacctccgagagcacagcggccctgggctgcctggtcaaggactacttccgctacgtagactgagcgggctggcaaggcgcatagnnnnnnnnn

SEQ ID NO: 226855 - DNA, 497 bp, Homo sapiens
  misc_feature: GYAE6OF02GUPZL.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgctaacttactactgccaagtgcaataataatcatttcggcggaggaccaaggtgagatacaaacgaactgtaggctcgcaccatctgtcttcattcccg

SEQ ID NO: 226856 - DNA, 492 bp, Homo sapiens
  misc_feature: GYAE6OF02F7ZOR.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgctaacttactactgccaagtgcataatatcatttcggcggaggaccaagggtgagatacaacgaactgtggctgcacatctgtcttcattcccg

SEQ ID NO: 226857 - DNA, 484 bp, Homo sapiens
  misc_feature: GYAE6OF02IOR26.15.28.C06.1.454.CMB.1.raw
  modified_base (464)..(464): a, c, t, g, unknown or other
  misc_feature (464)..(464): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtccatcaaggttcagcgcagtggatctggacagaattcagtctcaccatcagcagcctgcagcctgacgattttgcaacttactactgccaagtgcataataatcattcggcgagggacaaggtgagatcaaacgaactagtggntgcacatctgtcttcatccg

SEQ ID NO: 226858 - DNA, 507 bp, Homo sapiens
  misc_feature: GYAE6OF02H2E4S.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctggacagatcagtctcaccatcagcagcctgcagcctgacattttgctaacttactactgccaagtgcaataataatcatttcggacggtaagggaccaagggtcgagactacgaaacggactagtacgggctaggccaacgatctagtactttcattccc

SEQ ID NO: 226859 - DNA, 447 bp, Homo sapiens
  misc_feature: GYAE6OF02IJW3N.15.28.C06.1.454.CMB.1.raw
  modified_base (441)..(447): a, c, t, g, unknown or other
  misc_feature (441)..(447): n is a, c, g, or t
tcagtctacgtagccacgaccggtgctcgatttagagctcacgtattgggtttgggggaagaggaagactgacggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaacccctggtcaccgtctcctcagcctccaccaagggcccatcggtcttcccctggcgccctgctccaggagcacctccgagagcacagcggccctgggctgcctggtcaaggactacttccgctacgtagactgagcgggctggcaaggcgcatagnnnnnnn

SEQ ID NO: 226860 - DNA, 490 bp, Homo sapiens
  misc_feature: GYAE6OF02IEUAQ.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagattcaccatcacttgccgggccagtcagagtattactaaatggttggcctggtttcagcagaaaccagggaaagccccaaaaagtcctgatctctgccgcctctactttgcaaagtgggtccatcaaggttcagcggcagtggatctgggacagattcagtctcacatcagcagcctgcagcctgacgattttgctaactttactactgccaagtgacataataatacatttcggcgagggacaaggtggagatacaacgaactgtggctgcacatctgtacttcatcc

SEQ ID NO: 226861 - DNA, 488 bp, Homo sapiens
  misc_feature: GYAE6OF02FGZJJ.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagcccccaaaagtcctgatctctgccgcctctactttgcaaagtggggtcccatcaaggttcagcggcagtggatctgggacagaattcagtctcaccatcagcagcctgcagcctgacgattttgctaacttactactgccaagtgcataatatcatttcggcggaggaccaaggtgagatcaacgaactgtggctgcacatctgtcttcatccc

SEQ ID NO: 226862 - DNA, 484 bp, Homo sapiens
  misc_feature: GYAE6OF02ICELS.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcagcggcagtggatctggacagaatcagtctcaccatcagcagcctgcagcctgacgattttgctaacttactactgccaagtgcataataatcatttcggcgagggacaaggtggagatcaaagaactgtggctgcacatctgtcttcatcc

SEQ ID NO: 226863 - DNA, 494 bp, Homo sapiens
  misc_feature: GYAE6OF02HHDTD.15.28.C06.1.454.CMB.1.raw
  modified_base (486)..(494): a, c, t, g, unknown or other
  misc_feature (486)..(494): n is a, c, g, or t
tcagtctacgtagccacgaccggtgctcgatttagagctcacgtattgggtttgggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaaatgaacaacctgagagccgaggacacggctgtgtattactgtgtgagagatgttctgcgttggggccaggggaaccctggtcaccggtctcctcagcctccaccaagggcccatcggtcttcccctggcgccctgctccaggagcacctccgagagcacagcggccctgggctgcctggcaaggctacttccgctacgtagactgagcgggctggcaaggcgcagtagnnnnnnnnn

SEQ ID NO: 226864 - DNA, 489 bp, Homo sapiens
  misc_feature: GYAE6OF02FWT1N.15.28.C06.1.454.CMB.1.raw
  modified_base (485)..(485): a, c, t, g, unknown or other
  misc_feature (485)..(485): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgctaacttactactgccaagtgacataatatctatttcggcgaggaccaaggtgagtatcaaacgactgtggctgcacatctgtcttcnttcc

SEQ ID NO: 226865 - DNA, 548 bp, Homo sapiens
  misc_feature: GYAE6OF02IXPEC.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgaccccaaagtcctagatctctgccgcctctacttgacaaaggtcgggtaccatcaaggttcagcggcagtggatcgtggacagaattcatctcacatcagcagcctgcagcctagacgtatttgactaacttactactcgtacctaagtcgactaataattactactaacgtttcgggacgggtaacgggtaccgaaagggtggaagagtaccgaaacggtaacgtaggtcggactcgacaccgtacttccgtcgttccttactacttcccg

SEQ ID NO: 226866 - DNA, 566 bp, Homo sapiens
  misc_feature: GYAE6OF02I5TGO.15.28.C06.1.454.CMB.1.raw
  modified_base (275)..(275): a, c, t, g, unknown or other
  misc_feature (275)..(275): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaanaccccaaaagtcctgatctctgccgcctctactttgcaaagtgggtcccatcaaggttcagcggcagtggatcgtgggacagaatcagtctcaccatcagcagcctggcagcctagacgtattttcgactaactttactactgacctaagtcgactaataaatactactagtttacgggacgggaagggaacccgtaagggtcggaagtactacgaaaacggtaacgtaggttacgggctacggtaccaaccgtacgttaccgttacggttacctttaccgtattaccccg

SEQ ID NO: 226867 - DNA, 515 bp, Homo sapiens
  misc_feature: GYAE6OF02IGWYX.15.28.C06.1.454.CMB.1.raw
  modified_base (380)..(380): a, c, t, g, unknown or other
  misc_feature (380)..(380): n is a, c, g, or t
tcagtctacgtagccacgaccggtgctcgatttagagctcacgtattgggtttggggagtcagactcagtcaggacacagcatggacatgagggtccccgctcagctcctgggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagcccaaaaagtcctgatctctgccgacctctactttgcaaagtgggtcccatcaagttcagcggcagtgatctgggacagattcagtctcaccatcagcagcctgcanctgacgaattttgctaaacttactaactgaccaagtcgcaataaataatactaatttcgggacgtagggaccaaagggtcgaagatacaaacgaactagtaggctagctaaccgatactgtacttctattacccg

SEQ ID NO: 226868 - DNA, 506 bp, Homo sapiens
  misc_feature: GYAE6OF02IO7C4.15.28.C06.1.454.CMB.1.raw
  modified_base (478)..(478): a, c, t, g, unknown or other
  misc_feature (478)..(478): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtccctgatctctgccgcctctactttgcaaagtggggtcccatcaaggttcagcggcagtggatctgggacagaattcagtctcaccatcagcagcctgcagcctgacgtattttgctaactttactactgccaagtgacaataataatctaatttcggcggaagggaccaaagggtgagatacaaacgactgnggctgacaccatcctgtcttcattcccg

SEQ ID NO: 226869 - DNA, 586 bp, Homo sapiens
  misc_feature: GYAE6OF02IBEBA.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccaggaaagccccaaaagtcctgatctctgccgcctctactttgcaagtgggtcccatcaaggttcagcggcagtggatctggacagatcagtctcacatcagcagcctgcagcctgacgtattttgactaactttactaacttcgccaaagtgactaataaattaactctaacgttttcgggacgggaacggggtaacccaaaggggttacgggaaggtaacttaaccgaaaaccggtaaaacgtttcgggtagggtacccttacgggaccctaacccgtaagttcccgttaggttaccttttaccgactttacccccgg

SEQ ID NO: 226870 - DNA, 751 bp, Homo sapiens
  misc_feature: GYAE6OF02J3HWR.15.28.C06.1.454.CMB.1.raw
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (500)..(500): a, c, t, g, unknown or other
  misc_feature (500)..(500): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
  modified_base (738)..(738): a, c, t, g, unknown or other
  misc_feature (738)..(738): n is a, c, g, or t
  modified_base (742)..(742): a, c, t, g, unknown or other
  misc_feature (742)..(742): n is a, c, g, or t
  modified_base (744)..(744): a, c, t, g, unknown or other
  misc_feature (744)..(744): n is a, c, g, or t
  modified_base (748)..(749): a, c, t, g, unknown or other
  misc_feature (748)..(749): n is a, c, g, or t
tcagtctacgtagccacgaccggtgctcgatttagagctcacgtattgggtttggggtcccgtgagactctcctgtgaagcctctggattcaccttgagcacttattggatgacttgggtccgccagggcctcggaggggagggtcgtgggaggtgggtcggccacataaacgaaaagtgtagggaagtagaaccaacctaaaccgttagtggtaacgaaccttcgtggtagtaggtcggggacctattccgacccgttcaccgaaggacgaccgccgacctaaagactaccactaactacttcgacgaaactaaagtacgaaacctaacgngaacgcgacggagaaccgtacggtctagtacttattacgtggtggtagaagaagtnttgtttcgngggttacgggtcgggaccgtaacgggtacctcggttccaccgtccttccacgcctccctacccgaacggtacccggctacggttcccgttccccttccccggnggccccgcccgttaagccctaccgggaaggccgaccctaccggtaccggagacgacccgtaacgccgggcccggtccggtgggtacctccgggtacccgtttcgggaaccgtaaaccgggtacccttttacccgggttacccgacccggtttaaccggttacgaacgggtttccggaaccgggggtcccgtccggtacgggaaccaaccgggggccacgttaacgtcggncgngacgncgcncngcgnngc

SEQ ID NO: 226871 - DNA, 515 bp, Homo sapiens
  misc_feature: GYAE6OF02GTUSP.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatcgtgggacagaattcagtctcaccatcagcagcctgcagcctgacgtattttgactaacttactactgccaagtgactaataataatctagtttcggacggtaacgggaccaagggtgagatacgaaacgtacgtgtcggctagacactatccgttgtcttcattcccg

SEQ ID NO: 226872 - DNA, 503 bp, Homo sapiens
  misc_feature: GYAE6OF02H46LZ.15.28.C06.1.454.CMB.1.raw
  modified_base (173)..(173): a, c, t, g, unknown or other
  misc_feature (173)..(173): n is a, c, g, or t
  modified_base (388)..(388): a, c, t, g, unknown or other
  misc_feature (388)..(388): n is a, c, g, or t
  modified_base (491)..(503): a, c, t, g, unknown or other
  misc_feature (491)..(503): n is a, c, g, or t
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaaagntggaagtgacacaaacctatgtgaactctgtgatgggccattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccacaacgggcccatcggtccttcccctggccnccctgcctccaggacgcacctccgagagcacacgcggccctgggctgccgtgtcaaggactacgtccgctacgtagactgagcgggctggcaaggcgcagtgnnnnnnnnnnnnn

SEQ ID NO: 226873 - DNA, 566 bp, Homo sapiens
  misc_feature: GYAE6OF02JIAHP.15.28.C06.1.454.CMB.1.raw
  modified_base (340)..(340): a, c, t, g, unknown or other
  misc_feature (340)..(340): n is a, c, g, or t
  modified_base (559)..(559): a, c, t, g, unknown or other
  misc_feature (559)..(559): n is a, c, g, or t
  modified_base (561)..(566): a, c, t, g, unknown or other
  misc_feature (561)..(566): n is a, c, g, or t
tcagtctacgtagccacgaccggtgctcgatttagagctcacgtattgggtttggggggtccctgagactctcctgtgaagcctctggattcaccttgagcacttattggatgacttgggtccgccaggctccagggaaggggctggagtgggttggacgttttcaaaagtaaaaatgatggtgagaaaatagactacggtgcacccgtgaaaggaagattcaccatctcaagagataattcaaaaacgacggtgtatttgcaaatgaacagcctgaaaaccgaggacacagccgtctattactgtacccacagattcggaagtgcatcgacgtaaaggngctatgcttttgatatctggggcccagggacaagtggtcgtcgtctcttcagcctcaccaagggcccatcgtcctcccctgccaccctcctccaagacgccacctcgtcggggcacgacgccggccctgggcctcgccgtggtaccaacggaccttaccgttccgcttaaccggtacgactggacggcgggccgtgggcgaagggtccgacacgtacgncnnnnnn

SEQ ID NO: 226874 - DNA, 512 bp, Homo sapiens
  misc_feature: GYAE6OF02HYTDA.15.28.C06.1.454.CMB.1.raw
  modified_base (394)..(394): a, c, t, g, unknown or other
  misc_feature (394)..(394): n is a, c, g, or t
  modified_base (504)..(512): a, c, t, g, unknown or other
  misc_feature (504)..(512): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaaacctgagagccgaggacacggctgtgtattactgtgtgagagatgttctgcgttggggccaggggaaccctgggtcaccgtctcctcagcctccaccaagggcccatcggtccttcccctggccnccctgcctcccaggacgccacctccgagagcacacggccggccctgggcctgccctggtcaaggactaccttccgctacgtagactgagcgggctggcaaggcgcatagnnnnnnnnn

SEQ ID NO: 226875 - DNA, 562 bp, Homo sapiens
  misc_feature: GYAE6OF02G6S6S.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcggcggcagtggatcgtgggacagaattcagtctcaccatcagcagcctgcagcctgacgtattttgactaacttactacttgccaagtgactaataaataatctagtttcggacggtagggaaccaagggtaggaagtacgttacgaaaacgtaacgttggtacgggacttaggaccctaaccgtacgttccgttaccggttccctttacgtaccttccttacccccgg

SEQ ID NO: 226876 - DNA, 558 bp, Homo sapiens
  misc_feature: GYAE6OF02ISY63.15.28.C06.1.454.CMB.1.raw
  modified_base (257)..(257): a, c, t, g, unknown or other
  misc_feature (257)..(257): n is a, c, g, or t
  modified_base (426)..(426): a, c, t, g, unknown or other
  misc_feature (426)..(426): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcngcagaaaccagggaaagaccccaaaagtcctgatctctgccgctcccctatttcgcaaaggtcgggtccatcaaggttcagcggcagtggatctgggacagaattcagtctcacatcagcagcctgcagcctgacgtattttcgactaacttactactcgtaccaagtnacaataataatctaagtttcggacggtaagggaaccgtaaagggtgaacgacgttacgaaaaccggtaacgtaggttacggaccgttagaccctaacctacgttccgtcgttacctttacgtaccttccccg

SEQ ID NO: 226877 - DNA, 563 bp, Homo sapiens
  misc_feature: GYAE6OF02GJENU.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaaccagggaaacgaccccaaaagtccctgatctctgccgcctctactttgcaaagtggggtcccatcaaggttcaggcggcagtggatcgtgggacagaattcgagtctacaccatcagcagcctgcagcctagacgtattttcgacttaacttactactgaccaagtcactaataaattaatactagtttaccggacgggtaagggacccgaaagggtggaagagtaacgaaacgtaacgtaggtacggcgtacgaccgaacctacgttccgttacggtacctttaccgtacttaccccg

SEQ ID NO: 226878 - DNA, 577 bp, Homo sapiens
  misc_feature: GYAE6OF02IIST0.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccgggccagtcagagtatactaaatggttgctggttcagcagaaaccaggaaacgaccccaaaagtcctagattctctcgccgcctctactttgacaaagtcgggtccatcgaaggttcagcggcagtgatctggacagattcagtctacaccatcagcacgcctgcagtcctagacgtattttcgacttaaacgtttactactcgtaccaagtcgactaattaaataacttacctaagtttacgggaccgggtaacgggaaccgtaaagggtagaacggacgttaacgaaacggtaacgttaggtacggtacgttacgacctaccgtaacttcctacggttacttaccgtactttccccg

SEQ ID NO: 226879 - DNA, 508 bp, Homo sapiens
  misc_feature: GYAE6OF02GPDNC.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctagacgtattttgactaacttactactgccaagtgacataatatctatttcggcgaagggaccaagggtgagactacgaaacggaactagtcggactgactaccatctgttcttcattcccg

SEQ ID NO: 226880 - DNA, 643 bp, Homo sapiens
  misc_feature: GYAE6OF02JPVOU.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaccagggaaacgcccaaaagtcctagatctctcgccgcctctactttgctaaagtcgggtcccatcaaggttcaggcgcagtggatcgtggacagtaatcacgtctcaccatccagcagcctgcagtccgtagacgtattttacgaccgttaaactttaacctacgtcgaacctaacggtacgactaagttaaacttaacgtactaacgttttaccggggaaccggggtaaacggggtaaaccgtaaaggggttacgggtaaacggtacgttaaacccgaaaaccggttaaaccggttagggttaacgggtaccgttacggacccgtaaccgtaaccgtttaccgttacggttacccttttacgtaccgttttacccccg

SEQ ID NO: 226881 - DNA, 547 bp, Homo sapiens
  misc_feature: GYAE6OF02FNXL7.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgctctactttgcaaagtgggtccatcaaggttcagcggcagtggatctggacagaattcagtctcaccatcagcagcctgccagcctgacgtattttgactaacttactacttcacctaagtcgactataaataatcgtaagtttcgggacgggaagggtaccgaaagggtcggaagtacgtacgaaaacggtaactacggttaggaccttaggaccaacctagtccttaggtacctttacatttccccg

SEQ ID NO: 226882 - DNA, 514 bp, Homo sapiens
  misc_feature: GYAE6OF02JDUFW.15.28.C06.1.454.CMB.1.raw
  modified_base (359)..(359): a, c, t, g, unknown or other
  misc_feature (359)..(359): n is a, c, g, or t
  modified_base (429)..(429): a, c, t, g, unknown or other
  misc_feature (429)..(429): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcaagaaaccagggaaagaccccaaaagtcctagatctactcgccgcctctactttgactaaaggtggggtcccatcgaaggttcaggcggcagtggatcgngggacgattcagtctcacatcagcagcctgacacgctgacgtatttgactaacttactactcgaccagtnacataatatctattcggacggagacaaggtagagatacgaaagacgtggtagctagaccactactctagtctactctcctacccg

SEQ ID NO: 226883 - DNA, 494 bp, Homo sapiens
  misc_feature: GYAE6OF02HKQS4.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgtattttgactaacttactactgccaagtgcataatatactagtttcggacggagggacaaggtgagatacaacgtactgtggctgcacatctagtcttcattcc

SEQ ID NO: 226884 - DNA, 496 bp, Homo sapiens
  misc_feature: GYAE6OF02IZWIM.15.28.C06.1.454.CMB.1.raw
  modified_base (398)..(398): a, c, t, g, unknown or other
  misc_feature (398)..(398): n is a, c, g, or t
  modified_base (484)..(484): a, c, t, g, unknown or other
  misc_feature (484)..(484): n is a, c, g, or t
  modified_base (486)..(496): a, c, t, g, unknown or other
  misc_feature (486)..(496): n is a, c, g, or t
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaagatggaagtgacacaacctatgtgaactctgtgatgggccgattcaccgtctccagagacgacgccaagaactcactacatctgcaaaatgaacaacctgagagccgaggacacggctgtgtattactgtgtgagagatgttctgcgttggggccagggaaccctggtcaccgtctcctcagcctccaccaagggcccatcggtctcccctggcgccctgctccaggngcacctccgagagcacagcggccctgggctgcctggtcaaggactactccgctacgtagactgagcgggctggcaggcgcagtagncnnnnnnnnnnn

SEQ ID NO: 226885 - DNA, 499 bp, Homo sapiens
  misc_feature: GYAE6OF02GQKUY.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaaccagggaaagccccaaaagtcctgatctctgccgcctctactttgcaaagtgggtcccatcaaggttcagcggcagtggatcgtgggacagaattcagtctcaccatcagcagcctgcagcctgacgtattttgactaacttactactgccaagtgacataataatctagtttcggcggaggaccgaaggtgagatacgaaacgaactgtaggctgcacatctgtcttcattcccg

SEQ ID NO: 226886 - DNA, 593 bp, Homo sapiens
  misc_feature: GYAE6OF02H9NUX.15.28.C06.1.454.CMB.1.raw
  modified_base (400)..(400): a, c, t, g, unknown or other
  misc_feature (400)..(400): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgaccccaaaagtcctagatactctcgccgcctctactttgctaaagtcgggccatctaaggtcagcggctagtggatcgtggacagattcagtctcacatcagcacgcctgcagtcctagacgtnttttagccttaactttactactcgactaagtcgactaataattaactacgttagtttaccgggacgggtaacgggaaccgaaaggggttaggaagtaacgttaaccgtaaaaccggtaacgttacggttacgggaccgtttacgacccgtaccgtaagtaccgtttaggttactttaccctactttacccccg

SEQ ID NO: 226887 - DNA, 523 bp, Homo sapiens
  misc_feature: GYAE6OF02GINU2.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaacagggaaagccccaaaagtcctgatctctgccgcctctactttgcaagtggggtcccatcaaggttcagcggcagtggatcgtggacagaattcagtctcaccatcagcagcctgcacgcctgacgtattttgactaacttactactcgacctaagtgacataataatctagtttcggacggaagggaccaagggtggagacgtacgaaacggtacgtaggtcggactgaccacacttctggtacttcgtacttccccg

SEQ ID NO: 226888 - DNA, 516 bp, Homo sapiens
  misc_feature: GYAE6OF02IPAQ0.15.28.C06.1.454.CMB.1.raw
  modified_base (426)..(426): a, c, t, g, unknown or other
  misc_feature (426)..(426): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagaccccaaaagtcctgatctctgccgcctctactttgcaaagtggggtccatcaaggttcagcggcagtggatctgggacagaattcagtctcaccatcagcagcctgcagtcctgacgtattttgactaacttactactgacctaagtganataataatctaagtttcggacggaagggaccaagggtgagatacgaaacgaacgtggtggcgtgacacctatccgtgtcttacattcccg

SEQ ID NO: 226889 - DNA, 555 bp, Homo sapiens
  misc_feature: GYAE6OF02JCSBK.15.28.C06.1.454.CMB.1.raw
  modified_base (398)..(398): a, c, t, g, unknown or other
  misc_feature (398)..(398): n is a, c, g, or t
  modified_base (542)..(542): a, c, t, g, unknown or other
  misc_feature (542)..(542): n is a, c, g, or t
  modified_base (544)..(545): a, c, t, g, unknown or other
  misc_feature (544)..(545): n is a, c, g, or t
  modified_base (547)..(555): a, c, t, g, unknown or other
  misc_feature (547)..(555): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccaccataacaaaaagatggaagtgacacaacctatgtgaactctgtgatgggccattcaccgtctccagagacgacgccaagaactcactacatctgacaaatgaacaacctgagagccgaggacacggctgtgtattactgtgtgagagatgttctgcggttggggccagggaaccctggtcaccgtctcctcagcctcaccgaacgggcccagtcggtccttccccctcgggccncccgtgcctccgacggacgcacctccgagacgcacacgccggcccgtcgggccgtcgccgtcgggtcgaacggaccgttaccgttacccggccttaaccggtacgaccgttcgacggcgggcgtggcgaacgggcgcagtacgncnngnnnnnnnnn

SEQ ID NO: 226890 - DNA, 539 bp, Homo sapiens
  misc_feature: GYAE6OF02GNKRK.15.28.C06.1.454.CMB.1.raw
  modified_base (431)..(431): a, c, t, g, unknown or other
  misc_feature (431)..(431): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaaccagggaaagacccaaaagtccagatctctgccgcctctactttgactaaaggtcggggtcccagtacgtaaggttcagcggacagtggatcgtggacagaattcagtctacaccatcagcagcctgcagcctgacgtatttgactaactttactactcgacaagtnactaataaatatctatttcgggacggtaggaccgaagggtagagtatacgaaacgtaacgtagtacggtactcggacaccgtattcttcggttctttaccgattcccg

SEQ ID NO: 226891 - DNA, 452 bp, Homo sapiens
  misc_feature: GYAE6OF02JHAL1.15.28.C06.1.454.CMB.1.raw
  modified_base (438)..(438): a, c, t, g, unknown or other
  misc_feature (438)..(438): n is a, c, g, or t
  modified_base (443)..(452): a, c, t, g, unknown or other
  misc_feature (443)..(452): n is a, c, g, or t
tcagtctacgtagccacgaccggtgctcgatttagagctcacgtattgggtttgggggaagaggaagactgacggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggccgccctcgctccaggacgcacctccgagagcacagcggcctgggctgcctggtcaaggactacgttccgctacgtagactgacgcgggctggcaaggcncatgnnnnnnnnnn

SEQ ID NO: 226892 - DNA, 493 bp, Homo sapiens
  misc_feature: GYAE6OF02HA2M6.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggtcagcgcagtgatctggacagaattcagtctcaccatcagcagcctgcagcctgacgtatttgactaacgttactactgccaagtgcataataatctatttcggacggtaggaccaaggtgagatacaacgatgtagctagacacctatctgtcttcattcccg

SEQ ID NO: 226893 - DNA, 509 bp, Homo sapiens
  misc_feature: GYAE6OF02GFAFQ.15.28.C06.1.454.CMB.1.raw
  modified_base (500)..(509): a, c, t, g, unknown or other
  misc_feature (500)..(509): n is a, c, g, or t
tcagtctacgtagccacgaccggtgctcgatttagagctcacgtattgggtttggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaacttactacatctgcaaatgaacaacctgagagccgaggacacggctgtgtattactgtgtgagagatgttctgcgttggggccagggaaccctggtcaccgtctcctcagcctccaccaacgggcccatcggtcttccccctggccgccctgcctccagggacgccaccctccgagacgcacacgccggcccgtgggctgcctggtcaaggctacgttccgctacgtagactgacgcgggctggcagggcgcagtgnnnnnnnnnn

SEQ ID NO: 226894 - DNA, 564 bp, Homo sapiens
  misc_feature: GYAE6OF02HPBKH.15.28.C06.1.454.CMB.1.raw
  modified_base (178)..(178): a, c, t, g, unknown or other
  misc_feature (178)..(178): n is a, c, g, or t
  modified_base (552)..(564): a, c, t, g, unknown or other
  misc_feature (552)..(564): n is a, c, g, or t
tcagtctacgtagccacgaccggtgctcgatttagagctcacgtattgggtttggggggggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatgggccattcaccgtctccagagacgacgccaagaactcactacatctgcaaatgaacaacctgagagccgaggacacggctgtgtattactgtgtgagagatgttctgcgttggggccagggacctggtcaccgtctcctcacgcctccaccaacgggcccagtccggtccttcccccgtggccgcccctgcctccgaggacgccacccgtccgagacgcacgacggccggcccgtgggcctcggcccgttcgggtacaacgggtaccttaccgttcccgacttaccgtacgacgtcggacgggccggggcgtcgggaccgaacgggcgacgtaagtaggnnnnnnnnnnnnn

SEQ ID NO: 226895 - DNA, 494 bp, Homo sapiens
  misc_feature: GYAE6OF02H0D0Q.15.28.C06.1.454.CMB.1.raw
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
  modified_base (435)..(435): a, c, t, g, unknown or other
  misc_feature (435)..(435): n is a, c, g, or t
  modified_base (488)..(494): a, c, t, g, unknown or other
  misc_feature (488)..(494): n is a, c, g, or t
tcagtctacgtagccacgaccggtgctcgatttagagctcacgtattggggtttgggggggggggtccctgagactctcctgtgaagcctctggattcaccttgagcacttattggatgacttgggtccgccaggctccagggaaggggctggagtgggtggccaccatacaaaaaagatggaagtgacacaacctatgtgaactctgtgatgggccgattcaccgtctccagagacgacgccaaagaactcactacatctgcaaaatgaacaacctgagagccgaggacacggctgtgtattactgtgtgagagatgttctgcgttggggccagggaacctggtcaccgtctcctcagcctccacaaggcccatcggcttcccctggccnccctgcctccaggacgcacctccgagagcacngccggcctggcngcctgtcaagactacttccgctacgtagactgagcgggctggcaggcgcatgnnnnnnn

SEQ ID NO: 226896 - DNA, 519 bp, Homo sapiens
  misc_feature: GYAE6OF02GUQ6W.15.28.C06.1.454.CMB.1.raw
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (512)..(519): a, c, t, g, unknown or other
  misc_feature (512)..(519): n is a, c, g, or t
tcagtctacgtagccacgaccggtgctcgatttagagctcacgtattgggtttgggggggggtccctgagactctcctgtgaagcctctggattcaccttgagcacttattggatgagttgggtccgccaggctccagggaaggggctggagtgggttggacgtttcaaaagtaaaaatgatggtgagaaaatagactacggtgcacccgtgaaaggagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccagggacaagtggtcgtcgtctcttcagcctccacaggcccatcgtctccctgcncctctcagngcacctctggggcacngcggcctggctgcctggtcaggactactccgctacgtagactgagcgggctggcaaggcgcgatagnnnnnnnn

SEQ ID NO: 226897 - DNA, 592 bp, Homo sapiens
  misc_feature: GYAE6OF02JGVDU.15.28.C06.1.454.CMB.1.raw
  modified_base (139)..(139): a, c, t, g, unknown or other
  misc_feature (139)..(139): n is a, c, g, or t
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
  modified_base (416)..(416): a, c, t, g, unknown or other
  misc_feature (416)..(416): n is a, c, g, or t
tcagtctacgtagccacgaccggtgctcgattttagagctcacgtattgggtttggggagtcagactcagtcaggacacagcatggacatgagggtccccgctcagctcctgggctcctgctgctctggctcccaggtnccaaatgtgaccatccagatcgacccngtctccgtccacctgtcngcatcgtgacgagaccaggtatcaaccatccacgttcggccgggactagtccagatataactaaattggttgcctggttcagacgaagaaaccgagggaaacacccgtaaaagtcctagatctctcgccgtctctactttgactaaacggtcggggtaccagtacgtaaggtcaggcggtcagtggtatcggtaggacgtagaattcgaagttcacacatcagactagccgngacgaacgcgtacgtaacgttacttttagccttaactttacgactacgacctaagtcactaagtaattactagtacgttaggaccggtaagggaaccaagggtaggatacgaacgtaaccgaaggttcgaaggcctaagcgtaaccctggttcctatttacctactaacgttcccc

SEQ ID NO: 226898 - DNA, 501 bp, Homo sapiens
  misc_feature: GYAE6OF02HT5CL.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccagttgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctacttgcaaagtgggtccatcaaggttcagcggcagtgatctggacagaatcagtctcacatcagcagcctgcagcctgacgtattttcgctaactttactactcgaccaagtgacaataataatctagtttcgggacggagggaccaagggtgagatacgaaacgactgtaggctgacaccatctgtcttcattccc

SEQ ID NO: 226899 - DNA, 499 bp, Homo sapiens
  misc_feature: GYAE6OF02FWEPD.15.28.C06.1.454.CMB.1.raw
  modified_base (420)..(420): a, c, t, g, unknown or other
  misc_feature (420)..(420): n is a, c, g, or t
  modified_base (484)..(484): a, c, t, g, unknown or other
  misc_feature (484)..(484): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagaccccaaaagtcctgatctctgccgcctctactttgcaaagtgggtcccatcaaggttcagcggcagtggatcgtgggacagaattcagtctcaccatcagcagcctgcagcctgacgtatttcgctaacttactactgaccagtncaataataatctagttcggacggtaggactaaggtgagatacgaacgtacgtggcgctagcacntctgtcttcactccg

SEQ ID NO: 226900 - DNA, 539 bp, Homo sapiens
  misc_feature: GYAE6OF02JJKX8.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaaatggttggcctggtttcagcagaaaccagggaaaagccccaaaaagtcctagatctctgccgcctctactttgcaaaagtggggtcccatcgaagttcagcggcagtgatcgtggacagaatcagtctcacatacagcagctgcagcctgacgtatttgctaaacttactactgaccaaagtcgacaataaattaaatctaaagtttccgggacgggtaaacggggaaccaaagggtggaagactacgaaaacgaacgtagtaggctacgacaacctatcctagtcttacgattcccg

SEQ ID NO: 226901 - DNA, 698 bp, Homo sapiens
  misc_feature: GYAE6OF02J3CA9.15.28.C06.1.454.CMB.1.raw
  modified_base (380)..(380): a, c, t, g, unknown or other
  misc_feature (380)..(380): n is a, c, g, or t
  modified_base (529)..(529): a, c, t, g, unknown or other
  misc_feature (529)..(529): n is a, c, g, or t
  modified_base (626)..(626): a, c, t, g, unknown or other
  misc_feature (626)..(626): n is a, c, g, or t
tcagtctacgtagccacgaccggtgctcgatttagagctcacgtattgggtttggaggtctcagagaggagccttagccctggactccaaggcctttccacttggtgatcagcactgagcacagaggactcaccatggaattggggctgagctgggttttcctgttgctattttagaaggtgtccagtgtgaggtgcaacgtggtggagtcgtgggggagcctcggtccagggccggggggtccctggacgactctccgtgtgaacgcctgtggattcaccttgagctacttattggatgacgttggtcccgcgaggctaccgaggggaagggtctgggaggtcggggtcggaccaaccgtaagttaaaccgaaaaaggngttagggaaacgttcggaaaccaacgaaccttagtcggtacgaacttcgtaggtacgtaagtcggggaccttaacgtttccgaacccggtttccacccgaaggtacgggaaccgtaccggaccaaaaggtaacccttcaaaccgtaacncttacccgaggtaacaaaacgttccgaaaccttaaacccgtggaacgaccggaccgtaacggaccgtaacggtccttaggtagttaccgttagtggngttaggagtacgtagttcgttcgcgggttcgggttacgggaccttacggggacccttgggtaccctacccgg

SEQ ID NO: 226902 - DNA, 534 bp, Homo sapiens
  misc_feature: GYAE6OF02GV7KE.15.28.C06.1.454.CMB.1.raw
  modified_base (423)..(423): a, c, t, g, unknown or other
  misc_feature (423)..(423): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggctggtttcagcagaaaccagggaaagaccccaaaagtcctagatctctcgccgcctctactttgacaaagtgggtccatcaaggttcagcggcagtggatcgtgggacagaatcagtctcaccatcagcagcctgcagcctgacgtattttcgactaacttactactgaccaagtnacataaactatctagtttccgggacggaagggaccaaggggtgaacgtataacgaaacggacttaggtcgctacgacctaaccgngttcctacggttcttactattccccg

SEQ ID NO: 226903 - DNA, 549 bp, Homo sapiens
  misc_feature: GYAE6OF02HFIHQ.15.28.C06.1.454.CMB.1.raw
  modified_base (381)..(381): a, c, t, g, unknown or other
  misc_feature (381)..(381): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcgcagtggatcgtgggactagaattcagtctcaccatcagcagccngcagcctgacgtattttcgactaacttacctactcgtccaagtcgactaataaataatctatttcgggacggtaaggaccgaaagggtcgaagacgtacgaaacgtaacgttggttacggaccgtacgaccaaccgtacgttccgttcgttctttacgatttaccccg

SEQ ID NO: 226904 - DNA, 562 bp, Homo sapiens
  misc_feature: GYAE6OF02HS6RQ.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgccccaaaagtccctgactctctcgccgcctctactttgacaaaggtcggggtcccagtcaaggttcagcggcagtgatctgggacagaattcagtctcacatcagcagcctgacagcctagacgtatttgactaactttacactcgacctaagtcgactaattaataatctagtttccgggacgggtaacgggaaccgaaagggtgggaacgtagtacgaaacggtaacttacggtaggtccgtaggccaaccgtagttaccgttagttccttactacttaccccg

SEQ ID NO: 226905 - DNA, 517 bp, Homo sapiens
  misc_feature: GYAE6OF02ISN7S.15.28.C06.1.454.CMB.1.raw
  modified_base (271)..(271): a, c, t, g, unknown or other
  misc_feature (271)..(271): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaacaggaacnccccaaaagtcctagatctctgccgcctctacttgacaaggtcgggtacccatctaaggttcagcggcagtgatcgtggacagaattcagtctcacatcagcacgctcgacagcctagacctntttacnctaaacttactactcgaccaagtcanataactatactagttacggacggaggtaccaagggtgaagatacaaacgtacgtggtacgtctcgacacgatctcgtcttacgacttcccg

SEQ ID NO: 226906 - DNA, 515 bp, Homo sapiens
  misc_feature: GYAE6OF02F6V9M.15.28.C06.1.454.CMB.1.raw
  modified_base (508)..(508): a, c, t, g, unknown or other
  misc_feature (508)..(508): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcaagaaaccagggaaagccccaaaagtcctgatctctgccgcctctactttgcaaagtgggtcccatcaaggttcagcggcagtggatcgtggacagaattcagtctcaccatcagcagcctgcagcctgacgtattttgctaacttactactgccaagtgactataatatactacgtttcgggacgaacgggacaagggtgaacgatacgaaacggaactgtcggatgactacatcttacgtcttacncttcccg

SEQ ID NO: 226907 - DNA, 562 bp, Homo sapiens
  misc_feature: GYAE6OF02GUVOW.15.28.C06.1.454.CMB.1.raw
  modified_base (200)..(200): a, c, t, g, unknown or other
  misc_feature (200)..(200): n is a, c, g, or t
  modified_base (499)..(499): a, c, t, g, unknown or other
  misc_feature (499)..(499): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgaccaaatgtgacatccagatcgacccagtcctccgtccaccctgtctgcatctggtcgganacagagtcaccatcacttcggccgggccagtcagagtattaactaaatggttggccttggtttcagcaacgaaaccgaaggggaaacgacccccaaaagtcctagatcctctcgcccgcctcttactttgacaaaggtcggggtcccatcgaaggttcagcggcaggtggatcgtggacagaattcagtctcaccatcagcacgcctgcacgcctagacgttatttgacctaactttactactcgaccaagtgactaataataatctagttcgggacgggaacggaccgaagggtgganatacgaaaccgtaacgtggtcggacttcgacctactagttccttcgtcctttcactttccccg

SEQ ID NO: 226908 - DNA, 462 bp, Homo sapiens
  misc_feature: GYAE6OF02H3O5U.15.28.C06.1.454.CMB.1.raw
  modified_base (451)..(462): a, c, t, g, unknown or other
  misc_feature (451)..(462): n is a, c, g, or t
tcagtctacgtagccacgaccggtgctcgatttagagctcacgtattgggtttggggggaagaggaagactgacggtcctgccacaggtggtgctggagtgggtggccaccatacaaaaagatggaagtgacacaacctatgtgaactctgtgatgggccgattcaccgtctccagagacgacgccaagaactcactacatctgcaaaatgaacaacctgagagccgaggacacggctgtgtattactgtgtgagagatgttctgcgttggggccagggaaccctggtcaccgtctcctcagcctccaccgaagggcccatccggtcctttccccctggccgccctgctcccgaggagcacctccgagagcacagcggccctgggctgcctggtcaaggctacgttccgcttacgagactgagcggggctgggacaagggcgactaatagnnnnnnnnnnnn

SEQ ID NO: 226909 - DNA, 554 bp, Homo sapiens
  misc_feature: GYAE6OF02H7WYC.15.28.C06.1.454.CMB.1.raw
  modified_base (176)..(176): a, c, t, g, unknown or other
  misc_feature (176)..(176): n is a, c, g, or t
  modified_base (295)..(295): a, c, t, g, unknown or other
  misc_feature (295)..(295): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (546)..(554): a, c, t, g, unknown or other
  misc_feature (546)..(554): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatgggccgattcaccgtctccagagacgacgccaagaactcaactacatctgcaaatgaacaacctgagagccgaggacacggctgtntattactgtgtgagagatgttctgcggttggggccagggaccctggtccaccgtctcctcacgccctaccaccgaacggggccccaagtcccggttccctttcccccgtggcccgccctagccctaccgaggacgccaccgtccgagacgcacgacgcggcccgtgggctcgccgtggtacaacggacctacgttcccgacttacggtacgacgtggacggcgggctggaccgaggcgcaagtgnacgncnnnnnnnnn

SEQ ID NO: 226910 - DNA, 651 bp, Homo sapiens
  misc_feature: GYAE6OF02JCAXA.15.28.C06.1.454.CMB.1.raw
  modified_base (368)..(368): a, c, t, g, unknown or other
  misc_feature (368)..(368): n is a, c, g, or t
tcagtctacgtagccacgaccggtgctcgatttagagctcacgtattgggtttggaggtctcagagaggagccttagccctggactaccaaggccctttccgacttggtgatcagcactgagcacagaggactcaccatggaattggggctgagctgggtttccttgttgctattttagaaggtgtccagtgtgaggtgcaacgtggtggagtctgggggaggcctcgtccaggccgggggggtccctgacgactctccgtgtgaaggcctctggattccaccttgagtctacgttattggatgaccttgggtccgccgaggctccgagggacggggctggagtgggtcggccaccagtaacaaaagntaggaagtgaacaacaacctagtgtagaacgtctgtagaagtcggggaccgatttccgaaccgttcctacccgagaacggaccgaccgaccaaaggaacctcgaacctacgactctagacaaatcgaaaccaaccgtggaacgtacggacccgaggaccgacgggcctaggttacgtactttacccggtggtagtacggaaggtagttaagttcggttcgttgggtccgggttttacgggggaccccttaagggggtaaccccttggggtaccctaccccggg

SEQ ID NO: 226911 - DNA, 808 bp, Homo sapiens
  misc_feature: GYAE6OF02HJVWN.15.28.C06.1.454.CMB.1.raw
  modified_base (111)..(111): a, c, t, g, unknown or other
  misc_feature (111)..(111): n is a, c, g, or t
  modified_base (118)..(118): a, c, t, g, unknown or other
  misc_feature (118)..(118): n is a, c, g, or t
tcagtctacgtagccacgaccggtgctcgatttagagctcacgtattgggtttgggagtcagactcagtcaggacacagcatggacatgagggtccccgctcagctccggnggcctcngctgctgcgccaccgaggtcgacaagtgtagactactcgagtataccgacctagtcctccgtaccctaccgtgtctcgactacttcgtcggacggaacacgaggtactaccaacctactacctacgtcgggacccggacctacgtacgagtagttaacttaaacgtaagttgggtccgtcgtttcgttacacgacgaaacgaaaccggaaagggaaacccaaacccgtaaacgtccgtagtacttcctcgtaccgcccgtcctacctttacgttacgaacgtaaacggggttcccgggtacctacgtaacggttaacggtcgacgggccggacgtaggtaggtacttcgggtacggaacgtaaggttaactacgtacgttacctacccgtaacctacgtacgacgacgtaccgtccgtacgacgtaccgtcgtacggtactttacgttaccgaaacctttaacctttaccgtacgtaccgtaacgtaaggtaccgtaacttaaaacgttaaacttaccgtaacggtttaccgggtttaccggggaaccgggggtaaaccggtaaacggtaaggggtacggtaacgtaccgtaaaaccggtaaaccgttagggtaccgggtacggtaaccgtaccggaaccctacgttaaccgttccgttacgtttacccttacgtacccgtttacccccg

SEQ ID NO: 226912 - DNA, 507 bp, Homo sapiens
  misc_feature: GYAE6OF02FJVD4.15.28.C06.1.454.CMB.1.raw
  modified_base (275)..(275): a, c, t, g, unknown or other
  misc_feature (275)..(275): n is a, c, g, or t
  modified_base (501)..(501): a, c, t, g, unknown or other
  misc_feature (501)..(501): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaanccccaaaagtcctgatctctgccgcctctactttgcaaagtggggtcccatcaaggttcagcgcagtggatctgggacagaattcagtctcaccatcagcagcctgcagcctgacgtattttgctaaccttactactgaccaagtcgacaataataatctagtttcggcggaggacaagggtgagatacgaaacgtaactggtggctcgacaccatcctgtccttnattccc

SEQ ID NO: 226913 - DNA, 536 bp, Homo sapiens
  misc_feature: GYAE6OF02F8QV6.15.28.C06.1.454.CMB.1.raw
  modified_base (174)..(174): a, c, t, g, unknown or other
  misc_feature (174)..(174): n is a, c, g, or t
  modified_base (384)..(384): a, c, t, g, unknown or other
  misc_feature (384)..(384): n is a, c, g, or t
  modified_base (527)..(536): a, c, t, g, unknown or other
  misc_feature (527)..(536): n is a, c, g, or t
tcagtctacgtagccacgaccggtgctcgatttagagctcacgtattgggtttggggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatgggccgattcaccgtctccagagacgacgccaagactcactacatctgcaaatgaacaacctgagagccgaggacacggctgtgtattactgtgtgagagatgttctgcgttggggccaggggaaccctggtcaccgtctcctcagcctccaccaagggcccagtcggtcttccccnggccgccctgctccaggcgcaccgtccgagagcacagccggccctggggcctgtcccgtgggtaccgaacggtaccttaccgttccggacctaccgtagacctggagccggggctgggaccaagggccgagacgtaagcagcnnnnnnnnnn

SEQ ID NO: 226914 - DNA, 580 bp, Homo sapiens
  misc_feature: GYAE6OF02GUM09.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggtttcagcagaaaccagggaaacgacccaaaagtcctagatctctcgccgcctctactttgcaaagtgggtcccatcaaggttcagcggcagtggatctgggacagaattcagtctcacatcagcagctgacagcctgacgtattttcgacctaaactttactaactcgtacccaaggttgactaataaattaactctaagtttcgggaacgggtaacgggaaacccgtaaaggggttcgaagtacgttaaccgaaaacggtaacgttacggtacgggtacttacggacctaaccgtacgttccttaggtaccctttacgactttccccg

SEQ ID NO: 226915 - DNA, 590 bp, Homo sapiens
  misc_feature: GYAE6OF02GLO73.15.28.C06.1.454.CMB.1.raw
  modified_base (131)..(131): a, c, t, g, unknown or other
  misc_feature (131)..(131): n is a, c, g, or t
  modified_base (358)..(358): a, c, t, g, unknown or other
  misc_feature (358)..(358): n is a, c, g, or t
tcagtctacgtagccacgaccggtgctcgatttagagctcacgtattgggtttggaggtctcagagaggagccttagccctggactccaaggcctttccacttggtgatcagcactgagcacagaggactnaccatggaattggggctgagctgggttttccttgttgctattttagaaggtgtccagtgtgaggtgcaactggtggagtcgtgggggaggcctcggtccgaggccgggggggtccctgacgactctcctgtgaagcctctggattcaccttgagctacttattggatgacttgggccgccaggctccgaggggaaggggctgggagtgggtgccacatacaaaaagntaggaagtgaacacaaccgtatgtgaactcgtgtgagtcgggcctattccgaccgtcctccgaagacggaaccgacgaccaacgaactccaactacactctagacaaacgtgaaaccacctaggaacgacgacccggaggaccacgggctggtagttattacgtgtggtagagagtagtcgttcgtgtcggttcggggacccaacggggtacccgttggtacccgtacccgg

SEQ ID NO: 226916 - DNA, 790 bp, Homo sapiens
  misc_feature: GYAE6OF02IQG9H.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagacgtattactaaatggttggcctggtttcagtcacgaaaccgagggaaacgaccccgaaaagtcctagactctactcgccgtcctctactttacgacgtaaacgttcgggtaccctacgtacgtaacggttacgacggtacggtccgaaggttacggtagtaccgtaggggtaacctaaggtaaatttccgtaaggttcctaacctaaccctattaccgaacggccgtaacccgtacccggttacgaccgtaaccggtaccttaacgggtaacgttaaccgtttttacggtaaccttaaaaccgttttaacccctttaaccgttacgggtaacccctaaaagggtttcgaaacccgttaaattaaacgttaacttaccgtttaaccggttttaccggggaacggggtaaaccggggtaaaccccgtaaaggggttacccgggtaaaggtacgttaaaccggtaaaccggtaaacgtttacgggtacggtaaccggtgtaaccccggttaacgtaccggtttacttaacccgggtttactttaccgaacccgtttttcccccg

SEQ ID NO: 226917 - DNA, 595 bp, Homo sapiens
  misc_feature: GYAE6OF02HOW6R.15.28.C06.1.454.CMB.1.raw
  modified_base (413)..(413): a, c, t, g, unknown or other
  misc_feature (413)..(413): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagacagaaaccgagggaaacgacccctaaaagtccctagactactctcgccgccttctactttgactaaacggtcggggtacccagtacgtaaggttcacggcggcgtaggtggatcgtagggaacagtaattcagttctcacatcagcagcctgacngcctgacgtatttcgactaaacttacgtactcgaccaagtcgactaattaaataactactacggttaccgggacgggtaacgggaacgtaaaggggtgaacgtacgtaacgaaacggtaacgtggtacggacgtaccgacctaaccgtacgtccgttacgttaccttacgacctttaccccg

SEQ ID NO: 226918 - DNA, 562 bp, Homo sapiens
  misc_feature: GYAE6OF02G0CJU.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgagacagagtcaccatcacttgccggcagtcagagtatactaaatggttggcctggttcagcagaaaccgaggaaacgaccccaaaagtccctagactctctagcccgcctctacttgctaaagtcgggtccatcaaggttcacgcggcagtgatcgtagggacagtaattcgagtcgtcaccatcagccagcctgacacgcctagacgtattcgactaacttacacttgacctaagcgacgtaataataatctagtttcgggacggtaacggaccgaaaggtggaagtactaacgaaaccggtaactaggtacggactacggacctaccggtaattccgtacggttacctttacgaccctttaccccg

SEQ ID NO: 226919 - DNA, 541 bp, Homo sapiens
  misc_feature: GYAE6OF02GAWHJ.15.28.C06.1.454.CMB.1.raw
  modified_base (351)..(351): a, c, t, g, unknown or other
  misc_feature (351)..(351): n is a, c, g, or t
  modified_base (407)..(407): a, c, t, g, unknown or other
  misc_feature (407)..(407): n is a, c, g, or t
  modified_base (479)..(479): a, c, t, g, unknown or other
  misc_feature (479)..(479): n is a, c, g, or t
tcagtctacgtagccacgaccggtgctcgatttagagctcacgtattgggtttggaggtctcagagaggagccttagccctggactccaaggcctttccacttggtcgatcagcactgagcacagaggactcacccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttatggatgacttgggtccgccaggctccagggaagggctggagtgggtgccaccatacaaaaagntggaagtgaacacaacctatgtgaactctgtgatgggccaattcaccgtctccagngacgacgccaagaacctcactacatctgacaaatgaacaactgagagcgaggacacggctagtgtattacgngtgaggaagagatagttctaggtcggttcggggccaaggggaaccccttgggtcctacccgg

SEQ ID NO: 226920 - DNA, 577 bp, Homo sapiens
  misc_feature: GYAE6OF02F399S.15.28.C06.1.454.CMB.1.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (516)..(516): a, c, t, g, unknown or other
  misc_feature (516)..(516): n is a, c, g, or t
tcagtctacgtagccacgaccggtgctcgatttagagctcacgtattgggtttgggggtaggtcgagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggtttcagctaagaaaccgagggtaaacgaccccaaaagtcctagatctactgccgaccttctactttgacaaaggttcggggtacccagtactaaggttacaggcgagacgtgggatccgtgggactagaattcgagtctacgacctatcagancgacncgcacgtccagtacgtattttggcctaaactttcctactcgtactaaaggtcgactaataataacttctagtttcgggacggtacgggaacctaaagggtgaanagtaacgaaacggtaacgtgtcggtacctggaccaccgtatccgtggtaccttgacttccg

SEQ ID NO: 226921 - DNA, 589 bp, Homo sapiens
  misc_feature: GYAE6OF02G7B1E.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggttgctggttcagcagaacaggaacgacccaaaagtcctgatctcgtgccgcctcttactttgactaaaggtcggggtcccataccgaaggttcaggcggcgaggtggactcgtgggaacaaggtaattcagtctacaccatcagtcagcctgcacgcctgacgtattttacgaccttaaacttacctacgtcgaaccgtaagtcgtactaattaaactaattacgtaacgtttcgggacgggtaacgggaaccgtaagggtaggaacgtacgtaaccgaaacgggtaactagggttacggacgttcggaacctaccgtacttccgttcgtttaccttctacgttcccg

SEQ ID NO: 226922 - DNA, 601 bp, Homo sapiens
  misc_feature: GYAE6OF02JENHJ.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggccagtcagagtattactaaatggttggcctggtttcagcagaaaccagggaaacgccccaaaagtcctgatctctcgccgccttctactttcgacaaaggtcggggtaccctagtacgtaaggttcaggcggacaggtggaactcgtgggaacagtaacgttcagtcctcaccatacagccaagccctgccacgccgtgtacgtatttcgacctaattactacgtgaccaacgtcgactaagttaactaactactaaggtttccggacgggtaacgggaccgtaaagggtcggaacgtacgtaacgaaacggtaacgtacggtaggtacctacggtaccaacccgtacttacgttcggtcttaccgtcgtttaaccccg

SEQ ID NO: 226923 - DNA, 544 bp, Homo sapiens
  misc_feature: GYAE6OF02FZLKO.15.28.C06.1.454.CMB.1.raw
  modified_base (273)..(273): a, c, t, g, unknown or other
  misc_feature (273)..(273): n is a, c, g, or t
  modified_base (526)..(526): a, c, t, g, unknown or other
  misc_feature (526)..(526): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatccacttgtcgggccagtcagagtattactaatggttgcctggttcagcagaaccagggaaacnccccaaaagtcctagactcgtctcgccgcctctactttgacaaaggtcgggtcccagtcaaggttcagcggcagtggatcgtgggacagaatcagtctcaccatcagcacgcctgcacgcctagacgtatttcgactaaccttactactcgacctaagtcgactaataatatactagtttacggacggtacggtacgaagggtgaagtactacgaaacgtacgtagtacggcctgacctaccgtacttccgtntcctttacgactttcccg

SEQ ID NO: 226924 - DNA, 554 bp, Homo sapiens
  misc_feature: GYAE6OF02GL4C4.15.28.C06.1.454.CMB.1.raw
  modified_base (356)..(356): a, c, t, g, unknown or other
  misc_feature (356)..(356): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctggagactctcctgtgaagcctctggattcaccttgagcacttattggatgacttgggtccgccaggctccgaggggaaggggctgggagtgggtggccaccataacaaaaagntaggaagtgacacaacctatgtgaactctgtgagtgggccatcaccgtctccagagacgacgaccaagacctcactacatctgacaaatcgaacaacctgaagacgaccgaggaccacggctgtagtattacgtgtcgngagagtattggttcgtgtcggttgggaccgacgggtaccctgggtacccaccggttccg

SEQ ID NO: 226925 - DNA, 604 bp, Homo sapiens
  misc_feature: GYAE6OF02G0U1Q.15.28.C06.1.454.CMB.1.raw
  modified_base (278)..(278): a, c, t, g, unknown or other
  misc_feature (278)..(278): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacgttgccgggccagtcagagtattactaaatggttaggcctggtttcagcagaaaccagggaaacnccccaaaagtcctgactcgtctacgcccgccttctactttgactaaaggtcggggtcccatacgaaggttcaggcgctagtggatcgtgggaacagtaacttcgaagtcacgacatacgagcacgtcctaggacagtccgtagaacggttattttcgacttaaactttacttaacgtcgacctaagttcgactaattaaatactactaacgtttccgggaccgggtaaggtaccgaagggtcggaacgagtaacgaaacggtaacgttggtacggacttacggtacccacgtacgttccgtacgttacgttactacgtttaccccg

SEQ ID NO: 226926 - DNA, 684 bp, Homo sapiens
  misc_feature: GYAE6OF02HJKT3.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattaactaaatggttggctggtttcagcagaaaccagggaaacgaccccaaaagtcctagatctctgccgcctctactttgacgaaaggtcgggtccatcaaggttcaggcggacagtggatcgtaggacagtaattcagtctacgaccactacacgacagtccctgacctacgtcctggtaaccgttagtttttacgaaccttaaactttaccttaaccgttacgaaccgtaaacggttcggaacctaaagtttaaaacttaaacgttaccgttaaacgggttttaccggggaaccggggtaaacgggggtaacccgtaaaaggggttacggggaaacggtacgtaaccggtaaaaaccggtaacggttacgggttacggtaaccgttacggacccgtaacccgtaacgtttccgttacggtttaccctttaccgtaccgttttacccccgg

SEQ ID NO: 226927 - DNA, 506 bp, Homo sapiens
  misc_feature: GYAE6OF02FQI3D.15.28.C06.1.454.CMB.1.raw
  modified_base (337)..(337): a, c, t, g, unknown or other
  misc_feature (337)..(337): n is a, c, g, or t
  modified_base (419)..(419): a, c, t, g, unknown or other
  misc_feature (419)..(419): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggcctggtttcagcagaaaccagggaaagccccaaaagtcctgatctctgccgcctctactttgcaaagtgggtccatcaaggttcagcggnagtggatcgtgggacagaattcagtctcaccatcagcagcctgcagcctgacgtattttcgactaacttactactgcaagtnactataatatctagtttcggacggtaggaccgaagggtaggagatacgaaacgactggtaggctagcactatctgtcttcattcccg

SEQ ID NO: 226928 - DNA, 684 bp, Homo sapiens
  misc_feature: GYAE6OF02HXJIU.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtatactaatggtgctgttcagcagaaaccaggaaacacccaaaagtcctagactctactcgccgcctcttactttgacgtaaaggtcgggtcccaatacgtaaaggttcagcggactaggtggatcgtagggaacaagtaattcgagtcctaccaactatacgagtccaacgtccgtagacctagtcctagtaaccgttagttttacgaaccttaaacgttttaacaccgttacgtaccgtaaagtacgtaactaaacgttaaaactttaacgtacgtttaacggtttaccggggaaccgggttaaccgggggtaaacccgtaaaggggtacggtaaacgtaaccgtaaaccggtaaaaaccggtaacggttacggttaacgggtaccgttaccggaacccgtaaccttacgttaccgtttaccgtttaccgtttaccgtacccgtttacccccgg

SEQ ID NO: 226929 - DNA, 624 bp, Homo sapiens
  misc_feature: GYAE6OF02HVFUK.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgccccaaaagtcctagactctctcgccgcctctactttgactaaaggtcggggtcccatcgaaggttcaggcggcaggtggatcgtgggacagattcagtctcactatcagcagcctgacagcctagacgtatttgacctaactttactactgacctaagtcgtacaattaaacttaactcgtaagtttaccggggacgggtaacggggtaacccgtaaaggggttcgggaacgtacgttaaccgtaaaaccggaaccggtttagggtacggtaccggttacggacccctaaaccggtacgtttacccgtttacgggtttacccctttaccgtagttttacccccccgg

SEQ ID NO: 226930 - DNA, 609 bp, Homo sapiens
  misc_feature: GYAE6OF02JBYMM.15.28.C06.1.454.CMB.1.raw
  modified_base (297)..(297): a, c, t, g, unknown or other
  misc_feature (297)..(297): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccgagggaaagccccaaaagtcctgatcctcncgccgtcctctacttgactaaagtcggggtaccatacgaaggttcagcggcagtggactcgtagggactagattcacgtcctcaacatcgacgcacgcctgacacgtcctagtactattttgaccttaaacttacccgttactcgtacctaaagtcgtaacaattaaactaactccgttaagtttccggggaacgggtaacgggtaaacccgtagggttaacgggagtacgtaaccgtaaaacggtaccgttagggtacggtcgtacgaccctacgtacgtcctttacgttacccttactaccgttaccccg

SEQ ID NO: 226931 - DNA, 528 bp, Homo sapiens
  misc_feature: GYAE6OF02F1UKC.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattacaatggttgcctggttcagcagaaaccagggaaagccccaaaagtcctagatctctgccgcctctactttgcaaagtcgggtcccatcaaggttcacgcgcagtgatcgtgggacagaatcagtctcaccatcagcagcctgcacgctgacgtattttgactaacttactactgaccaagtcgactaataatatctaagtttcgggacgtagggactaagggtcggaagtactacgaaacgtacgtcggacggtccgtgacctaccgtagttccgtacgttcttctattccccg

SEQ ID NO: 226932 - DNA, 604 bp, Homo sapiens
  misc_feature: GYAE6OF02I5GMF.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggcctggtttcagcagaaaccagggaaagccccaaaagtcctgatctctgccgcctctactttgcaaagtgggtcccatcaaggttcagcggcagtggatcgtgggacagaattcagtctcaccatcagcagcctgcagcctgacgtatttgactaactttactactcgaccctaagtcgactaattaaactaagttacctaagttttaccggggacggggtaaacgggggtaacccgtaaaaggggttcgggaaggtacttaaccgaaaacggtaaacgttacgggtacgggtaccgttacggtaccgtaacccgtaacgtttaccgttacggtttccgtttaccgtactttcccccg

SEQ ID NO: 226933 - DNA, 557 bp, Homo sapiens
  misc_feature: GYAE6OF02HV8UC.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgaccccaaaagtcctagatctctgccgcctctacttgacaagtggggtcccatcaaggttcagcggcgagtggatcgtggacagaattcagtctcaccatcagcagcctgcagcctgactattttgactaactttacctactcgacctaagtcgactaattaaataataccgtaagttttccggggacgggtaacggggtaccaaaggggtggaagtataccgaaacggtaacttaggtacggacgtgacacctattccgttgtacctttacacttaccccg

SEQ ID NO: 226934 - DNA, 540 bp, Homo sapiens
  misc_feature: GYAE6OF02HQ85H.15.28.C06.1.454.CMB.1.raw
  modified_base (533)..(533): a, c, t, g, unknown or other
  misc_feature (533)..(533): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgaccgggccagtcagagtattaactaaatggttgctgttcagcacgaacgaggaaacgacccaaaagtcctagatctctcgaccgcctcttacttgactaagtcggggtacccagtacgtaaggttacacggcgacagtgatcgtagggacagtaatcgacgtctcacatacagtcacgcctgcagtctgtacgtatttcgacttaacttactactcgactatgactaagtaactatactagttcggacggtacggaacgaggtaggagagtacgtaaacgctaggtggtactcgcaccgtactcgttacgtcttacncttaccg

SEQ ID NO: 226935 - DNA, 522 bp, Homo sapiens
  misc_feature: GYAE6OF02IK073.15.28.C06.1.454.CMB.1.raw
  modified_base (336)..(336): a, c, t, g, unknown or other
  misc_feature (336)..(336): n is a, c, g, or t
  modified_base (412)..(412): a, c, t, g, unknown or other
  misc_feature (412)..(412): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaccagggaagacccaaaagtcctgatctctgccgcctctactttgcaaggtcgggtcccatcaagttcagcgnagtggatctgggacagattcagtctacacatcagcagcctgcagctgacgtatttgactacttactactgccagtnacataatatctattcggacggaggaccaagggtacgaagtatacgaaacggacttaggtagggtacctagacctaccgattaccgttagttccgtttacaccgtttcccg

SEQ ID NO: 226936 - DNA, 650 bp, Homo sapiens
  misc_feature: GYAE6OF02JLBMI.15.28.C06.1.454.CMB.1.raw
  modified_base (386)..(386): a, c, t, g, unknown or other
  misc_feature (386)..(386): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcacatcacttgccgggccagtcagatattactaaatggtgctgttcagcagaacaggaaacgaccccaaagtcctagatctctgccgtcctctacttgacaaacgtcgggtccatcgaaggttcagcgcagtgatcgtggacagtaattcgagtctacgacctactcgagaccacgttacccngcctaacgtcccgtagtaaccgttagtttttccgacttaaaccgtttacttaccgtacggtaaccctaaggtccgtaacttaagttaaaacttaacgtttacctaaacggttttccggggaaccggggtaaacgggttaaccccgtaaaggggttacgggaaaccgtacgttaaaccggaaaaccggtaacgttaggtccgggtacttacggtaacccaccgtttactacccgttacggtttacccttacgtacccgtttcccc

SEQ ID NO: 226937 - DNA, 586 bp, Homo sapiens
  misc_feature: GYAE6OF02H4U5F.15.28.C06.1.454.CMB.1.raw
  modified_base (298)..(298): a, c, t, g, unknown or other
  misc_feature (298)..(298): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccncctctactttgcaaagtggggtcccatcaaggttcagcgcagtggatcgtaggacagaattcagtctcaccatcagcagtcctgcagcctgtacgtattttgacttaactttactactcgtactaagtcgactaagttaaacttaatcttaacgtttacgggacgggtaaggggtacccgtaaagggttagggaacgtaacgtaaccgtaaacggaacgttaggttacgggaccttacggacctaaccgtacgttaccgttacggtttacctttacgaatttcccccg

SEQ ID NO: 226938 - DNA, 546 bp, Homo sapiens
  misc_feature: GYAE6OF02ISTXB.15.28.C06.1.454.CMB.1.raw
  modified_base (197)..(197): a, c, t, g, unknown or other
  misc_feature (197)..(197): n is a, c, g, or t
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagataatactaaatggttgccttggtttcagcaagaaaaccgagggaaacgaccccaaaagtcctagaactctctcgccgcctctacgttgactaaaggtcgggtccatcgaaggttcaggcggngagtggatcgtggacagtaatcagttcncaccatcagcagcctagcacgctagacgtatttcgacttaacttatacgtacgacctaagtgataataatactactattcgggcggaacgggacgaagggtgaagtactacgaaacggaacttggacggtcagacactacttccgtgttaccttctaccttacccg

SEQ ID NO: 226939 - DNA, 542 bp, Homo sapiens
  misc_feature: GYAE6OF02G89TZ.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagtagtattactaaagtggttggcctggtttcagcagaaaccagggaaacgccccaaaagtccctagatctctcgccgcctctactttgactaaagtcggggtacccatctaacggttcacgcggcagtggatctgggacagaattcagtctcaccatcagcacgcctgcagcctgacgtattttgactaacttctactgaccagtcgacaataactactctaacgtttcgggacggaacgggaccgaagggtcggagacgtacaaacggtaacgtaggttcggactcgaccactactcgttcgtcttcacttcccg

SEQ ID NO: 226940 - DNA, 546 bp, Homo sapiens
  misc_feature: GYAE6OF02FPPWA.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgctgggccagtcagagtattactaaatggttggctggttcagcagaaacagggaaacaccccaaaagtcctagactctctcgccgcctctactttgactaaaggtcgggtccatacgaaggttcagcggcagtggatcgtaggacagtaattcagtctacacatacacgcagcctgcacgctgacgtattttacgactaacttactactacgacctaagtcgactaataataactactacgtttacgggacggtaacggaaccgtagggtaggagtaacgtacgaaaacgtacgtagtcggtactgaccactacttcgtcgttctactaccg

SEQ ID NO: 226941 - DNA, 698 bp, Homo sapiens
  misc_feature: GYAE6OF02JIB71.15.28.C06.1.454.CMB.1.raw
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (552)..(552): a, c, t, g, unknown or other
  misc_feature (552)..(552): n is a, c, g, or t
tcagtctacgtagccacgaccggtgctcgatttagagctcacgtattgggtttgggggaggtcgagactcagtcaggacacagcatggacatgagggtccccgctcagctcctggggctcctgctgctctggctcccaggtgccaaatgtgacatccagatgacccagtcctccgtccaccctgtctgcatctgtcggagacaggacgtcaccgtatccacttgcccgggccagtcagagtattacaaatggttaggccttggttcagcagaaaccgagggaaacncccgaaaagtcctacgatacttcaggtaccnccttactacgtttacgacaaaacgggttcggggtacccagttaccgtaacgggttacacggtaccggtcaacggttagggaacttcggtaggggtaaccggtaaagtttcaacgggttcctaccaccctaagtaccgtaaggcctaagtcccgttagaccgacgtaccgtcgtaacgttacgttttcgaaccttaaacgtttacctacgtcgacccttaagtcgactagttaaanacttacgtacgtttcgggacggtaaggacgtaaggtaacggagtaaacgtccgtaaaacggtgttacgggttactacgggtagtaacccgtaacgacgttttaccgtacggtttaacctttacctaccgttacccctttccccggg

SEQ ID NO: 226942 - DNA, 641 bp, Homo sapiens
  misc_feature: GYAE6OF02H2EZ8.15.28.C06.1.454.CMB.1.raw
  modified_base (304)..(304): a, c, t, g, unknown or other
  misc_feature (304)..(304): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagatcaccatccacttgccgggccagtcagatatactaaagtggttggcctggtttcagcagaaaaccagggaaacgaccccaaaagtcctagactctctgcccncctctacttgacgaagtcggggtccatacaggttcagcggcaggtggatcggtaggacagtacttcacgtctacaccacttcagcacgtccctgaccagccgtagaccgttattttcgaaccgttaaacctttactacgttacgacccgtaaaggtcgtaactaattaaacttaacttacttaacggttttccgggaacggggttaacggggaaacccgtaaaggggtacgggtaataaccggttacgaaaaccggtaacggttacggtaacgggtccgttacggacccaaccgttactcccgtttacggttacccttttccgtactttacccccgg

SEQ ID NO: 226943 - DNA, 536 bp, Homo sapiens
  misc_feature: GYAE6OF02HQTBB.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggccttggtttcagcagaaaaccagggaaaactccccaaaagtcctgactctctcgccgcctctactttgcaaagtgggtcccatcaaggttcagcgcagtgatcgtggacagaatcagtctcacatcagcacgcctgcacgcctgacgttattttgacttaaacttactactgacctagtacactaataaattaactctaacgtttcgggacgggtaacgggaccgaagggtgagagtaccgaaacgtaactggtcgcgtagctaactatcctgttcttactattacccg

SEQ ID NO: 226944 - DNA, 698 bp, Homo sapiens
  misc_feature: GYAE6OF02G9DK0.15.28.C06.1.454.CMB.1.raw
tcagtctacgtagccacgaccggtgctcgatttagagctcacgtattgggtttggggagtcagactcagtcaggacacagcatggacatgagggtccccgctcagctcctgggctcctgctgctctggctcccaggtcgaccaaatgtgacatccagatgacccagtcctccgtccacctgtctgcatctgtacggagacagagtccaccatccacttcggccggtccagtcagtagtattaactaaagtggttggcttggttcagcaagaaaccgaagggaaacgacccgaaaagtcctagactctcgtcgccgtcctcttacgttgactaaaggtcgggtacctagtacgtaaggttcgacggcggacgtagtggtacttcgtagggaactaaggtaacttacgtacgtacctaccgaaccgtactaccgacgactacgtccgtagaccgtacgtaccgtaggtaacgttacgttttacgaaccttaaaccgtttaaccgtacgtaccgtaccgtaaaggtccgtaactaaacgttaaattaaccgtaccgttacgggtttaacgggacgggaaaccggttaacggaaaggggttgggaaccgtaacgtaaccggtaaaaccggtaacgtacggtacgggtccttaaccggaacctaccttaagtcccgttaggttcctttaccgacctttacccg

SEQ ID NO: 226945 - DNA, 600 bp, Homo sapiens
  misc_feature: GYAE6OF02FHT7H.15.28.C06.1.454.CMB.1.raw
  modified_base (394)..(394): a, c, t, g, unknown or other
  misc_feature (394)..(394): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcagaaccagggaaacacccaaaagtcctgatctctcgccgccttctactttgacgaaaggtcgggtacccatcgtaagttcgagcggacagtggagtcgtagggacgtaattcgagtctcacctatcagcagcctgcngcctagtacgttagtttcgactaacttactactacgacctaagtcactaaattaacgttaactactacgttaccgggacgggaacgggtaaccgtaagggtggaaacgtactaaccgaaacgtaacggttcggtacggtactaccgggactaacccgttacttaccgttacggttacctttaccgtacgtttcccgtttacccccg

SEQ ID NO: 226946 - DNA, 527 bp, Homo sapiens
  misc_feature: GYAE6OF02GM5JO.15.28.C06.1.454.CMB.1.raw
  modified_base (402)..(402): a, c, t, g, unknown or other
  misc_feature (402)..(402): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggccttggttcagcagaaacagggaaagaccccaaaagtcctagatctctgccgcctctactttagcaaaggtcggggtacccatacgaaggttcagcggcagtgatcgtgggacagaattcagtctcacatcagcagcctgacagcctagacgtntttacgactaacttactactgacaagtgacaataaatatctaagttcgggacggaacggaccgaagggtgagtagtacaaacgtacgtaggtcggactgaccactntctagtcttacngttcccg

SEQ ID NO: 226947 - DNA, 459 bp, Homo sapiens
  misc_feature: GYAE6OF02JC8XI.15.28.C06.1.454.CMB.1.raw
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (449)..(459): a, c, t, g, unknown or other
  misc_feature (449)..(459): n is a, c, g, or t
tcagtctacgtagccacgaccggtgctcgatttagagctcacgtattgggtttggggggaagaggaagactgacggtcctgccacaggtggtgctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggcnccctgctccgaggacgccaccnccgagagcacgagcggcccgtggggcctggccctgggtcaaggtacctacttcccgctacgtagactgagcgggctggcaaggcgacatagnnnnnnnnnnn

SEQ ID NO: 226948 - DNA, 546 bp, Homo sapiens
  misc_feature: GYAE6OF02IX8AL.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctgttcagcagaaacaggaagcccaaaagtctgatctctgccgcctctacttgacaaaggtgggtaccatcgaaggttcagcggcagtgatcgtggacagaattcagtctacaccatcagcagcctgcagtcctagacgtattttgactaactttactactcgaccaagtcgacataaataactctaacgtttcggacgggtaagggaaccgaagggtaggaagacgtaacgaaaacggtaacgttggtacgggtacttacgacgaaccctagtccttacgttccttactactttccccg

SEQ ID NO: 226949 - DNA, 561 bp, Homo sapiens
  misc_feature: GYAE6OF02GW771.15.28.C06.1.454.CMB.1.raw
  modified_base (375)..(375): a, c, t, g, unknown or other
  misc_feature (375)..(375): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgcccgggccagtcagagtattactaaatggttgcctggttcagcaagaaaccagggaaacaccccaaaagtcctagatctctgccgcctctactttgactaaagtcgggtcccatacgaaggttcagcggcaggtggatcgtggacaggtaattcagtcncaccatcagcacgcctgcacgctgactattttcgacttaacttactactgacctaagtcgaacaattaaactaatacgtaagtttccgggacggtaacggaaccgaagggtaggaagtaccgtaacgaaacggtaacgtggttacggactacgactaccctattccgtgttaccttctacttcccg

SEQ ID NO: 226950 - DNA, 617 bp, Homo sapiens
  misc_feature: GYAE6OF02GXGGZ.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgacccaaaagtcctagatctctgccgcctctactttgactaaaggtcggggtacccagtacgtaaaggttcaaggccggacgaaggtgggactcgtagggaacggtaattcgagttcctaccgacctatacagcacgtcctgccacgcctagactatttacgactaaacttactactcgtaccgaagtcactaattaactaacttctaagtttaccgggacgggtaacggtaaccgtaaaggtaggtaacgtaacgtacgtaaaaccggtacgtacggttaggaccgttacgaccgtaaccgtacttccgttagttccttacgttaccgttcccttaccccgg

SEQ ID NO: 226951 - DNA, 615 bp, Homo sapiens
  misc_feature: GYAE6OF02IIUG1.15.28.C06.1.454.CMB.1.raw
  modified_base (165)..(165): a, c, t, g, unknown or other
  misc_feature (165)..(165): n is a, c, g, or t
  modified_base (289)..(289): a, c, t, g, unknown or other
  misc_feature (289)..(289): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccngtcctccgtccaccctgtctgcatctgtcggagacagactcaccatcactgccggcagtcagatatactaatggtggctggttcagcaagaaacgaaggaaacgacccaaaagtccagatctcncgccacctctactttgacgtaaagtcgggtacccagtacgaacggttacgagaccggctaacggtggaacttggtacgggaactaaggtaacttcgtaacgttcctaccgaacctatacgaagccgaacggcttcgacgtaacggtcctaggtacgtagttttcgaaccttaaactttacgtaacttacgaccgtaagtcgtactaaaagtaacttaatacggtacgtttcgggaacgggtaacgggaaacctaaggggtagaagtaacgtaacgaaacggaacttaggcggactacgctaacgtatcgtgtacctctagttcccc

SEQ ID NO: 226952 - DNA, 492 bp, Homo sapiens
  misc_feature: GYAE6OF02HAX5D.15.28.C06.1.454.CMB.1.raw
  modified_base (486)..(486): a, c, t, g, unknown or other
  misc_feature (486)..(486): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgctaacttactattgccaagtgacataatatctatttcggcgaaggaccaaggtgagatacaacgaatgtggctgcacatctgtcttcnttcccg

SEQ ID NO: 226953 - DNA, 626 bp, Homo sapiens
  misc_feature: GYAE6OF02G84EP.15.28.C06.1.454.CMB.1.raw
  modified_base (249)..(249): a, c, t, g, unknown or other
  misc_feature (249)..(249): n is a, c, g, or t
tcagtctacgtagccacgaccggtgctcgatttagagctcacgtattggggtttggggagtcagactcagtcaggacacagcatggacatgagggtccccgctcagctcctgggctcctgctgctctggctcccaggtgccaaatgtgacatccagatgacccagtctccgtccaccctgtctgcatctgtcgagacagagtcaccatcacttgccggcagtcagagtatactaatggtgctgttcagnagaacgaggaacaccaaaagtcctagatctctcgccgcctcttacgtttcgacgtaaaggtcggggtaccctagtaccgtaaggttcgacggcggacaggtggactcgtagggacacggtaatcgagtctacacatcagcagtcctgacgtacgccgtagacgttatttacgaacttaaacctttacgtacctggaacctaaggtacgaactaaattaaacttaaagttccttaacggtttacggggacgggtaaacgggtaaccgtaaacggggttagaaacgtacgtaaccggaaaaccgttaacggtggtaacggtaccgtaacggtacctaaccgtacgttccgttacgtttacttacccgtactttaccccg

SEQ ID NO: 226954 - DNA, 576 bp, Homo sapiens
  misc_feature: GYAE6OF02GZPFC.15.28.C06.1.454.CMB.1.raw
  modified_base (275)..(275): a, c, t, g, unknown or other
  misc_feature (275)..(275): n is a, c, g, or t
  modified_base (341)..(341): a, c, t, g, unknown or other
  misc_feature (341)..(341): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaanccccaaaagtcctgatctctgccgcctctactttgcaaagtcggggtcccatcaaggttcagcggnagtggactcgtgggacagtaacttcagtctacaccatcagcagcctgcagccgtgtaccgtattttgactaacttacctacttcgacctaggtcactaattaaattatccgttaagtttccgggacggggtaacggaacccgtaaaggggtcggaaggtacgtaaccgaaaacgtaacggtaggtacggtactaggaccctaccagttccgttgttaccttactactttcccccg

SEQ ID NO: 226955 - DNA, 565 bp, Homo sapiens
  misc_feature: GYAE6OF02FJ0OQ.15.28.C06.1.454.CMB.1.raw
  modified_base (332)..(332): a, c, t, g, unknown or other
  misc_feature (332)..(332): n is a, c, g, or t
  modified_base (377)..(377): a, c, t, g, unknown or other
  misc_feature (377)..(377): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaaccagggaaacgaccccaaaagtcctagatctctcgccgcctctactttgcaagtgggtccatcagtcngcggcagtgatcgtgggacagaattcagtcactaccatcagacanccgtgcagcctgacgtatttgactaacttactactcgacctaaggtgactaataacttaataccgtagtttacgggacggtaaggggtaccaaaggggtggacgtaagtaccaaacggttaacgtaggttacggtccgtacgtacccgaccgtacttaccggttcgttaccttacctagtttaccccg

SEQ ID NO: 226956 - DNA, 808 bp, Homo sapiens
  misc_feature: GYAE6OF02JYRAP.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctgggctcctgctgctctggctccaggtgccaaatgtgacatccagatgacccagtctccgtccaccctgtctgcatctgtcggagacagagtcaccatcacttgaccggccagtcagagtatactaaagtggttaggccttggttcacgcaacgaaaccgaagggaaaccgacccgaaaagtccctagactcctacgtcgaccgtcccgttacttaccgtttcggaaccgtaaaacgggttccggggtacccctaagttaaccggtaaacgggtttccgacggtaccggtaccggtaaggttcggtaacgttccgggttaaggggaaccttaaggtaaacttttaccggaacgtttacccgttaaccgaaccgtaaacgtccgaaacgggcctaaaccgtcccgttaggaaccctacggtccgttaacggttaacccggtttaagtttttcccggaaaccttaaacgttttaactaacccggttacgttaacccgaaaaggtttcctaaaccgttaaattaaaccgtttaaagtttaccggttaacgttttacgggggaaccggttaaacgggtaaccgtaaaggggtttacgaagttaccgtaaacgtaaaaccggtcggttaacgttcgggaaccttaccgggaaccttaactccgttacggtttacttacccgttttaccgacttttacccccgg

SEQ ID NO: 226957 - DNA, 538 bp, Homo sapiens
  misc_feature: GYAE6OF02FZFYP.15.28.C06.1.454.CMB.1.raw
  modified_base (479)..(479): a, c, t, g, unknown or other
  misc_feature (479)..(479): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggttgcctggttcagcagaaaccagggaaacgaccccaaaagtcctagactctctgccgcttctactttgactaaagtcgggtcccatcaaggttcagcggacagtggatcgtggacagaacttcgagtcacaccatcgacgcacgcctgacacgtccgtagaccgttagtttcgacttaaacttactactcgactagtcgactaagtaatatctagttcggagtaaggacgaaggtgganactacgaaacgagtggtacggacgtacgacacctattcgtacgttcttactattccccg

SEQ ID NO: 226958 - DNA, 596 bp, Homo sapiens
  misc_feature: GYAE6OF02JUVUV.15.28.C06.1.454.CMB.1.raw
  modified_base (386)..(386): a, c, t, g, unknown or other
  misc_feature (386)..(386): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattacaatggtgcctggttcagcagaaaccagggaaacgcccaaaagtcctgatctctcgccgccttctactttgactaaaggtcgggtcccatcaaggttcagcgcagtgatcgtaggacagaatcgaagtctacacatcagcagcctgcacgcngtacgtatttcgacttaacttactacttcgacctaagtcgtaactaagttaaacttacgttaccgtaacggttttacccggggacgggtaaaccgggtaaccgtaagggtacgggtaacgtacgtaacgtaaaccggtaacgttcgggtaacggtcgtacggaccgtaacccgttagtccgtttaacggtccttacgttacttcccccgg

SEQ ID NO: 226959 - DNA, 638 bp, Homo sapiens
  misc_feature: GYAE6OF02GSZIN.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggcccgggcagtcagtagtattaactaaatggttggccttggtttcagcaagaaaccgagggaaacgaccccaaaagtcctgacttctctcgcccgccttcgtactttgacgtaaaggtcgggtacccatcgaaggttcaggcgcaggtgatcgtggacagtaattcgagtctacacctactcacgcacgtcctgacacgtccgtagtacggttacttttacgaccttaaaccgtttaccttaccgtcgtaaacccgtaggttacgacctaaattaacttaacttacgttacgtttaccggggacggttaacgggaaccgtaaagggtcggaacgtactaacggtaaaccggtacgttacgggtacgtaccgttacgaccgtacctacgttaccgttacgttccgtttacacgtttaccccg

SEQ ID NO: 226960 - DNA, 695 bp, Homo sapiens
  misc_feature: GYAE6OF02GYO25.15.28.C06.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagagtcacntcacttgccgggcagtcagagtattactaaatggttgccgtggttcagcagaacgaggaaacgacccaaaagtcctagactctctcgccgtcctctactttcgacgtaaaggtcggggtaccctagtacgtaacggttcgacggcggacgtaggtggtacgtcgtagggaactaaggtaacttactacgttcctaccacctacgtacaagacgacgtcgtcgactacgacccgtagtacgttacgttttcggaccttaaacgtttaccttacgtaccgtaccgtaaacgtacgtacttaaagttaaacttaaacgttacgttaacggtttaccggggaacggggttaaacggggaaccgtaaaggggtagggaacggttaagttaaccggaaaacggtaaccggttagggtaccgggtaacgtaccggaaccttaacccgtagttacccgtttaccgttacgtttacccgtacgttttacccccgg

SEQ ID NO: 226961 - DNA, 578 bp, Homo sapiens
  misc_feature: GYAE6OF02FE0JC.15.28.C06.1.454.CMB.1.raw
  modified_base (292)..(292): a, c, t, g, unknown or other
  misc_feature (292)..(292): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagagtcaccatcacgttgccggcagtcagagtattactaatggtgctgttcagcagaaccgaggaacacccaaagtcctgatctctcgccncctctactttgacgaagtcgggtccatcgtaagttcacgcgacgagtggatcgaggacagactcgagtcacgacatccgagtcacgcctgaccacgcctgtacgtatttcgacttaacttacctacttcgactaacgtcgactaaactattaaccgtactttacggttacccggtacggggaacgtaaacccgagggttacggaagtaacgtaaccgaaacggtaacgtggtacggtacgtcgtaccgtaccacgttcgttacggtccttactaccgtttaccccg

SEQ ID NO: 226962 - DNA, 708 bp, Homo sapiens
  misc_feature: GYAE6OF02GG59C.15.28.C06.1.454.CMB.1.raw
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
tcagtctacgtagccacgaccggtgctcgatttagagctcacgtattgggtttgggggagtcagactcagtcaggacacagcatggacatgagggtccccgttcagctcctggggctcctgctgctctggctcccaggtgccaaatgtgacatccagatgacccagtcctccgtccaccctgtctgcatctgtcggagacagatcacatcacttgccggcagtcagatattactaaagtgtggctggttcagacaagaaaccgaggaaacgaccccaaaagtcctagactctcncgcctcctcttacttcgacaaggtcgggtaccatacaacggttnacgcgcgaggtcgatcgtaggacatacttcgatcgtacaccatcgaacgcgaacgtccgtcgaccgtacgacccgtacggtaaacgtttacgtttccggtaaaccttaaacctttaaccgttaacccttacgggtaaccctaaagggtcctaaacgtaaactttaaaacgttaaccgttaaccgtttaagttttaacccgggggaaccggggttaaacggggtaaaaccgtaacgggggtttaacggaaaccggttaacgttaaaccgaaaacgggttaaccgtaaggttacggggtaccttaccggaacctaaccgtaccgttaccgttaccgtttacctttacgtaacccttcccgtttaacccccgg

SEQ ID NO: 226963 - DNA, 542 bp, Homo sapiens
  misc_feature: GYAE6OF02IC30Y.15.28.C06.1.454.CMB.1.raw
  modified_base (275)..(275): a, c, t, g, unknown or other
  misc_feature (275)..(275): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaanccccaaaagtcctgactctctgccgcctctactttgcaaagtcgggtcccatcaaggttcagcggcaggtggatcgtgggacgaattcgagtctcacatcagcagcctgcagcctgacgtattttcgctaactttactactcgacctaagtcgactaataataactctaagtttccggacgggtacggaaccgaagggtaggaagatacgaaacgtacgtggtacggctgaccacctatccttgttaccttctaccttcttaccccg

SEQ ID NO: 226964 - DNA, 513 bp, Homo sapiens
  misc_feature: GYAE6OF02HD6G2.15.28.C06.1.454.CMB.1.raw
  modified_base (502)..(502): a, c, t, g, unknown or other
  misc_feature (502)..(502): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgccccaaaagtcctagatctctcgccgcctctactttgacaaagtcggggtcccatcaaggttcagcggcagtggatcgtggacagaattcagtcacaccatcagcagcctgcagcctgactattttcgactaaacttactactgaccaagtcgacaataataatactagtttcggacggtaggaccaagggtagacgatacgaacgagtgtgctagcacactcgtntcttcatcccg

SEQ ID NO: 226965 - DNA, 579 bp, Homo sapiens
  misc_feature: GYAE6OF02JJBHZ.15.28.C06.1.454.CMB.1.raw
  modified_base (176)..(176): a, c, t, g, unknown or other
  misc_feature (176)..(176): n is a, c, g, or t
  modified_base (400)..(400): a, c, t, g, unknown or other
  misc_feature (400)..(400): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (575)..(579): a, c, t, g, unknown or other
  misc_feature (575)..(579): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccacataacaaaaagntggaagtgacacaacctatgtgaactctgtgatgggccgattcaccgtctccagagacgacgccaagaactcaactacatctgacaaaatgaacaacctgagagccgaggacacggctgtgtattactgtgtgagagattgttctgcggttggggccagggaaccctggtcaccgttctcctcgagccctccaccgaacgggcccattcggtcccttcccccgnggcccgccctgcctccgaggcgccaccgtccgagacgcacgaggcccggcccgtgggcctcggcccttgggtaccaaacgggaccttacgttcccgaccgttaaccgtacgtacgtcggacggcggggtctcgggaccaacgggccgactaaggtacgcagtnacgngctgacgnnnnn

SEQ ID NO: 226966 - DNA, 168 bp, Homo sapiens
  misc_feature: GYAE6OF02IUGDH.15.28.C06.1.454.CMB.1.raw
  modified_base (101)..(101): a, c, t, g, unknown or other
  misc_feature (101)..(101): n is a, c, g, or t
  modified_base (126)..(126): a, c, t, g, unknown or other
  misc_feature (126)..(126): n is a, c, g, or t
  modified_base (139)..(139): a, c, t, g, unknown or other
  misc_feature (139)..(139): n is a, c, g, or t
  modified_base (150)..(150): a, c, t, g, unknown or other
  misc_feature (150)..(150): n is a, c, g, or t
  modified_base (155)..(168): a, c, t, g, unknown or other
  misc_feature (155)..(168): n is a, c, g, or t
tcagtctacgtagccacgaccggtgctcgatttagagctcacgtattgggtttggggagtcagactcagtcaggacacagcatggacatgagggtccccgntcagctcctggggctcctgctgctntggctcccaggtnacctaaatgcncactnnnnnnnnnnnnnn

SEQ ID NO: 226967 - DNA, 541 bp, Homo sapiens
  misc_feature: GYAE6OF02GWLID.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcagcggcagtggatcgtgggacagaattcagtctcaccatcagcagcctgcacgcctgacgtattttcgacctaacttacttactcgtacctaagtcgctaataaacttatcgtagtttcgggacgggtaagggaccaagggtaggaagacgtacaaacggtaactggtacggctacgacctacgtacgtctacgtcttacacttcccg

SEQ ID NO: 226968 - DNA, 792 bp, Homo sapiens
  misc_feature: GYAE6OF02IFEWD.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatctgtcggagacagagtcaccatcacttcgccgggccagtcagagtattacgtaagtggttgccgttgttcagcaagaaaccgaggaaacgacccaaaagtcctagactctcgtcgccgtaccttcttaccgtttgaccgtaaagggttcggggtacccctagttaccgtaacggtttccacggtcggtacgaggttaggtacgttccggtaggggaaccaaaggtaaacttcgtaacggttcctaaccgtaacccgtaacgttaccgaacggaccgtaaccggcccgttacggaccgtaacgtcccgttacggtaaaccggtttacgtttttacggaaccctttaaaccgtttaccgttaacccgtacgtaaccccgtaaaggttaccgtaaaccttaacttaaaacgttaacgtttaaccgttaaccgggtttttaccggggaaccggggtaaaccgggtaaccggttaaaggggtcgggtaaacggtacgttaaaccgtaaaacccgggtacgttaacgggtaccgggtaccgttaccgacccgttaaccgttacgtttaccggtttaccgttaccgttttaccctaccgtttacccccgg

SEQ ID NO: 226969 - DNA, 709 bp, Homo sapiens
  misc_feature: GYAE6OF02FK0B0.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagacgtcaccatcacgttcggccgggccagtcagtagtattaactaagtggttggccttggttcagcaagaaccgaggaaacacccaaaagtccagatctctcgccgtcctctactttgacgaaagtcgggtccagtcgaaggttcaggcggctaggtggatcgtggacagtattcgagtcttaccacctatacgacgtcgaacgtccgcgaccgacgtaccgttaggtaaccgtttacgttttacgaaccttaaacctttaaccgttaaccgtaccggaacccttaaaggtaccgtaacttaaacgtaaactttaacgtaaccgtttaacgggtttcccggggaacggggtaaccgggtaacccggtaaaggggtaacggtaacggtaacgtaaaccggtaaaacggtaaccggttacggttaaccgggtaccgttacggaaccccgtaacgttaaccgtttaccgtttaccggttaccgttttacccttacccggtttaccccccg

SEQ ID NO: 226970 - DNA, 558 bp, Homo sapiens
  misc_feature: GYAE6OF02HKTWG.15.28.C06.1.454.CMB.1.raw
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggtttcagcagaaaccagggaaacaccccgaaaagtcctagatcctctcgccgtcctctactttagacaaaggtcgggtccatcgaaggttcaggcggnaggtggatcgnggacagtaattcagtctcacatcagcacgcctgcacgtccgtacgtacgttatttcgaccttaaactttactacctgacctaagtcactaattaatatctagttcgggacgggtaaggaccgtaagggtgagtactacggaaacgtacgtggtaccggtgtcgaccgactacgtcgttacgttcctacgtcttccccg

SEQ ID NO: 226971 - DNA, 601 bp, Homo sapiens
  misc_feature: GYAE6OF02FYOF6.15.28.C06.1.454.CMB.1.raw
  modified_base (579)..(579): a, c, t, g, unknown or other
  misc_feature (579)..(579): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggccagtcagagtattactaatggttgcctggtttcagtcaagaaaccgagggaaacacccgaaaagtcctagatctctcgccgtcctctaccttgactaaaggtcgggtacccagtactaacggttcacggcggcctaggtcggactacgtagggaacaggtaacttcgacgtcctacgaccatcaagcacgtcctgcacgtccgtacgtacgttatttcgtacctaacgttactaactcgtacaagtcgtactaaagtaattaacgtcgttacgttacgggaggtaacggacgtaagggtaggacgtaataaccggaaacggtacgttggtacggtctacgcctaacgcgttccgtntttaccttcctacgttaccccg

SEQ ID NO: 226972 - DNA, 501 bp, Homo sapiens
  misc_feature: GYAE6OF02HAQP8.15.28.C06.1.454.CMB.1.raw
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
  modified_base (491)..(501): a, c, t, g, unknown or other
  misc_feature (491)..(501): n is a, c, g, or t
tcagtctacgtagccacgaccggtgctcgatttagagctcacgtattgggtttggggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaaatgaacaacctgagagccgaggacacggctgtgtattactgtgtgagagatgttctgcgttggggccagggaaccctggtcaccgtctcctcagcctcaccaagggcccatcggtctcccctgcgccctgctccaggagcacctccgagagcacagccggccctgggctgcctggtcaaggactactccgctacgtagactgagcgggcnggcaaggcgcagtagcngnnnnnnnnnnn

SEQ ID NO: 226973 - DNA, 640 bp, Homo sapiens
  misc_feature: GYAE6OF02I9D0C.15.28.C06.1.454.CMB.1.raw
  modified_base (197)..(197): a, c, t, g, unknown or other
  misc_feature (197)..(197): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttcgccgggcagtcagagtattactaatggttgcctggttcagcagaaccgagggaaacacccaaaagtcctagactctctcgccgcctctactttgactaaggtcgggtaccatcgtaaggtcagcggcgaggttggatcgtggacaagtaattacgacgtcctacaccatacagaccacgctacgcacggtcctacgacgttacttttacgaccttaacttactacgtcgaaccgtagtcgaactaattaaataacttaccgttaacggtttccggggaacgggttaacggggaacgttaaacggggtacggtaaacgtacgttaaccgaaaaacgggttaccgttaaggttaccgggtacttacggtaaccccgtaacgttacgttaccgttaggtttacctttaccgtaccttttacccccgg

SEQ ID NO: 226974 - DNA, 620 bp, Homo sapiens
  misc_feature: GYAE6OF02JCPMD.15.28.C06.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
tcagtctacgtagccacgaccggtgctcgatttagagctcacgtattgggtttgggggaggtcagactcagtcaggacacagcatggacatgagggtccccgctcagctcctgggctcctgctgctctggctcccaggtgccaaatgtcgacatccagatcgacccagtctccgtccaccctgtctgcatctgtcggagacagacgtcaccagtcacgttcggccggtaccagtcagagtattactaaagtggttcgccttggttcagacgaacgaacgaggaaacacccaagtcctagntctctcgccncctnttcttcgctaagggtccggtaccattaccgtaagtcgagccgagacgttaggactcggtaggaccagtaacttcacgtccgactaccatacagacctacgtcctacgcgaccgtcgtacgtacgtttacgtttcgaaccttaactttaaccttacgtacgtacccgtaggtactaactaagttaaaacttcgtacgtaacgtttcgggaacgggaacggtaacccggtaggtacggaagtaccgtaagaaccggtaagtcggtagcgtaacgtccacgttcgtacttcgtactaccgtcgttaccc

SEQ ID NO: 226975 - DNA, 588 bp, Homo sapiens
  misc_feature: GYAE6OF02HEK95.15.28.C06.1.454.CMB.1.raw
  modified_base (364)..(364): a, c, t, g, unknown or other
  misc_feature (364)..(364): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattacaaatggttaggctggtttcagcagaaaccaagggaaacgaccccaaaagtcctagatctactgccgcctctactttgacaagtggggtccatctaagttcagcggcagtaggatcgtaggacagtaanctttttttagctacacatcacgacacgcctagcacgctacgacgttatttgaacttaacttactactacgactaagtacgactaataattaatactaagtttaccggtacgggaacgggaaccgtaaagggtaggaacgtaagtaaccgtaaacgtaacgttaggtacgggtacgtacgaccgtaccaacgttccttacggttacctttactactttaccccgg

SEQ ID NO: 226976 - DNA, 922 bp, Homo sapiens
  misc_feature: GYAE6OF02F78T2.15.28.C06.1.454.CMB.1.raw
tcagtctacgtagccacgaccggtgctcgatttagagctcacgtattgggtttgggggagtcagactcagtcaggacacagcatggacatgagggtccccgctcagctccgtggggctcctgctgctcgtggctcccgaggtgccaaatgtgacatccagatcgaccctagtcctcccgtccaccctgtcctgcctatcgtggtcggaagacgagtacgtccaacctatcctacgttcggcccgggacctaggttaccgaaggtaacgtttaaatttaaaccgtaaagtttcggggtttcggtacccgtttgggttttacacggtaccgtaaacggaaaaccccggaaaggggaaaacctaacccccgtaaaaacggttcccgtacgtaaaccgttccgttaccgtccggtccccgttacctttacccgtttaccgttttaacggaacgtaaaaccggggttccggggtaacccctaacgttaacggttaaacggttaccgaacggtcccggacgtacgggtacggtacgttaccgggtaacgggaacgtaacgtaaacggtttaccgtaaccggttacctaaccgtaacccgtaacgtaccgtaacgacccgtaccgtaccggtggaacccgtacggtccgttaaacggtacggtttaactttaccgtaaccgttaaacccttttaaccgtaaccgttaccgtaaaccgtaaggttaccgtacgtttaaaactaaacgtttaccttaccggttaacggtttaccggggaaccggggtaaacgggtaaacccggttaaacggggtaacggtaaccgttaacgtaaccgtaaaaccggttcggttacggtaccggtacgtaaccggtaaccctaccgtaacgtttccgttacggttacccttacggtacccgtttacccccgg

SEQ ID NO: 226977 - DNA, 630 bp, Homo sapiens
  misc_feature: GYAE6OF02IVLU6.15.28.C06.1.454.CMB.1.raw
  modified_base (177)..(177): a, c, t, g, unknown or other
  misc_feature (177)..(177): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(630): a, c, t, g, unknown or other
  misc_feature (629)..(630): n is a, c, g, or t
tcagtctacgtagccacgaccggtgctcgatttagagctcacgtattgggtttgggggggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgagtgggccgattcaccgtctccagagacgacgccaagaactcactacatctgacaaatgaacaacctgagagccgaggacacggctgtgtaacttacgtgtgtgagagtatgttctggtcgggttcggggacccgaacggggtaaccccttgggtacccctaccggttcctcccgttaccacgtccccttaccccgaaccggaacgggtcccctacggttccggttaccccttccccccgtcggggccctccccgtgcccttaccgaggccgacccacccgtaccgagacgaccacgacggcccggtcccgtgggcctcggcccgtggtaccgaagtacccgttaccgttccgacttacgtagaccgtagacgggtcggacgtcgggacgacggcgtacgagnggncntnatgctgngncnn

SEQ ID NO: 226978 - DNA, 666 bp, Homo sapiens
  misc_feature: GYAE6OF02JIQJ1.15.28.C06.1.454.CMB.1.raw
  modified_base (575)..(575): a, c, t, g, unknown or other
  misc_feature (575)..(575): n is a, c, g, or t
tcagtctacgtagccacgaccggtgctcgatttagagctcacgtattgggtttggggagtcagactcagtcaggacacagcatggacatgagggtccccgctcagctcctgggctcctgctgctctggctcccaggtgccaaatgtgacatccagatgacccagtctccgtccaccctgtctgccatctgtcggagacagatcaccatcacgttgccgggccagtcagagttatactaaatggttaggcctggttcagcagaacagggaagacccaaaagtcctagtatactctcgaccgtctcttacgtttgacaaacggtcgggtaccataccgaaggttcacgcggactaggttggacgtcgtagggaccaagtacttacaggtcctacaccattcgaacgtcgtaacgccgttcgacgtacggtcctacggtacgttacgtttttacgaccgttaaactttaaccgttaacgttacgaacccgtaaaggtcgtaaccgtaaatttaacttaaaacgttcgttaaaccggtttaccggggtagggttaaccgggtaaaccggttaaacgggnggtaaaccggtagtaaccgtaaacggtaaccggttaggtcggaacgtccgaccgtaacctacgtcgttcttacccggtcttaacctcccgg

SEQ ID NO: 226979 - DNA, 625 bp, Homo sapiens
  misc_feature: GYAE6OF02H1TES.15.28.C06.1.454.CMB.1.raw
  modified_base (578)..(578): a, c, t, g, unknown or other
  misc_feature (578)..(578): n is a, c, g, or t
tcagtctacgtagccacgaccggtgctcgatttagagctcacgtattgggtttgggggagtcagactcagtcaggacacagcatggacatgagggtccccgctcagctcctgggctcctgctgctctggctcccaggtgccaaatgtgacatccagatgacccagtctccgtccaccctgtctgcatctgtcggagacagagtcaccatcacttgccggccagtcagagtattacaaatggttcgctggttcagcagaaaaccgagggaaaacgaccccgaaaaagtcctagactactctcgccgcctcttactttcgactaaaggtcgggttacccaagttaccgtaaagggttcaaggccggactaacgtggtaatccgtagggacaaaggtacttacagtaccttacacctagtacaagccagacccttggacaacggtcctacggtaaccggtattttcgaacttaaaccttactaactcgtaacctaagcgtaacaaattaaataattactagtttaccgggacgaaccgggtaactaaagggtcgaagacgttaacgaaaccgacgttaggngtcgttacgacctacgaattccgtaggtttcctttacgaccttcccg

SEQ ID NO: 226980 - DNA, 554 bp, Homo sapiens
  misc_feature: GYAE6OF02FQFHD.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatgtgctggttcagcagaacagggaaacacccaaaagtcctagatctctgccgcctctactttgacaaagtcggggtacccatacgaaggttcagcggacagtggatcggtgggaacaagtaacttcgagtctacaccatcagtcagcctgcagtcctgacgtatttcgactaactttactactacgcaagtgactaataaatatctaagtttcgggacgggtaaggaccaagggtagacgtataacgaaacgtaacgttaggtacggtactacgaccaaccgtacgtttacgttgtttaccttactacgttccccg

SEQ ID NO: 226981 - DNA, 592 bp, Homo sapiens
  misc_feature: GYAE6OF02JTSXI.15.28.C06.1.454.CMB.1.raw
  modified_base (152)..(152): a, c, t, g, unknown or other
  misc_feature (152)..(152): n is a, c, g, or t
  modified_base (197)..(197): a, c, t, g, unknown or other
  misc_feature (197)..(197): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (493)..(493): a, c, t, g, unknown or other
  misc_feature (493)..(493): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (586)..(586): a, c, t, g, unknown or other
  misc_feature (586)..(586): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
tcagtctacgtagccacgaccggtgctcgatttagagctcacgtattgggtttggggggggggtcccgtgagactctcctgtgaagcctctggattcaccttgagcacttattggatgacttggtccgccaggctccagggagggctggagnggtgcacatacaaaaggtaggagtgacactactatgacgactcgngtcgacgcggctacttaccgccgtacctccgaagacgaccgactaccgagttaaccgacgacgtacaggtccgagaccaagttcgaacccgttacgacgaggccgaacgacggaccgttacggtattcgttanatcggtagcgtaagtagagttntgtagtcgtcggtacggacgacggtacgtacggtacgtcgtacgacgacgacgtaccgacgacgtaccgacgacgtcgtccgtccgtcgtccgccgacgtaccgtacgacgacgacgacgacgtacgacgacgcgacgacncgtcgtacgacgcgcgacgacacgtacgccgtcgtacgaccgacgacgcgcgacgcgacgnacgngtcgtctagacgtacgcgagcacagtgncgngtn

SEQ ID NO: 226982 - DNA, 587 bp, Homo sapiens
  misc_feature: GYAE6OF02GI79D.15.28.C06.1.454.CMB.1.raw
  modified_base (130)..(130): a, c, t, g, unknown or other
  misc_feature (130)..(130): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (581)..(587): a, c, t, g, unknown or other
  misc_feature (581)..(587): n is a, c, g, or t
tcagtctacgtagccacgaccggtgctcgatttagagctcacgtattgggtttggggggggggggtccctgagactctcctgtgaagcctctggattcaccttgagcacttattggatgacttgggtccnccaggctccgagggaaggggctggagtgggtgccacatacaaaaagtggaagtgacacaacctatgtgaactctgtgatgggccattcaccgtctccagagacgacgccaaagaactcaactacatctagacaaaatgaacaacctgagagccgaggacacggctgtgtattactgtgtgagagatgttctggcggttggggaccagggaaccctggtccaccgtctcctcacgccctccgacgaacgggcccagtccggtccttcccccgtggcccgtccctcgacctccgaggacgccaccgtccgagcgccacgacggcccggcccgtgggcctcgccgttagggtaccaacggtaccttaccgttcccggacgttaacggtacgacgttacgggacggtccggggtacgtcgggacgtaacgggccgacgtagtacggncgnagncnnnnnnn

SEQ ID NO: 226983 - DNA, 707 bp, Homo sapiens
  misc_feature: GYAE6OF02J3FRP.15.28.C06.1.454.CMB.1.raw
  modified_base (145)..(145): a, c, t, g, unknown or other
  misc_feature (145)..(145): n is a, c, g, or t
  modified_base (168)..(168): a, c, t, g, unknown or other
  misc_feature (168)..(168): n is a, c, g, or t
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (349)..(349): a, c, t, g, unknown or other
  misc_feature (349)..(349): n is a, c, g, or t
  modified_base (494)..(494): a, c, t, g, unknown or other
  misc_feature (494)..(494): n is a, c, g, or t
  modified_base (554)..(554): a, c, t, g, unknown or other
  misc_feature (554)..(554): n is a, c, g, or t
tcagtctacgtagccacgaccggtgctcgattagagctcacgtattgggtttgggggagtcagactcagtcaggacacagcatggacatgacgggtccccgctcacgctccgtgggcctcctgctcgtcctctcggcctacccgnggtcgaccaagtggtacactacncacgtatccgtacctgtccctcccgtaccncctgtcctancctctcggtcggacgacgtacagcctacactcgtcttcggcggccgactagtacgagtacgtaactacgtacggttcggtggtcctacggtacgacgaacgaaaccgtaacggaacgaacctacccgtaagtcgactaccncggttccacggtcctacgttaaccctgtaacggaccgtcgggtaccacttcggaacgtcggactcggtactggttaaccgaggtacgtacggtaacggtactaattacgtcccgttacgacaaccgggtactacgcgaacccgtntacccgtcgccgtacgtacctacgggttactttacgtacttacctacctacgttaaccgngttaaccgacgtctacggtaataccggtaattaccgggttaacgtcgggtaaccggtaacgggtaacgagaacgttcgaactacgtaacggtaccgaacgttcgacgtacctccggtactacctggaaccttccgtctaccgtcccgtaaccg

SEQ ID NO: 226984 - DNA, 722 bp, Homo sapiens
  misc_feature: GYAE6OF02GAL8Y.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcactctgtcggagacagactcaccatctacttcggaccgggcagtcgagagttaattacgtaaagttggttcggccgttggtttcacgtacgaacgaaaccgacgggaaacaccctaaagtcccgtagactcgtctcgacccgtccttactaccgtttgacgtaaagggtccgggtaccctaagttaccgtaaacggttccgacggtccggtacgtagggtacggtacttacggtacggggaactaacggtaaacttcgtaaccgttacccgtactaacccgtaagttaccgaacgtacccggacgtccccggtacgtaacccgtacgtacccgtagtaaccggttattttaccgaaccgttaacctttaccgtacgttacgacccgtaagtcgaaccttaataacgttactcgttacgttccggggacgtaacggaaccgtaagggtacgaaggtactaacggtaaacgtaggttcggtacgtaccgtagacccgttacgacgttccgtaaggttcccttacgtacgttaccccg

SEQ ID NO: 226985 - DNA, 567 bp, Homo sapiens
  misc_feature: GYAE6OF02JAAQ4.15.28.C06.1.454.CMB.1.raw
  modified_base (432)..(432): a, c, t, g, unknown or other
  misc_feature (432)..(432): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtaaccatcacttgccgggccagtcagagtattactaaatggttgcctggtttcagcagaaaccagggaaacgccccaaaagtccctagactctctgcccgcctctactttgctaaaggtgggtcccatcaaggtcagcggcagtgatcgtagggacagaattcagtctacaccatcagcagcctgcagcctagacgtatttcgactaaccttactactcgacctaagtnactaattaataactctagtttcgggacgggtacggtaaccgaagggtcggaagtacgtacaaacggtaacgttggtacggtctacggaccaaccgttacttccgttagttacttaccgtacttcccgttaccccg

SEQ ID NO: 226986 - DNA, 515 bp, Homo sapiens
  misc_feature: GYAE6OF02JATQC.15.28.C06.1.454.CMB.1.raw
  modified_base (369)..(369): a, c, t, g, unknown or other
  misc_feature (369)..(369): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttgcctggttcagcagaaacaggaaagaccccaaaagtcctgatctctgccgcctctactttgcaagtggggtccatacaaggttcagcggcagtggatcgtggacagaattcagtctcacatcancagcctgcagcctgacgtatttcgactaacttactactgactagtgacataataatctagttcggacggaggaccaagggtgagtactacgaaacgaagtaggtaggctaggaccacctattccgttgttcttacctacttccccg

SEQ ID NO: 226987 - DNA, 817 bp, Homo sapiens
  misc_feature: GYAE6OF02H6II8.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttggccgggccagtcagtagtattaacgtaaatggttggccttaggtttcacggtacaacgaaaaccgagggaaacgacccctaaaaggttcctagaactctcgtcgacccgtcctacgttacttttcggaactaaagggttccgggggtaccctacgtacgtaagggttaccacggtcggaccgtaggttcgggtaacgttccggttacgggaacgtaaggtaacgtttacgtacgttacctaccaaccgtacgttaccgaaggtacccgacggccgttacgaacgtacgtccgtacggtaccgtttacgtttttacggaaccctttaaaacgttttaccgttaaccgttaccgtaaccgtaaaacggtcgggtaaaccttaactttaaaaacgttaaccgttaacctttaacgggttttacccggggaaccggggttaacggggaaacccggttaaacggggtacggggtaaagtttaaccggtaaacccgtaaaacggttaacggtttaaccgggtagggttaacccgttcggtaaccctaacccgttacggtttacccgttaccggtttttacccttaccggttaacctttccccccgg

SEQ ID NO: 226988 - DNA, 604 bp, Homo sapiens
  misc_feature: GYAE6OF02HJJT9.15.28.C06.1.454.CMB.1.raw
  modified_base (200)..(200): a, c, t, g, unknown or other
  misc_feature (200)..(200): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacngagtcaccatccacttgccgggccagtcagagtattactaaatggttggcctggtttcagcagaaaccaggaaacgacccaaagtcctgatctctgccgcctctactttgcaaagtcgggtccatcaaggttcagcggcagtggactcgtggacagtaacttcgagtctcacctatcacgcacgcctcggacacgcctacggacgtattttcggacttaactttacctacgtcgaccgtaagtcgactaataacttaacgtcttaacggtttcgggacggggtaaccgggtaaccgtaaaggggttagaaccggtataaccggtaaaacggtacgttaggtacggtacttacgggacctacccggacgtttcccgttagttcccgtttacgtaccgttaccccg

SEQ ID NO: 226989 - DNA, 563 bp, Homo sapiens
  misc_feature: GYAE6OF02IN5VG.15.28.C06.1.454.CMB.1.raw
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcttggttcagcaagaaaccgaggaaacacccaaaagtcctgactctctcgccgcctctacttgacaaaggtcgggtccaatcgaaggttcagcggacagtgagtcgaggacagattcagtctacacatcagcacgcngcagctgtacgtnttttacgactaacttactaccttagacctaagtcgaactattaaataactcgtaagtttcgggacgggtaacggaccgtaagggtcggaatacgtaacaaacggtacgtaggtacggacttcggacctaccgtacttccgttacgttaccttacgtacttccccg

SEQ ID NO: 226990 - DNA, 563 bp, Homo sapiens
  misc_feature: GYAE6OF02G6G5W.15.28.C06.1.454.CMB.1.raw
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (559)..(563): a, c, t, g, unknown or other
  misc_feature (559)..(563): n is a, c, g, or t
tcagtctacgtagccacgaccggtgctcgatttagagctcacgtattgggtttggggggggggtcccgtggagactctcctgtgaagcctctggattcaccttgagcacttattggatgacttgggtccgccgaggctccagggaagggggctgggagtgggtggccaccgataacaaaaagataggaagtgacaacaaacctatgtagaactctagtgagttgggacccgtattccaccgtactcccgaagacgacgacgccaaaggaactcaactacatcnganaaatgaaaccaacctgaagacgacgagacacggntgtagtattacgtgagtgagagatgtctgcggttggggcaggggacctgggtccaccgtctcctcagcctccacgacggccctaagtccgtccgtcccctggccgccctgcgtcccngcgcacctccgagcncacgcgccggccgcggctcgcgtcgtacgagacctacgtccgtacctacgtacgacgtgacggcggtcacggcgaacggcgacgagtacgagtcangtancgtgngnnnnn

SEQ ID NO: 226991 - DNA, 525 bp, Homo sapiens
  misc_feature: GYAE6OF02FJ0H0.15.28.C06.1.454.CMB.1.raw
  modified_base (338)..(338): a, c, t, g, unknown or other
  misc_feature (338)..(338): n is a, c, g, or t
  modified_base (423)..(423): a, c, t, g, unknown or other
  misc_feature (423)..(423): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggcagtcagagtattactaaatggttggcctggtttcagcagaaaccagggaaacgccccaaaagtcctgatctctgccgcctctactttgacaagtcgggtccatcaaggttcagcggnagtggatctgggacagaattcagtctacaccatcagcagcctgcacgcctgacgtattttcgactaacttactactcgaccagtnactataaatatcgtagttcggacggtaaggaccaagggtggagtagtacaaacggtacgtaggtacggtctagactaccattcgtagttcctctattccccg

SEQ ID NO: 226992 - DNA, 738 bp, Homo sapiens
  misc_feature: GYAE6OF02IRBIZ.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtcaccctgtctgcatctgtcggagacagagtacaccatcacttggccggcagtcagagtatactaatggtgctgttcagcagaaacgaggaaacgacccaaaagtcctagatcgtctacggccgcctactactttacgacgtaaaaggtcgggtaccctaagtacgtaacggttcgaacggcggacgtaggtaggacgttcggtaagggaaactaacggttaaattccgtaaagttccgtacctaaccgaacgtacctaaggtaccgtaacgcccgttagaccgtaaggtaccgttacgggaaacctttagttttacggaaccttaaaccgttttaaccgtaaaccgttcgaaacccgttaaaggtaccggttaactaaacgtttaaacgttaaacttaccgttaacggtttaccggggaccgggttaaacgggaccgtaaaggggtacgggtaacgacgttaaaccggaaaccggttaaacgttacgggacgggttaccgtaaccggtacccgttaaccgtagtttaccccgtaaggtttaccctttacgtaacctttacccccgg

SEQ ID NO: 226993 - DNA, 592 bp, Homo sapiens
  misc_feature: GYAE6OF02H5VDG.15.28.C06.1.454.CMB.1.raw
  modified_base (373)..(373): a, c, t, g, unknown or other
  misc_feature (373)..(373): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggcagtcagagtattactaaatggttggctggttcagcaagaaacgagggaaacacccaaaagtcctgatctctgccgcttctacttgacgtaaaggtcgggtacctatactaaggttcaggcggctaggtggatcgtagggaacaagtattnacgttcacaactatacagtacacgacctagcagctagacgtattttacgacttaaactttactactacgtacaagtcgataaattaaattaacgtacgtagtttaccgggaacgggaacgggaacgaaagggtacgaagtaactaaccgaaaacggacttaggtacggaccttagaaccgtacaacgttccgttacgttacctttaccgtattaccccg

SEQ ID NO: 226994 - DNA, 555 bp, Homo sapiens
  misc_feature: GYAE6OF02GPL25.15.28.C06.1.454.CMB.1.raw
  modified_base (378)..(378): a, c, t, g, unknown or other
  misc_feature (378)..(378): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgacaaagtgggtccatcaaggttcagcggcagtgatcgtggacagaattcagtctcaccatcagcagccngcagcctgacgtatttgactaacttactacgtcgaccaagtcgactaataaataatactagtttacgggacggtaacgggaaccgtaaggtacggaagtacgtaacgaaacggtaacgtacggtcggacttcgaccgtaccgtacgttaccgttagttaccttacgtacttaccccg

SEQ ID NO: 226995 - DNA, 713 bp, Homo sapiens
  misc_feature: GYAE6OF02HHTUK.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctgggctcctgctgctctggctccaggtgccaaatgtgacatccagatgacccagtctccgtccacctgtctgcatctgtcggagacagagtcacatcacttcggccggcagtcagtagtattactaatggtgcctgttcagcaacgtaacgaggaaacacccaaaagtcctagatctctcgccgccttactacgtttagactaaaggtcgggtacccagtacgtaacggttcgacggtccggacgtaagggttacggtacgttaccggtagggtaacctaagggttaaactttaccgaaacgttccgttacccgaaacccgtaacttaccgaacggcccgttaaacgccccgttagaccggtaaccgttaccggtaggttaaaccgtttacgtttttaccggaaccttaaacgtttaccgtacgtcgtaacgtaagtacgtactaaattaaactacgtacgttacggttaccgggacggtaacgggtaaccgtaagggtagaacgtaacgttaacgaaaaccggtacgttacggtagggtaccttaaccgggtctaaacccttacggttcctttaccggttctttaccggtactttcccccgg

SEQ ID NO: 226996 - DNA, 641 bp, Homo sapiens
  misc_feature: GYAE6OF02GQZ8S.15.28.C06.1.454.CMB.1.raw
  modified_base (491)..(491): a, c, t, g, unknown or other
  misc_feature (491)..(491): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagacgtccaccatctacgttcggcccgggacagtcagtagtaatttactaaagtggttgccttggtttcagacaagaaaccgagggaaacacccgaaaacgtcctagatctcgcgccgtcctctacttgacgtaagtcgggtccatcgtagtcagcgctaggtgatcggtagactaagtacgttacacgtctaccgaacctacgactagaccacggaaccgtcgaccgtacgccgtagttacgttagttaccaaccgttaactttacctaccgtacgaaccgtacgttanaccgttaaataaattaacgttacctaaggtttccgggaacgggtacgtaaacggaagggtacgaacgtacgtaaccgtaacgtacggtcggttacgtaccgtagacccttaccgcttacggtttactaccgtttccgtaacctttcccgg

SEQ ID NO: 226997 - DNA, 619 bp, Homo sapiens
  misc_feature: GYAE6OF02JGT03.15.28.C06.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (447)..(447): a, c, t, g, unknown or other
  misc_feature (447)..(447): n is a, c, g, or t
  modified_base (555)..(555): a, c, t, g, unknown or other
  misc_feature (555)..(555): n is a, c, g, or t
  modified_base (580)..(580): a, c, t, g, unknown or other
  misc_feature (580)..(580): n is a, c, g, or t
tcagtctacgtagccacgaccggtgctcgatttagagctcacgtattgggtttgggggagtcagactcagtcaggacacagcatggacatgacggtcccgctcagctcctgggctcctgctgctctgctcccaggtgccaatgtgacatccagntgacccngtcctccgtccaccctgtcctgcatcgtcgtacggagacagacgtcaccatcacttggaccggccagtcagagtattactaatggttgccttgttcagtcaagaaccgaggaaacgaccccaaaagtcctagactcgtcctgccaccgttctaactttgacgtaaggtcggtacccatacggtaagttcgacggaccgtacgacgggttagacgttacgtacgggacaaggttaacgtttcgaacggtttacaccgttacccaattcccgagtaccgacgttccgngtaaccgactcggtactaccgtagttttcgaccttaacttactactagtacccgtaggactacgtaactaagtaactcgtaacgttcgggacggacgtaacgtaaggngtaacgatacgaacggtatacggtnacgttcgaacgtacgtgttccgatccgttatccttcccg

SEQ ID NO: 226998 - DNA, 558 bp, Homo sapiens
  misc_feature: GYAE6OF02GGTE3.15.28.C06.1.454.CMB.1.raw
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagaccccaaaagtcctgatctctgccgcctctactttgcaaagtcgggtccatcgaagttcagcggcagtgatcgngggacagaattcagtctcacatcagcagctgcacgcctgacgtntttgaccttaacttacgtactcgacctaagtcgactaataataactactaggtttccgggacgggtaacgggaaccgtaagggtcgaagtactaccgaaaacggtacgtaggtacggaccttacggacctaacgtacttacgttcgttacctttacgactttacccg

SEQ ID NO: 226999 - DNA, 596 bp, Homo sapiens
  misc_feature: GYAE6OF02G90UR.15.28.C06.1.454.CMB.1.raw
  modified_base (197)..(197): a, c, t, g, unknown or other
  misc_feature (197)..(197): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccatgtgccaaatgtgacatccagatgacccagtctccgtccaccctgtctgcatctgtcgganacagagtcaccatcacttcgccggccagtcagagtataactaaagtggttgctggttcagacaagaaaccgagggaaacgacccaaaagtcctagactctctcgccgcctacttactttgacgtaaaggtcgggtacccagtacgtaacggttcgaacgcggcgtaggtcggactacgtaggaacagtaacttcaacggtcctaccaacctataccgagtaccacgtccgtacgtacacggcttaggacgttatttacgacctaactttacacgtctactaagtcaagtaataataacttacgtacgtttacgggacgggtaaacgaacgtaaggaggtacgactaacgaaacgtcgtaggtcgacgtgaacctaccgtattcgtactcgtacttaccc

SEQ ID NO: 227000 - DNA, 726 bp, Homo sapiens
  misc_feature: GYAE6OF02HYMST.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatcgtgtacggagacagtacgtcaacatccacttcggccgggaccagtcagagttaattaactaaagtggttacgtccgttggttacagacaacgaaacgaagggaaacacccgaaagtcctgatctctcgccgtctctacttcgacgtaaggtcgggtacctagtactaggtacaggacgcgtagtacggacttcggacgggaacaaggtacttacgtacgtcctacgacacgtaccgagtcgtaaccggccgttacgacgtaccgtaccgtacggtacgtttacgttttacgtaaaccttaaacgtttaacccttacgtaccgtaaccgtaaacggtacgtaaacttaaacgtaaacttaaacgtttaccggttaaccggtttaccggggaaccggggtaaacggggtaaacccggtaaaggggttaacggtaacggtaacgttaacggaaaccggttaaacgttcgggttacggtacgttacgaacccgtaacgtaccgttacgttaacccgttctttaccgtaccttacccccgg

SEQ ID NO: 227001 - DNA, 659 bp, Homo sapiens
  misc_feature: GYAE6OF02FWOCI.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgagacagagtcaccatcacttgccggccagtcagagtattactaagtggtcgccttggttcagcaacgaaaccgaagggaaacgacccgaaaagtccgtagatcgtctcgccgtcctactacgttcgacgtaaaggtcgggtaccctagttacgtaacggttcacggcggtactaggtacggtactcggtacggacgtaagtaacttaccgtagttccctacacctaagtccacgaccgacgtccgtagccgaacgtcccgtacggtacgtttatttaccgaactttaaccttacgttacgtacgaaccgtaagtcgtaactaataaacttaacgtcgttaacgttaccggggacgggtaaggtaaccggtaagggtcgtaacggtactaacggtaaacggtacgtacgggtacgtcctacggtacctaacgtccttcggttcgttaccttacgttaccttccccg

SEQ ID NO: 227002 - DNA, 688 bp, Homo sapiens
  misc_feature: GYAE6OF02I8H04.15.28.C06.1.454.CMB.1.raw
tcagtctacgtagccacgaccggtgctcgatttagagctcacgtattgggtttggggagtcagactcagtcaggacacagcatggacatgaggtccccgctcagctcctgggctcctgctgctctggctcccaggtgccaaatgtgacatccagatcgacccagtctccgtccacctgtctgcatcgtgtacgagacagacgtcaccatcacgttcgccggcacgtcgagagtattaactaaagtggttacgtccgttgtttcgagtacgaacgtaaaccgaacggaaaccgtaccccgtaaaagtccgtaggaactccgtccgtcgcccgtacctacgttacgtttcgacgtaaacggtccgggtaccctagtacgtaaggttcgaggtcggtacgtaggtagtacgtacgtaggaacgtaagtaacgttcacgtcctacacctagtacgacgacgtacgccgtacgtaccacgtcctacggtacgtttacgtttacgaaccttaaccttacgtacgtaccgacgtaaggtcctaactacttaaactaccgtacgttaccgtttacgggacgggtaaccggtaacgtaagggtacgtaacgtacgtaaactaaacggtacggtacgtcggtaacgtcgtaaccgtacgtaacgttcttaccggttacttaccgttccgttaaccccg

SEQ ID NO: 227003 - DNA, 725 bp, Homo sapiens
  misc_feature: GYAE6OF02HWF39.15.28.C06.1.454.CMB.1.raw
  modified_base (189)..(189): a, c, t, g, unknown or other
  misc_feature (189)..(189): n is a, c, g, or t
tcagtctacgtagccacgaccggtgctcgatttagagctcacgtattgggtttgggggagtcagactcagtcaggacacagcatggacatgagggtccccgctcagctctgggctcctgctgctctggctcccaggtgccaaatgtgacatccagatgaccagtctccgtccacctgtctgctatctgnggagacagtacgcacatcagttcgccgggcagtacagtagttaacttaacgtaaagtggttcggccttacggtttcacgtacaaggaaaaccgtaacgggaaaacgaccccgaaaaagttcctagtatccgtactcggccgccttaccttacgttggacctaaaagggttccgggtacctagtaccgtaaacgggttccaacgggtaccggtcgtaaggttacggtactacggtagggtaactaaacgtacttacgtacgttaccctacgtaaacccctagtaaccgtacgtaccgtacgggtacccctaagggtcccaagggttacccgttaaggtaacccgttaagttttcgaaaccgttaactttaccgtaacttaccggacgtaaagtcctaacgtaattaaacgtaatccgtacgtttacgggacgtaacgggtacgagggttagagttaacgacgaaacgtacggtacggttacgtacgttaacgccgtaacgtacgttcgttaaccgttcgttagttaccttaccccgg

SEQ ID NO: 227004 - DNA, 584 bp, Homo sapiens
  misc_feature: GYAE6OF02GZJSS.15.28.C06.1.454.CMB.1.raw
  modified_base (368)..(368): a, c, t, g, unknown or other
  misc_feature (368)..(368): n is a, c, g, or t
  modified_base (572)..(584): a, c, t, g, unknown or other
  misc_feature (572)..(584): n is a, c, g, or t
tcagtctacgtagccacgaccggtgctcgatttagagctcacgtattgggtttgggggggggggtccctgagactctcctgtgaagcctctggattcaccttgagcacttattggatgacttgggtccgccaggctccgagggaaggggctggagtgggtggccaccataacaaaaagatggaagtgacacaacctatgtgaactctgtgatgggccgattcaccgtctccagagacgacgccaaagaactcactacatctgacaaaatcgaaacaacctgagagaccgaggacacggctgtgtattactgtgtgagagattgttctgtcggttggggaccgacgggaaccctggtccaccgtctccncacgcctccacgaacgggcccagtccggttccttcccccgtggcccgtcccgtgccctccgacggacgccgacccgtccgagacgaccaccgacggcccggcccgtcgggcctcgtcccgtggtaccaacgggtacctaccgttcccgacgttaccgtagaccgttcggacggccgggtcgtgggacgaacggcgacgagtagnnnnnnnnnnnnn

SEQ ID NO: 227005 - DNA, 937 bp, Homo sapiens
  misc_feature: GYAE6OF02FH8BT.15.28.C06.1.454.CMB.1.raw
tcagtctacgtagccacgaccggtgctcgattagagctcacgtattgggtttgggggagtcagactcagtcaggacacagcatggacatgagggtccccgctcagctcctggggctcctgctgctctggctcccaggtcgccaaatgtgacatccagatgacccagtctaccgtccaccctgtctgcatctgtcggagacagactccaccatcacttcggccgggccaggtccaggtacgtacttaacgaaattcggtcggcccttggtttaccacgtcgtaaacggaaaccccgtaaggggtaaaaccgacccccgtaaaacggtccctacggtactacgttctcgtaccggtccttaccgttaaccgttttacggaaccgtaaacgggttccggggtacccctaagttaacccgtaacggtttaccgacgggccggtactacgggtacgtaacgttccgggttaacgggaaaccacgttaaactttaccgaacggtttacccacccgtaaaaccctccgttaaccgtaaccgggtacccaacggtttaccccccgagggtaaccccgtccgggtaccccgtttaagggggtaaaccccttttaaccgtttttcgggaaaaccccttttaacccctttaaaccggtttaacccggttacccgaaacccgttaaacgggttacgtaaacccttaaaagttaaaaccttaaaccgtttaaacccgttaaaccggggttttaaaccgggcccggggggtaaaaaccgaacccgggttaaagggggttaaccgtaaccgggtaaaccttaaacccggtaaaacccggtaaaccgggtttggaaacccgggttaccttacccggaacccggttaacccctttaaccggttaccgggtttacctaccccggttttaacccacccggttttaaccccccccgg

SEQ ID NO: 227006 - DNA, 662 bp, Homo sapiens
  misc_feature: GYAE6OF02G7GIC.15.28.C06.1.454.CMB.1.raw
  modified_base (203)..(203): a, c, t, g, unknown or other
  misc_feature (203)..(203): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccagtctccgtccaccctgtctgcatcgtgtcggagacagngtcacatcacttcggccggcagtcagagttataactaagtggttaggccttggttcagtacaagaaaccgagggaaacacccaaagtcctagactctctcgcctccttacttacgttgacgtaaggtcgggtaccactagaacggttcaggacggagaggtggtaacgtggtacggactaagtaattccgagttccgtaccacctatacgacgtacgacgtcccgtagccgagtaccgtaggtaaccgttagttttaccgaacttaaacctttaaccgtaccgtacgtaaccgtagtaccgtaacttaaacgttaaattacgttacgttacggttaccggggaaccgggtaaacggtaccggtaaagggtacgtaagtaccgtaacgtaaaacggtacgttggtacgtacgttaccgactaaccgtcgttaccgttacgttacttccacgtttaccccg

SEQ ID NO: 227007 - DNA, 646 bp, Homo sapiens
  misc_feature: GYAE6OF02JJW9M.15.28.C06.1.454.CMB.1.raw
  modified_base (204)..(204): a, c, t, g, unknown or other
  misc_feature (204)..(204): n is a, c, g, or t
  modified_base (509)..(509): a, c, t, g, unknown or other
  misc_feature (509)..(509): n is a, c, g, or t
tcagtctacgtagccacgaccggtgctcgatttagagctcacgtattgggtttggggagtcagactcagtcaggacacagcatggacatgagggtccccgctcagctcctgggctcctgctgctctggctcccaggtgccaaatgtgacatccagatgacccagtcctccgtccacccctgtcctgccatctgtcggagacagngtcaccatcacttgccggccagtcagagtattactaaagtggttgccttgttcagtcaagaaaccgtagggaaacgtacccaaaacggtcctagatacctcctcggtcccgtccctacttaccttcgtaccgaaacgggttcgggtcccaagtccgtaacggttcacggtcggacaagggtcgatcgtaggaacgataagttcaaggtccacaccatcccaaggcacggtactcgtacacgcccgtgaacgttacttttcgacttaaccgttctagtacgacctaggtcaactagtaaacttacncgtttacgttacgggacgggtaaccggttaaaccggaggttaacgaggttaactaacccggaaaacggttctacgggtagtccctaagacccgtaacgtcgtaaccgtttcgtacccgtttaccgtcttaacccccg

SEQ ID NO: 227008 - DNA, 550 bp, Homo sapiens
  misc_feature: GYAE6OF02GDEJC.15.28.C06.1.454.CMB.1.raw
  modified_base (377)..(377): a, c, t, g, unknown or other
  misc_feature (377)..(377): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggtgcctggttcagcagaaccaggaacgacccaaaagtcctagatctctgccgctctactttgacgtaaaggtcgggtaccatacgaacgttcaggcggacagtggactcgtagggacagtactcagtctacacctanacagcacgtcctgacacgcctagacgtatttcgacttaacttactactgacctagtcgactaataactactactagttcgggaggtacgtaacgaagggtacgaagtactaacgaacggtaacgtgtacggtctagacgtaccgattaccgttagttccttacgacttacccg

SEQ ID NO: 227009 - DNA, 625 bp, Homo sapiens
  misc_feature: GYAE6OF02HEISR.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatccacttcgccgggccagtcagagtattactaatggttgctggtttcagcagaaaccgaggaaagaccccaaaagtcctagatctactcgccgcctcctactttgacgtaaacgtcggggtaccagtacgtaaggttcgagcggcgagtggactcggtagggacagtaacttcgagtactcctaactatacgtagaccgacgtaccgtcgacctagtccgtacgtacgttacgttttcgaaccttaactttaacttactacgacctaagtacgactaattaacgttactacgttaacgtttccgggacgggaacgggtaacgaagggtacgtaacggaacgttaccgaaaacggtaacgtggttacgggtactacgtaccgacgtacttcgttcgttaccttacgtacctttcccg

SEQ ID NO: 227010 - DNA, 799 bp, Homo sapiens
  misc_feature: GYAE6OF02IJUJ1.15.28.C06.1.454.CMB.1.raw
  modified_base (188)..(188): a, c, t, g, unknown or other
  misc_feature (188)..(188): n is a, c, g, or t
  modified_base (769)..(769): a, c, t, g, unknown or other
  misc_feature (769)..(769): n is a, c, g, or t
  modified_base (796)..(796): a, c, t, g, unknown or other
  misc_feature (796)..(796): n is a, c, g, or t
tcagtctacgtagccacgaccggtgctcgatttagagctcacgtattggggtttggggggggggggggtccctgagactctcctgtgaagcctctggattcaccttgagcacttattggatgacttgggtccgccaggctccgaggggaaggggctgggagtggggtggccaccaataacaaaaaagntgggaagtgaacacaaacctatgtgaactctgtgagtgggaccattccaccgtctccagagacgacgaccaagactcactacatctgacaaatgaacaaccgtgagacgaccggaggacacggctgtagttattacgttgtggttagaggtaagtagttggttcgtggtcgggtttcgggggacccgtaacggggtaacccgttcgggtaccgtacccggttcctcctaccgaccgtcccgtacccgaaaccggtaaccgggtacccctaacggtttcccggttacccccgtttccccccggtcgggtccccgttcccccgtcgggtaccccgttaccggtaacgggtccggtacccgtaccccggttaaccggaacggtaaccgaccgaaccggaaccggggtccccgggacccgggttccggggtaccgttcccggtaacccggttacgggtaacccgtaaaccggtaccgttaacccgtttcccggtaaccgttaaccgtacgggtaaccggtacggggtaccgggtaccggggtcgtacgggaaccgtaaccgggacgaaccgtaaggtacggtagngtacgtcgagcgtagtcctagcgtacngtc

SEQ ID NO: 227011 - DNA, 667 bp, Homo sapiens
  misc_feature: GYAE6OF02IAH9M.15.28.C06.1.454.CMB.1.raw
  modified_base (173)..(173): a, c, t, g, unknown or other
  misc_feature (173)..(173): n is a, c, g, or t
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
  modified_base (601)..(601): a, c, t, g, unknown or other
  misc_feature (601)..(601): n is a, c, g, or t
tcagtctacgtagccacgaccggtgctcgatttagagctcacgtattgggtttggggagtcgagactcagtcaggacacagcatggacatgagggtccccgctcagctcctgggctcctgctgctcgtcggctcccgaaggtcgccaaatggtgacacgtccagatgacccanctacgccacctgtctagcatcgngtacggagacagacgacaccagtcacgttcgcggggccaaggttccaaggatttataaccgtaaagtcggtaggcctaggtttcagtcagaaaaccgtaggaaactcccaaaaggtcccngaactctacgtacgccgtctcgttaaccttgaaccgtaaaggtccgggtaccgtagtacgtaacggtagtacgacgccgtaagtcggtactacgtagggtaaccaggtaacgttctacggtacttacctaacacgttcaacggtacgaaccgtcccgtaggtccacgtaccttacggtaacgtgtttaacgacgttaaacctttcggtactagtaccctaaggttacgctaacgtaaacttaactacgagtttaccgcgggtaacgtaacggaacgtaggtaacngtaaccgtaaagaaacgttcgtacgacgttccgaccgtatcggacttcggttactcttagttcccg

SEQ ID NO: 227012 - DNA, 669 bp, Homo sapiens
  misc_feature: GYAE6OF02GWA6Y.15.28.C06.1.454.CMB.1.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatctgcgganacngatcacatcacttcgccgggaccngtacagagttataactaagtggtcgtctgttcagcaagaacgaaggaaacaccaaacgtcgagtatcctcgtcgccgtcctcttacgttagacgtaaggtcgggtacccagtacgtaaacggttcaggcgtacgtagtacggactacggtaggaactaagtaacttacgacgttactaccgaactacgtacgacgacctacggtcctggtaccgtacgtaccgtaggtaaccgtttacttttaccggtaacttaactttaaccttacgcgaccgtagtacgattaaacgtaaactactcgttaacggtttaccggggacggttaaacgggttaaccggaagggttaggaacgtaacgttaaccggaaaccgttaacgttcgggtaaccggtctacggtactaacccgtacgtttacgtcggtttaccttacgtaccgtttacccg

SEQ ID NO: 227013 - DNA, 606 bp, Homo sapiens
  misc_feature: GYAE6OF02FWIC5.15.28.C06.1.454.CMB.1.raw
  modified_base (101)..(101): a, c, t, g, unknown or other
  misc_feature (101)..(101): n is a, c, g, or t
  modified_base (208)..(208): a, c, t, g, unknown or other
  misc_feature (208)..(208): n is a, c, g, or t
tcagtctacgtagccacgaccggtgctcgatttagagctcacgtattgggtttggggagtcagactcagtcaggacacagcatggacatgagggtccccgntcagctcctggggctcctgctgctctggctcccaggtgccaaatgtgacatccagatgacccagtctccgtccaccctgtctgcatctgtcggagacagagtccacntcactgccggcagtcagagtattacaagtggtgcctggttcagcaagaaaccagggaaacacccgaaaagtcctagatacctctcggccgtccttactactttagacgtaaaggtcgggtaccctagtccgtaaggttcagtcggactaggtggtactcggtagggactaacgtaattcgagttcctacacctataccagaccagcctgacacgtcctagtacgttacttacgaccttaactttacgtacgtacgtaccgtagtacgactaaattaaactacgtacgttacgtacgggacggtaacggaacgtaagggagtaacgagtaaccgaaacggtagtacggtacggtactacgacctacgtacgttccttactaccgttactacttaccccg

SEQ ID NO: 227014 - DNA, 687 bp, Homo sapiens
  misc_feature: GYAE6OF02HOCM9.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtcgccaaatgtgacatccagatgacccagtctccgtccaccctgtctgcatctgtcggagacagacgtcaccatcactcgccgggccagtcagagtatactaagtggttggctggttcagcagaaaccgagggaaacgacccaaagtcctagatctctcgccgcctctacttcgacaaggtcgggtacctagtacgtaacggttcgaacggtcggacgtaggtagtacgtcgtagggaacgacgttaagttaccagttacctaccgaacctactaccgaggaccgaacggtccccgtcggactacggccgttacgtaacgttacgtttacgtaccttaaaccgtttacctaccgtataacccggtaagtccgtaactaaactttaaactacgttaccgttaaggttacccgggtacggggtaaccggggtaacggttaaacggggtagggtaacgttaaccggtaaacgtaaaccggtaacggttccggtagggtcctaacgggcctaccgtacttcccgttgtttaacctttaccgtaccttaccccg

SEQ ID NO: 227015 - DNA, 616 bp, Homo sapiens
  misc_feature: GYAE6OF02IWCRF.15.28.C06.1.454.CMB.1.raw
  modified_base (277)..(277): a, c, t, g, unknown or other
  misc_feature (277)..(277): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgggggagtcagactcagtcaggacacagcatggacatgagggtccccgctcagctcctgggctcctgctgctctggctcccaggtgccaaatgtgacatccagatgacccagtctccgtccaccctgtctagcatctgtccggagacagagtcaccatcacttgccgggccagtcagagtattactaaatggttggcctggtttcagcagaaaccagggaaacnccccaaaagtcctagaatcgtactgaccgccttctaacgtttgacgaaaagttcggggtacccatcgaacggttcacgtccggactagtggtacgtctggganaacggaatttcagttcctacacctatcagccaagcctgactagcctagacgtattttcgactaaacttctaacgtcgaaccgagtcgactaaagttaactaacttactacgtttacgggacggggtaaccggtaaccgtaaagggcggtaagacgtaccgaaaacggtaccggtagttaccggacttacggtaaccctaccgtattccgtacggttaccttaccgtctttaccccg

SEQ ID NO: 227016 - DNA, 638 bp, Homo sapiens
  misc_feature: GYAE6OF02J0EKX.15.28.C06.1.454.CMB.1.raw
  modified_base (415)..(415): a, c, t, g, unknown or other
  misc_feature (415)..(415): n is a, c, g, or t
  modified_base (581)..(581): a, c, t, g, unknown or other
  misc_feature (581)..(581): n is a, c, g, or t
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgactatccagatcgacccagtctccgtccacctgtcagcatctgtcgagacagatcaccagtcacttggccggctaagcagtagtattacaatgtgactgtcagcagaacaggaactaccaaagtccagactctctgtccacgtctacgtttcgacgtaaaggtcgggtaccctaagttacgtaacggttcaacggcgtacagtacggagtacgtacgggactaacgtctacgtctacaactactcaacgtcacgcctagcgaacncgtaagacggttactttcgaattaaccttaacttacgacggtaaccctaaggtactacctaaaggttaaactacgtacgttaacgttccggggtaaaggtacgggtaaaccgtaaagggtacggtaacgtaacgtaccgaaacgtacggttcggtaacggttaacnccgggaactaacctacggttaccgtaatttccgtaacttacggtccccttaacccgg

SEQ ID NO: 227017 - DNA, 724 bp, Homo sapiens
  misc_feature: GYAE6OF02F4C85.15.28.C06.1.454.CMB.1.raw
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
tcagtctacgtagccacgaccggtgctcgatttagagctcacgtattgggtttggaggtctcagagaggagccttagccctggactccaaggcctttccacttggtgatcagcactgagcacagaggactcacccatggaattggggcctgaggcctgggtttttccttgttgctattttagaaggtgtccagtgtgaggtgcaactggtggagtctgggggacgcctaccgtccacggcccgggggggtcccctgacggacctccgtcctggtgaacgtcctcgtaggacttcacccttgacgcacttatggatgacgttggtccgccgtacgctccgaggaagggtctggacggtggtcggaccaccataacgaaaacgntaggaacgtnaacacaaccgtatacgtanaacctctggtcgacgtaggggacctacgttccgacccgtcaccgaagacgtaaccgacgaccctaaacggtaacctccgaaacttacctacgtcgttacgaacgtaaactacggaaacctaaccgtacgaacggacgtaccggaaacggttaaccgacggggttaccttaggtacgttaaacgttccggttagacggttcggtaaacggtccgttaacggttccggtttaccggttaggtacccgggggtttaccgggggaaccccggtttaacggggaaccccccgttttagggtaccccgttaaccccggg

SEQ ID NO: 227018 - DNA, 556 bp, Homo sapiens
  misc_feature: GYAE6OF02GFMUZ.15.28.C06.1.454.CMB.1.raw
  modified_base (549)..(549): a, c, t, g, unknown or other
  misc_feature (549)..(549): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttgctggttcagcagaaacaggaacacccaaagtcctgactctctcgccgtcctctactttcgactaaggtcgggtacccagtctaaggttcacgcggacagtgatcgtaggacaagtaattcgagtcctacaccatcagcacgcctgcacgtcctacgacgttacttttcgacttaaaccgttactactcgaacctagtcgactaataaataattcgtagtttcgggacgggtaaggaccggtaaggtggaagtacgtacgaaacgtacgtaggtacggctagaccacgtatcttcgtcttaccnttccccg

SEQ ID NO: 227019 - DNA, 718 bp, Homo sapiens
  misc_feature: GYAE6OF02GWJR4.15.28.C06.1.454.CMB.1.raw
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
tcagtctacgtagccacgaccggtgctcgatttagagctcacgtattgggtttgggggagtcagactcagtcaggacacagcatggacatgagggtccccgctcagctcctgggctcctgctgctctggctcccaggtgccaaatgtgacatccagatgacccagtctccgtccaccctgtctgcatctgtcggatacagacgtccacatcacttcgccgggccagtcagagttatactaatggtgcttggtttcagcagaaccgagggaaacaccctaaaagtcctagactctctcgccncctcttactttgacgaaggtcgggtacccagtacgtaagtcgacgnggacgagtgactcggaggacggtacttcgacggtcctacaccgtacacgtagaccgtacgtcccgtagaccgtacgtccctaggtaaccggtttatttaccggaccgtttaaacctttaccgttaccgtacggtaacccgtaaaggttccgtaaactaaagtttaaacccgttaagtttaacccgttaaccggggttttaccgggggaaccggggttaaaccggggtaaaccccgttaaagggggttacgtaacggtaaccgttaaaccgtaaaacggttacggtacgggttacggtaccgttaaccgtaccgtaacccgttacttccgttaccgttacctttaccggtacccttaccccggttaccccgg

SEQ ID NO: 227020 - DNA, 596 bp, Homo sapiens
  misc_feature: GYAE6OF02JCD1S.15.28.C06.1.454.CMB.1.raw
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagtacagngtccaccatcacttgccgggccagtcagatattacaaatggttgcctggttcagcagaaccagggaaacncccaaaagtcctagactctactgcccgtcctactacttcgacaaaggtcggggtccctatcgaaggttccaaggtccggacgagtacggatccggtaggacagtaactcgagtcctacacctatacagtcacgcctgcctagcctgacggttatttacggaccttaacttaacgtacttcgaacctaagtcgaactaagttaactagtaccttaggttaccgggacgggaacgggtaaccgtaagggttacggaagtataacggaaaccgaaggtggtacgacttacggacctaaccgacgttccgtatccttacacttcccg

SEQ ID NO: 227021 - DNA, 862 bp, Homo sapiens
  misc_feature: GYAE6OF02GGVXX.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgaccaaatgtgacactccagatcgacccagtcctccgtccaccctgtctgcatctgtcggagacagacgtccaccatctacgttcggcccgggcctagtcaagtagttaacttaacgtaaaggttgggttacggtccgttgggtttccaaggtaccgtaaacggaaaacccggtaaacggggtaaaacccgaaccccccgtaaaaacggttcccgttacggttaaacttcccgttaccggtaccggtacccccgttacccttaaccgttttaccgttttaaccggtaaccgttaaacgggggttcccgggttaacccctaaggttaacccggtaaacggttccggaccggtaccgggtacgtaaacggggttggtaacgttacgggtacgggaacgtaaacgttacttacgtacgttacctaaccgtacctaacgtacgaacgacctacggtcctacgaccgtaccggtccgttaacggtaacgtttacgtttacggtaacctttaacccgtttaaccgtaccggtaccgttaccggtaacggtactaaaccttaattaaaccgttagttaaccgttacggtttacggggaaccggggtaaccggtaaacggttacggggaacgtataaaccgtaaccggtaaacgtcggtaacggtaccggtacgtaccgtaaccgtaccgtacgttaccgtttgtaccctttaaccgtcctttaacccccg

SEQ ID NO: 227022 - DNA, 680 bp, Homo sapiens
  misc_feature: GYAE6OF02GNA2U.15.28.C06.1.454.CMB.1.raw
  modified_base (102)..(102): a, c, t, g, unknown or other
  misc_feature (102)..(102): n is a, c, g, or t
tcagtctacgtagccacgaccggtgctcgatttagagctcacgtattgggtttgggggagtcagactcagtcaggacacagcatggacatgagggtccccgntcagctcctggggctcctgctgctctggctcccaggtgccaaatgtgacatccagatgacccagtctccgtccaccctgtctgcatcgtggtcggagacgagagtcaccatcacgttcgccggcagtcagtagtatactaagtggttggcctggttcagcagaacaggaacgcccaaagtcctagactctctcgccgtccttctacttgactaaggtcgggtacccatcgaaggttcaggtccgcgtagtcggtactcggttagggactaaggtaattaccgagtacctcgtaaccctaagtcctaagccgtaacgcccgttacggacgtaaccgacccgttaggtaaccgttacgtttttaccggtaaccttaaacgttttaaccttaccgttaccgtaaccctaagttacggtaccgtaaagttaaacttaacgtaccgtttaacggtttcgggaacgggtaacgggaacccgtaggggtaacgggaacgtaccggtaacgtaaacgtaacggttacggtcggtacgtacggacctacgtaacttccggttagttaccgttacgtaccttacccgg

SEQ ID NO: 227023 - DNA, 773 bp, Homo sapiens
  misc_feature: GYAE6OF02JHI8H.15.28.C06.1.454.CMB.1.raw
  modified_base (540)..(540): a, c, t, g, unknown or other
  misc_feature (540)..(540): n is a, c, g, or t
  modified_base (548)..(548): a, c, t, g, unknown or other
  misc_feature (548)..(548): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccgaggtcgaccaaatgtgacatccagatcgacccagtcctccgtccaccctgtctgactactcgtggtacggagacagacgtacacctatccgtacgttcggacccggggtacctagtaccgaaggtacgttaactttaacgtaaagttcggttacgggtccgtttacggtttacgaacggacgtaaacgtaaaccgggaacggaaaacccgtaaccccgtaaaacgtcccgtaggtactcctacgtccggaccctaccgttaccttaacgttacggtaacgtaacgggttccgggtaccctacgttaacggtacggttaccgacggtacggtacgtacggtacggtacgttacggacggtaacgaaggttacttaccgtacgttaccgtaccgactactacggacncggtaccnccgttcgaaccgtcgtaaccgtagtaggtttaactacggtaccttaaacgttcctacgtcgtaactcgtacacttataactacgtacgtaaccggttgggaacggtacggaactaacgggagttaaccgacgttaaaccggaagtacgggtttaacgccggtaacgtaccgttaacgccgtttacggttaccgtttacccgtacttacccttacccgggttaccc

SEQ ID NO: 227024 - DNA, 654 bp, Homo sapiens
  misc_feature: GYAE6OF02IJ5BQ.15.28.C06.1.454.CMB.1.raw
  modified_base (251)..(251): a, c, t, g, unknown or other
  misc_feature (251)..(251): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggccggccagtcagagtatactaatggtgctgttnagcagaaacaggaacgacccaaagtcctagactctctcgcctcctcttacttgactaacggtcgggtccatacgaaggttcaggcgacgagtaggtactcgtaggacgaagtaactcacgtctacaccactacgacgcaacgtccgtacgcgacgtccgtacgtaacgttagttttacgaccttaaacctttaccgacgttaccgaccgtaaaggtctaacgtaaacttaacttaacgtcgttaacggtttaccggggaaccgggttaaacggggacccggtaaaagggttcgggaacgttaacctaaccggtaaaaccggtaacgttcggggtacgtaaccgtaccggaaccgtacccgtatttccccggttagtttcccttacctaccgtttaacccccgg

SEQ ID NO: 227025 - DNA, 668 bp, Homo sapiens
  misc_feature: GYAE6OF02J1TJR.15.28.C06.1.454.CMB.1.raw
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (651)..(651): a, c, t, g, unknown or other
  misc_feature (651)..(651): n is a, c, g, or t
  modified_base (661)..(661): a, c, t, g, unknown or other
  misc_feature (661)..(661): n is a, c, g, or t
  modified_base (663)..(664): a, c, t, g, unknown or other
  misc_feature (663)..(664): n is a, c, g, or t
  modified_base (666)..(667): a, c, t, g, unknown or other
  misc_feature (666)..(667): n is a, c, g, or t
tcagtctacgtagccacgaccggtgctcgatttagagctcacgtattgggtttggggggggtccctgagactctcctgtgaagcctctggattccaccttgagcactttattggatgacttgggtccgccaggctccagggaaggggctggagtgggtggccaccataacgaaaaagtggaagtgacacaacctatgtgaactctgtgatgggccgattccaccgtctccagagacgacgacctaaagacttcaactacactctacgacaaaagtcgaaactaacctgaagacgccggacgactacggctgtgtattacgtggtgtagngagtatgttcgngtcgggttgggccgtaacggaccgtcggtaccgaccgtctaccgtcaccgtaccgtcctaaccggaacggtcccctaacgttcccggtccttaccccggtcggcccgtaccgtcggtacctaccgggaacggcgaccctaacccggtcccggaaacgtacgaccgtaccggaccggtcccggcccggtcgggaccttccgggaccttacgggtaccgaaacggttaacccgtcgttacccgcgttaaccggaacgtccggaaggtcgggaacggtcgtagggaccgaaccggtcgccgtaaggtcgcganacgctgcgcngnngnnc

SEQ ID NO: 227026 - DNA, 809 bp, Homo sapiens
  misc_feature: GYAE6OF02GOEV8.15.28.C06.1.454.CMB.1.raw
  modified_base (102)..(102): a, c, t, g, unknown or other
  misc_feature (102)..(102): n is a, c, g, or t
tcagtctacgtagccacgaccggtgctcgatttagagctcacgtattgggtttgggggagtcagactcagtcaggacacagcatggacatgagggtccccgntcagctcctggggctcctgctgctctggctcccaggtgccaaatgtgacatccagatcgacccagtcctccgtccaccctgtctgcatcgtgtcggagacagacgtcaccatcacgttcggccgggcagtcagtagtaattaacgtaagtggttacggccttaggttcagacaacgaaaccgaagggaaaccgacccctaaaaggtcctagacttctacgtcggaccctccttacttacgtttacgaacgtaaacgggtccgggtaccctaagttacgtaaacggttcgacggacggtacgtagggtacggtacgttacggtacggggaactaaacggtaacttccggtaacgttccgtaacccgtaccctaacgttaccgacggtaccgaacccggttccgtacgtaccgtaaccggtcccgttaaggtaccgtttaacgttttcccgaaacgtttaaaacccgtttacgtttaaccggtcggtaaccgtaaacggtttacgtaaacttaaacgtttaaaacgtttaccggttaacgtttaacgggtttaaccggggaaccgggtaaaccggggttaaacgtaaacgggggtaggtaacgtaacgtaaccggtaaaacggtcggttacgggtaccgggttactaccggtaacccgtaccgttagtttacccgtttaccgttacctttaccgacctttacccccggg

SEQ ID NO: 227027 - DNA, 645 bp, Homo sapiens
  misc_feature: GYAE6OF02HV59P.15.28.C06.1.454.CMB.1.raw
  modified_base (125)..(125): a, c, t, g, unknown or other
  misc_feature (125)..(125): n is a, c, g, or t
tcagtctacgtagccacgaccggtgctcgatttagagctcacgtattgggtttggggagtcagactcagtcaggacacagcatggacatgagggtccccgctcagctcctgggctcctgctgctntggctcccaggtgccaaatgtgacatccagatcgacccagtcctccgtccaccctgtctgcatctgtcggagacagagtccaccatcacttcggccggccagtcagagtaatttaactaaagttggttaggccttggtttacagaccgaagaaaccgaagggaaacgaccccaaaagtcctagtaactcctcctcgccgtccttccttacgtttcgacgtaacggtcgggtaccctagtacgtaaggttcaggccggactaggtggacgtccgtagggaacaaggtaattcgtagtctaccaacctacgtcgtagaccacgtcccgcgcgacgtcccgtaggtacgttaacttttacgaccttaaacctttactaccttcgaactaagctataaacgttaaatactacgttacggttacgggacggaaacggacgtaagggtgaagtacgtaacaaaacggtcttagggcgtactccggacctaccgtaagttccgttcgtttaccttctacttaccccg

SEQ ID NO: 227028 - DNA, 692 bp, Homo sapiens
  misc_feature: GYAE6OF02GXOV2.15.28.C06.1.454.CMB.1.raw
  modified_base (201)..(201): a, c, t, g, unknown or other
  misc_feature (201)..(201): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagngtcaccatcacttcgccgggccagtcagagtattactaagtggtgcctggtttcagcaacgaaccgagggaacaccccaaagtccgtagatctctgccgcctctacttgactaaaggtcgggtaccctatacgtaacggttcacggtacggactaaggtcggtaactacggttacgggaactaaggtaaacgttcgtacgttacctaccaaccctatacgaacgtccacggtcctacgggacacggtacgttacgtaacgttagttttacgaccttaaacgtttaccttacgtaccgtaccgtaacggtcgtaacctaaattaaacgttaacgttaccgttaacgggttttaccggggacggggttaaaccgggtaaacgtaaacggggtaggtaaacgtagttaaaccgtaaaacggtaacggttagggttaccgcgttacgacccgtaacgtacgttaccgttaggttcctttaccgcctttaccccgg

SEQ ID NO: 227029 - DNA, 717 bp, Homo sapiens
  misc_feature: GYAE6OF02IM2JS.15.28.C06.1.454.CMB.1.raw
  modified_base (275)..(275): a, c, t, g, unknown or other
  misc_feature (275)..(275): n is a, c, g, or t
tcagtctacgtagccacgaccggtgctcgatttagagctcacgtattgggtttgggggagtcagactcagtcaggacacagcatggacatggacggtccccgctcgagctccgtgggctcctgctgctgtcgcctccgaggtcacctaagtgtgactactccagtatccgaccctagtcctcccgtccctaccgtgtctcgctacttgtacggacgagacagactccactatctacgtcgccgcagtcagattatacgtagtgtcgtctgtcgancgaacgaacgaggaaccgaacctaacgtcctagtactccgtactccgcctccgtcttaccgtgtaacgaacgggttccgaccgtacgtacggttaacgtcggacggtccgtacggtaggtcggtaacgtcggtacggaactagtacgttacgtaccgtcctaccgtactaccgtacgtacgaccgtaccgtccgtacgtacggtacgtcgtaacgtaccgtttactaccggtaaccttaaacgtttccgtaccgttcgtaaccgtaaggtccctaagtaaccttaagttaccgtaccgttacgggtacggggtaccggtaaacgggtaccggtaagggtacgtacgtacccgtaagtaccgtaacgggttcggacgttacccggaccgtcgtaaccgttaccgttacggttcccgtttacgtcccgtaacctttccccccgg

SEQ ID NO: 227030 - DNA, 682 bp, Homo sapiens
  misc_feature: GYAE6OF02HK887.15.28.C06.1.454.CMB.1.raw
  modified_base (179)..(179): a, c, t, g, unknown or other
  misc_feature (179)..(179): n is a, c, g, or t
  modified_base (654)..(654): a, c, t, g, unknown or other
  misc_feature (654)..(654): n is a, c, g, or t
  modified_base (662)..(662): a, c, t, g, unknown or other
  misc_feature (662)..(662): n is a, c, g, or t
  modified_base (669)..(669): a, c, t, g, unknown or other
  misc_feature (669)..(669): n is a, c, g, or t
  modified_base (672)..(672): a, c, t, g, unknown or other
  misc_feature (672)..(672): n is a, c, g, or t
  modified_base (681)..(681): a, c, t, g, unknown or other
  misc_feature (681)..(681): n is a, c, g, or t
tcagtctacgtagccacgaccggtgctcgatttagagctcacgtattgggtttggggggggggggtccctgagactctcctgtgaagcctctggattcaccttgagcacttattggatgacttgggtccgccaggctccagggaaggggctggagtgggtggccaccataacaaaaagntaggaagtgacaacaacctatgtagaactctgtgatcgggccgtattcaccgtctccagagacgacgaccaagaactcactacatctgacaaagtcgaaacaaccgtgaagacgaccggaggacacggtctgtagtatacgtgtgagagagatgttctgtcggttcggggccaaggggaccctggtccaccggtctccgtcacgtccctaccgaaccgaacgggtccccagttcccggttccttaccccccgtgggacccctccccgtgtccccgttaccgaacggaccgacccgtacccgtcccggaagaccgaccgtaacgacgggcccggtaccccgtaggggtacctcgggtacccgttaccgggtaacgaaaccgggtacccttaccgttacccgtaccgttaaccggtaagaaccgttcggacggtaccggggtcgtagggaccgtaaggggccctaggtaacgtcggnacgtcgancgtacgnacncgtagctang

SEQ ID NO: 227031 - DNA, 603 bp, Homo sapiens
  misc_feature: GYAE6OF02ICL5I.15.28.C06.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (350)..(350): a, c, t, g, unknown or other
  misc_feature (350)..(350): n is a, c, g, or t
  modified_base (449)..(449): a, c, t, g, unknown or other
  misc_feature (449)..(449): n is a, c, g, or t
tcagtctacgtagccacgaccggtgctcgatttagagctcacgtattgggtttggggagtcagactcagtcaggacacagcatggacatgagggtcccgctcagctcgtgggctcctgctgctcgtcggctccgaggtcgaccaaaatggtagacactccgagatcgaccctagtcctccgtcccacctgtcgtcgcatcgttggacggaagacgagactcactatcncgttcggccgggcagtcgaagacttataactaagtacggtcgtcgtgttcagacaacgaacgaaggaaaccgaccgaaacgtcctagactcgtcngccactctcttgacgaagtcggtctanacgtacgtacgacgacgacgtaggacgtacgtgtaggaacgacgtacgttacgtctacctccaactcgtagacgcgaacgcgttcacgtacgtacccgngtaaacgttcgttactaactaacttacgtatccgaacttagaccgtattaaacgtaaacttgtacctggttacgaaagggacgtacggaaagagtacgacacgtaacgtaacgtggccgtatacgactactcggattccgtatacccttgtccc

SEQ ID NO: 227032 - DNA, 670 bp, Homo sapiens
  misc_feature: GYAE6OF02FZBA5.15.28.C06.1.454.CMB.1.raw
  modified_base (634)..(634): a, c, t, g, unknown or other
  misc_feature (634)..(634): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccgggccagtcagtagtattactaagtggtggccgttggttcagacaacgaaaccgaagggaaacgaccccgtaaaagtcctagtactcctctcgcccgtcctctacttgacgtaaaggtcgggtaccctagtaccgtaaggttcgacggccggagtaggtggacgtcggtaggtaccgtaagtacttcgtacgtcctaccgacctagtcagaccacgtcccgtcgactaccgtccgtaacgtaccgtttagtttaccgtaaccttaaccgtttaacgtaccgttacgtaaccgtaacgtacgtaactaattaaactacgttacgttaacggtttccgggacgggtaacgggacgtaagggtagaacgtacgtaacggaaccggtaagtacggtcgtaccgtacgtacccaccgttnttaccgttagttaccgttacgtaccgtttacccccg

SEQ ID NO: 227033 - DNA, 634 bp, Homo sapiens
  misc_feature: GYAE6OF02FHZOC.15.28.C06.1.454.CMB.1.raw
  modified_base (500)..(500): a, c, t, g, unknown or other
  misc_feature (500)..(500): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagagtccacatcacttgccgggcagtcagtagtattactaagtggtggctggtttcagcaagaaccgaagggaaacgaccccaaagtcctagactctactcgcccgtcctaccgttactttcgactaaaggtcgggggttaccccagtactaaggttccaggccggagaggtggagtcgtagggaacaggtaacttcgagttctacctaacctactacgaacgtcgacgtccgtaggaccacgtcctacggtacgttagttcgaccttaacttactacgtacgactaagtcgacttaaanaattaacgtacttacggttacgggtacggggaacggtaccggtaagggtacggtagtacgaacgtaacgggtaacgtggtacggcgttacgaccgtactacgttaccgtcggtttacttctaccgtttaccccg

SEQ ID NO: 227034 - DNA, 674 bp, Homo sapiens
  misc_feature: GYAE6OF02FPFOF.15.28.C06.1.454.CMB.1.raw
  modified_base (301)..(301): a, c, t, g, unknown or other
  misc_feature (301)..(301): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccgagggaaacgaccccaaaagtcctgaatcgttcncgccgcctctactttgactaaaggtcgggtacccatcaaggttcagcggctagtggatcgtagggacagaatttcatcgtaccaacctatcacgcaacgcctgaccgacgcccgttagtacgttagttttacggacttaaacctttaccgttacgttacgaccgtaaagtcggactaaacgttaaacttaacttcccgttaaggttttaccggggaccggggtaaccggggtaacccgtaaagggtttacggggaacgttacgtaacccggtaaaacggtaacgtttaacgggtccggggtacttacggtaccccgtaaaccgttacgtttacccgttaccggtttaccgtttaccgttacgttttccccccg

SEQ ID NO: 227035 - DNA, 580 bp, Homo sapiens
  misc_feature: GYAE6OF02H7U5Q.15.28.C06.1.454.CMB.1.raw
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (533)..(533): a, c, t, g, unknown or other
  misc_feature (533)..(533): n is a, c, g, or t
tcagtctacgtagccacgaccggtgctcgatttagagctcacgtattgggtttggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtgggggtcccttagagtctctgtgtggcctctggattcactttcagtaatggctggatgagttcggtccgcaggctcgagggagggcgtggaggtgggttggacgtttacaaaagtaaatgatggtagaagaaatagactacggngacaccgtagaaggaagatcacatctacaaganaataatacgaaaaacgtcggttatatttagataaatgaaactagacctaagaaacgagaccagacgccttcgtaatactacgaccacaagtacgtacgaatgactagtacgacgtaaggcgtntagtgtctttagattagtccggtgggacccaagggtaccaggttcgg

SEQ ID NO: 227036 - DNA, 688 bp, Homo sapiens
  misc_feature: GYAE6OF02HXTTZ.15.28.C06.1.454.CMB.1.raw
  modified_base (197)..(197): a, c, t, g, unknown or other
  misc_feature (197)..(197): n is a, c, g, or t
  modified_base (488)..(488): a, c, t, g, unknown or other
  misc_feature (488)..(488): n is a, c, g, or t
  modified_base (679)..(679): a, c, t, g, unknown or other
  misc_feature (679)..(679): n is a, c, g, or t
tcagtctacgtagccacgaccggtgctcgatttagagctcacgtattggggtttgggggagtcagactcagtcaggacacagcatggacatgagggtccccgctcagctcctggggcctcctgctgctctggctcccaggtgaccaaatgtagactatccagatcgacccagtcctccgtccctacccgtgtacctnctatcgtggtacggagacagacgtaccaccatcgacgttcggcccggccagtcgaagtagttaacttaacgtaaagttcgggttcgccgtttacggttccaagaccgtaaacggaaacccggtaaacggggaaaccgaaccccgtaaaacgtccctaggtaccttcctccggtccgtccccgttaccttacgttaccgttacggacgtaaacgggttcccgggacccttagtaccggtaacggttccgacggcggtagtaggtgtacggtcggaggtaacgagttaccgtntacgttccaccgtactacgacgtacgcgacgtacctgaccgtaccgtacgtacgtaccgtttagttaccgtaaccgttaacttaacgccgtacaaccgtagtacctaataaactaactcgtataacggtcggacggtacgagtagcgagtacagtacgtcgtgacgcaacgtcgactcgtctacggtcctntaccctccg

SEQ ID NO: 227037 - DNA, 918 bp, Homo sapiens
  misc_feature: GYAE6OF02HYCIC.15.28.C06.1.454.CMB.1.raw
  modified_base (205)..(205): a, c, t, g, unknown or other
  misc_feature (205)..(205): n is a, c, g, or t
tcagtctacgtagccacgaccggtgctcgatttagagctcacgtattgggtttgggggagtcagactcagtcaggacacagcatggacatgagggtcccgctcagctcctggggctcctgctgctctggctccaggtgacctaaatgtgacatccagatcgacccagtctccgtcctacctgtctgacatcgtgtacggagacgnggacgtccacctagtcctacgttcgccgggtacctaggtctaagtagttaacttaacgtaagttcgggtttacggccgtttacggttaccacggtaacgaaacggaaacccggaagggtaaaaccgaaccccgtaaaacgttccgtaagtacttacgtacgtaccgggtaccgtccttaccgtttacgttacggaacgtaaacgggttccggggtaccctacgttaacggtaaccgggttacgcgggtaaccggtacgtacggggttacggtaacgttaccgggttgggaaaccgtaacggttaactttacccgggaattcccgtaaaccggtacctaacgttaccgaaccggtccgtaaaccggtaccggttaccggtaccgtaacggttaccggtttaacggtaaacccggtttacgggtttttaacccgaacccgtttaaaccgttttaaccggtacccggttaaccggtaaacggttaacggtacgttaaaccgttaaacgttaaacgtttaaccgttaacggtttacccgggtaaacggggtaccgggggttaaaaccgggtaaaccgggttaaacggggttaacgggtaaaccggttaaccgttaaaccggtaaacgggtacggttaacgggttaacccggtcgttaacccgacgttacctacggttaacccttagggttacccttaccggttaccctttaacccgg

SEQ ID NO: 227038 - DNA, 712 bp, Homo sapiens
  misc_feature: GYAE6OF02H2V2N.15.28.C06.1.454.CMB.1.raw
  modified_base (200)..(200): a, c, t, g, unknown or other
  misc_feature (200)..(200): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgctatccgtgtcgganacagagtcaccatcacttgccggccagtcagatattaacaagtggttagcttggttcagtcaagaaacgagggaaacaccccgtaaaagtccctgaacttcctacgtcgccgtcctactttactttcgacgtaaggttcggggtaccctagtacgtaaggttacacggtcggacgtaggtacggacgttcgtacgggactaaaggtaacgttcgtaacggttaccttacccaaccgtacgtaccgaacggtacctaaccgtccccggttagaccgtaaccgtccgttaacggtaacgtttactttttacgaaccgttaaaccttttaactaccgttaagtaacctaaacggtcgtaaacgtaagtttaaacttaaacgttacgttaacggttttaccgggaaccgggtaacgggtaaaccggtaaagggtacggtaagtacgtaaccggtaaacgtaacgtacggtacgtacgtacgactactcgtaccgttagttcgttctacttaccccg

SEQ ID NO: 227039 - DNA, 767 bp, Homo sapiens
  misc_feature: GYAE6OF02GUJD4.15.28.C06.1.454.CMB.1.raw
  modified_base (102)..(102): a, c, t, g, unknown or other
  misc_feature (102)..(102): n is a, c, g, or t
  modified_base (138)..(138): a, c, t, g, unknown or other
  misc_feature (138)..(138): n is a, c, g, or t
  modified_base (158)..(158): a, c, t, g, unknown or other
  misc_feature (158)..(158): n is a, c, g, or t
  modified_base (727)..(727): a, c, t, g, unknown or other
  misc_feature (727)..(727): n is a, c, g, or t
tcagtctacgtagccacgaccggtgctcgatttagagctcacgtattgggtttgggggagtcagactcagtcaggacacagcatggacatgaggttccccgntcagctcctggggctcctgctgctctgctcccagtnccaatgtgacatccagactnaccagtctcctccgaccctgtctgcatcgtgtcggagacacgagtccaaccgatccacgttcgccgggacctaaggtcagagtacttaactaaagtgttaggtccttggttacgacgtacacgaaaccgaagggaaaccaacccgtaaaacggtccgtaccggaattccgttacgttacggccccgttacccttacttaaccgttttaggccgttaaaacggtaccggggttcccaacgttcgtaaacgggttctaacggccggtaaccgtaggtacggtacgtaccgttcggaacgtaaccgtaaattcgacgttacccttaccgaaccgtaagttaccgtacggacctaacggtcccgttacgaacgtaaccgtccgttacgggtaacttacggtttacctaccgttaaacgtactttaccgaacgtaccggttaatcgggaacttaacttaaaccgtaactttacgtacgtttccgggtaaccgtaagggtaacctaaggggtaacgtaacgggtactacggtaaaaccggtacgttaccggtggaccgtttagaccccggttaanacccgtttaggttaccctacggtttcaaccgtttccccgg

SEQ ID NO: 227040 - DNA, 887 bp, Homo sapiens
  misc_feature: GYAE6OF02HHWJR.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctggtacggagacaggagtcaaccagtccacgttcggcccgggacctaggtacaggtaacggttaatttaaacgtaaagttaggggttcgggtccgtttagggttttccaacggtacgaaaccgggaaaaacccgaaagggggaaaaaccgaaccccccgtaaaaaaggtttccctacggtaaccgttcccgttccgtacgggtcccccggtacctttacctttaaccgtttttcggaacccgttaaaacggggttacccgggggtttaccccgtaacgttaccggtaaacgggttttacccggaagggacccgggtacgtaacgggttagggtaacttcggtacgggaacgtaaggtaacgttttacgacgttcctaccgtaacctacgtaccgaaccgagtaccgtacccggttacggaccgtaccgggtaccgttaacgggtaaccgttttaggtttaacccgttaaccttaaaccggttttacccgttaaccgttacccggtagttaaccgggttactaacgttaaacttaaacgtttaaccgttacgttaccggggttttaaccgggacggggttaacgggaaaccggttaaggggacgtaaccgggtactaaacgtaaaccgggtacggtaacggtggtaccgtccggaaccgtaccgtacttcgtaccgtttactcctaccgtttacccg

SEQ ID NO: 227041 - DNA, 781 bp, Homo sapiens
  misc_feature: GYAE6OF02IRPP9.15.28.C06.1.454.CMB.1.raw
  modified_base (203)..(203): a, c, t, g, unknown or other
  misc_feature (203)..(203): n is a, c, g, or t
  modified_base (601)..(601): a, c, t, g, unknown or other
  misc_feature (601)..(601): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccgaggtgccaaatgtgacatccagatcgacccagtcctccgtcccaccctgtctgcactcgtgtcgganacgagtacgtccacctatccacgttcggccgggacctagtaccgaaggtacttacgttaaactaaaggttggttacggtccgtttcggtttacgaacggtaccaaacggaaaaccggaaacggggtaaaacccggaacccccgtaaaaacggttcccgttaaggtaaccttccgtaccgttaccggtccccgttacccgttaccgtttaccgtttacggaacggttaaacgggtccgggttaccctaacgttacgtaaccgggttacgacggtaccggtacgtacggttacggtacgttacggtacgggaacgtaacgttaacgttacgtacgttacctaccgacctacgtaccgaacgacctacgtccgtaacgcgtaacgtccgtagttaccgttnttacgtaacttaacgttacgtacgtaccgtacgtaagtacacttaactaaacgtttctacgtacggtttaccgggaggtaaccggtaaggtaacgtggaacttaccgtaacggtaacggtacgttgtaccggtcacggtaacctaccgtagtccgttccttacgttacctccgttacccg

SEQ ID NO: 227042 - DNA, 594 bp, Homo sapiens
  misc_feature: GYAE6OF02GOG1W.15.28.C06.1.454.CMB.1.raw
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (450)..(450): a, c, t, g, unknown or other
  misc_feature (450)..(450): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccgaggtgccaaatgtgacagtccagatcgacccagtcctccgtccaccctgtctgcatctgtcggagacagactccacctatcacttcggccgggcagtcagtactattactaagtggttcgctgttcagcaagaaccgaagggaacacccgaagtccngtatctctcgccgcctctacttgacgtaacggtcgggtaccatacgtaacgtcgnggcgcgtaggtgatcgtaggacagtaatcgtactctcacctacncacgnccgctcgcactcacgtagtacttcgaaccttactactacgtcgacgtaacgtnaccttaataaacttacgtacgttacggttacgggacgggtaaccgacgggtaaggtacggtagtacctaacggaaaccgtacggttcggacggtaccgtcgaccgtacgtaccttacgtcctacccgtaccgttccttaccccg

SEQ ID NO: 227043 - DNA, 701 bp, Homo sapiens
  misc_feature: GYAE6OF02H7EFU.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaaatgtgacatccagatgaccagtctccgtccacctgtctgcatctggccggagacagacgtcaaccgatccattcggccgggcagtcagagtatactaaagtggttcggcttggttcagacagaaacgaggaaacaccaaaagtcctagactctcgtcgtccgtacctacttactttacgaacgtaacgggtacgggtaccctagtaacgtaacggttcaacggtacggactacggtaggtaactacgggttagggactaaaggtaacttcgaagttcctacaaccgtacttacgagacgacgtcctacggtacacgtctacgtacgttaagtttcgtaaaccttaactttaactactacgaacgtaagtacgaactaaagttaaactaacgttaacgttaacggtttacggggaaccgggtaacgggtaaccgtaagggttaacggggtaataacccgttaaacgtaaaaccggtacggtaacggttaccggtacgtaacgtaccggaaccctaaggttaccgtttacggtttacttacccgtagtttacccccgg

SEQ ID NO: 227044 - DNA, 566 bp, Homo sapiens
  misc_feature: GYAE6OF02FQ7GN.15.28.C06.1.454.CMB.1.raw
  modified_base (179)..(179): a, c, t, g, unknown or other
  misc_feature (179)..(179): n is a, c, g, or t
  modified_base (335)..(335): a, c, t, g, unknown or other
  misc_feature (335)..(335): n is a, c, g, or t
  modified_base (370)..(370): a, c, t, g, unknown or other
  misc_feature (370)..(370): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
  modified_base (557)..(558): a, c, t, g, unknown or other
  misc_feature (557)..(558): n is a, c, g, or t
  modified_base (560)..(563): a, c, t, g, unknown or other
  misc_feature (560)..(563): n is a, c, g, or t
  modified_base (565)..(566): a, c, t, g, unknown or other
  misc_feature (565)..(566): n is a, c, g, or t
tcagtctacgtagccacgaccggtgctcgatttagagctcacgtattgggtttggggggggggggtccctgagactctcctgtgaagcctctggattcaccttgagcacttattggatgacttgggtccgccaggctccagggaaggggctgggagtgggtggccaccatacaaaaagntggaagtgacacaacctatgtgaactctgtgagtgggccattcaccgtctccagagacgacgccaaagaacctcactacatctgacaaatgaaaccaacctgaagagccggaaggacacggctggtagttattacgtgtgtagagagtatgttcgngtcggttggggaccagggacctggcaccgtctccncacgccctcaccgaagggcccagtccgtccttccccgnggcccnccgtnccgtccgacggacgcctaccgccgagacgcacgcgccggccgtcggctcgtccgtcgtacgacggtactaccgttccgacgtacgtagacgtgacggtcggcgtcggacgtaggccgacgtagtacgntcgcgacngnngnnnngnn

SEQ ID NO: 227045 - DNA, 771 bp, Homo sapiens
  misc_feature: GYAE6OF02JMZO4.15.28.C06.1.454.CMB.1.raw
  modified_base (176)..(176): a, c, t, g, unknown or other
  misc_feature (176)..(176): n is a, c, g, or t
  modified_base (303)..(303): a, c, t, g, unknown or other
  misc_feature (303)..(303): n is a, c, g, or t
tcagtctacgtagccacgaccggtgctcgatttagagctcacgtattgggtttgggggggggggtcccgtgagactctcctgtgaagcctctggattcaccttgagcacttattggatgacttgggtccgccaggctcagggaagggctggagtgggtggccacataacaaaaagntaggaagtgacacaacctatggtgaactctgtagagtcgggccgtattcaccgtctccaggacgacgtcgaccaaagaactcactacatctgacaaatcgaacaacctgagagacgaggacacggtntgtgtattacgtagtggtgagagtagttgttacgtggtcgggtttggggaccgtaaccggggtaaccctgggtaccccgtaccggtccttaccgtacgtacccggtcccgttaacccgacccggtaaacggggcccctaacgtttcccgggttaccccgttccccccgtacgggtcccggtccccgtacggtacccgtaccggtaccgggtaacgtacccgtaccccgttaaccccgggacgtaaccggacctaacgaaccggcccgggtcccgtcgggcgtccgtaccggttcggtaaccgtaacggtaccttaacggttcccgtaacgttaccggtaaacgttacccgtacgggtaccgtacgggggttaccgtacggggtaccgaacccggggtacccgaacggtacgtaaccggtagttaccgccggtaaacgcgtacggtccggacgtacgtcgtcgtcgtcg

SEQ ID NO: 227046 - DNA, 741 bp, Homo sapiens
  misc_feature: GYAE6OF02HHP4W.15.28.C06.1.454.CMB.1.raw
  modified_base (680)..(680): a, c, t, g, unknown or other
  misc_feature (680)..(680): n is a, c, g, or t
  modified_base (698)..(698): a, c, t, g, unknown or other
  misc_feature (698)..(698): n is a, c, g, or t
tcagtctacgtagccacgaccggtgctcgatttagagctcacgtattggggtttgggggagtcagactcagtcaggacacagcagtggacatggacgggtccccgctcagctccgtggggctcctgctgctcgtggcctcccgaggtcgacctaaagtggtagaccactccaagtactaccgaccctaggttccctacccgtccctaacccttggtacctgacctagttccgttacgggtacggaacgaccgaacggtacgtacccgtaaccgacttaccgtaccggttaccgggacccggtaccgtaagtacgaacggtaagttaacttaaacgtaaaggttcgggttacggtaccgttaggttaccaaggaactaaacggaaaaccgaacgggaaaaccgaaaccccgtaaagtcgttaagacttccgtcgacgtcccgtaccttacttacgtacgacggtaaacggtcggtaacctagtacgtaagtacgacgacggtacgagtcgtacgcggacgaatagtactacgacgttacacgtacacgtacgaacgtacaccgtccgtacgacgttacggtaccgtaggtaacttacgttaacaccgtttaactacgacctagaaactagtctaacgttaataactcgtacgttaacgcggaacgtaacggagtaggacanacgtaacgagtagcgtanaccgtaccgataccgttgtacgtaccgtcgtactaccgtaccg

SEQ ID NO: 227047 - DNA, 763 bp, Homo sapiens
  misc_feature: GYAE6OF02HXKKR.15.28.C06.1.454.CMB.1.raw
  modified_base (200)..(200): a, c, t, g, unknown or other
  misc_feature (200)..(200): n is a, c, g, or t
tcagtctacgtagccacgaccggtgctcgatttagagctcacgtattgggtttgggggagtcagactcagtcaggacacagcatggacatgaaggtccccgctcagctccgtggggctcctgctgctctggctcccaggtgccaaatgtgacatccagatcgacccagtctccgtccaccctgtctgcatctgtcggaanacgagagtacaccatcaacgttcggccgggaccagtacacgtagttaacttaactaaaagtgggttcggtaccgttaggtttccagacaagaaaccgaacggggaaacaaccccgaaaagtccctagactccgtacgttcggacccgtccttaccgtttactttacgaacgtaaacggttccggggtacccctaagtaccgtaaacgggttcacgggtaccggacgtaggtacggtacgtacggtacgggtaacaacggttaaactttcgtaacgttccgtaacctaacccgtaagtacgtacgaccgtacggtacccttaggaccgacggtacccgttacggtaaccgtttaacgttttaccggaaccttaaaacttttaccttaaccttacgaacccgttaaagtaccgaattaaattaaacgttaactacggttaacgtttccgggaacgggtaacgggtaacgtaaagggtagaacgtacgtaaccgtaaacgtacggtaggtaccggtacacggtacctaccgacgttaccttagttaccttaccgtaccttaccccg

SEQ ID NO: 227048 - DNA, 693 bp, Homo sapiens
  misc_feature: GYAE6OF02GUCE3.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcgagacagagtcaccatcacgttcgccgggccagtcagagtattacgtaaatggttggccttggttcagcaacgaaaccgaagggaaacgaccccgaaaagtcctagactctactcgccgcctcttacttgactaaaggtcgggtacctacgtcgtaacgttcgagcggacgagtggacgttacggtagggaactaaggtaattccgaaggttcctacgaacctaacttcgaacgtccaacggtcctacggaccgtaacggtccgtaacgtaccggttaacgttttcgaactttaaacgttaccgttaacttacggaccttaagtacgaacttaaaacgttaacttaaacgttcgtttaaacggttccggggtaacggggtaacggtaacccggttaaagggtaagggaacgttacggaaccgtaaacgggtgttaacggtacggtaccgtaccggtaccacgtttacgtccgttacggtttccttaccgtacgttaccccc

SEQ ID NO: 227049 - DNA, 523 bp, Homo sapiens
  misc_feature: GYAE6OF02FOX4H.15.28.C06.1.454.CMB.1.raw
  modified_base (404)..(404): a, c, t, g, unknown or other
  misc_feature (404)..(404): n is a, c, g, or t
  modified_base (487)..(490): a, c, t, g, unknown or other
  misc_feature (487)..(490): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (498)..(499): a, c, t, g, unknown or other
  misc_feature (498)..(499): n is a, c, g, or t
  modified_base (501)..(501): a, c, t, g, unknown or other
  misc_feature (501)..(501): n is a, c, g, or t
  modified_base (503)..(523): a, c, t, g, unknown or other
  misc_feature (503)..(523): n is a, c, g, or t
tcagtctacgtagccacgaccggtgctcgatttagagctcacgtattgggtttgggggggaagaggaagactgacggtcctgccacaggtggtgctggagtgggtggccaccatacaaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagattgttctggtcggttggggccgtagggaaccccttggtccgtacccgtctccgtcacggtccctccaccggaacggccccaaggtccggttcccttcccccgtggcccgtcccctgacctccgaggacgtcctaccctcggagcncacgcggcgccgtggctcgccgtgtacgaacgcttacgtcgacgtacgtactcgtgacggcggcgtaggcgacgcgacagtannnncgncngtnnangnnnnnnnnnnnnnnnnnnnnn

SEQ ID NO: 227050 - DNA, 708 bp, Homo sapiens
  misc_feature: GYAE6OF02GJ2X2.15.28.C06.1.454.CMB.1.raw
  modified_base (101)..(101): a, c, t, g, unknown or other
  misc_feature (101)..(101): n is a, c, g, or t
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
  modified_base (557)..(557): a, c, t, g, unknown or other
  misc_feature (557)..(557): n is a, c, g, or t
tcagtctacgtagccacgaccggtgctcgatttagagctcacgtattgggtttgggggagtcagactcagtcaggacacagcatggacatgagggtcccgntcagctcctggggctctgctgctctggctccaggtgccaaatgtagacatccagatgaccagtctccgtcacctgtcngcatcngtcgagacagacgtcaccatcacttcggccgggcagtccgaagtacgtatttaacgaaagttcggttcggcctggtttcagtacgagaaaaccgagggtaaacgaccccgaaaagtccgttagacgtctacgtcggtccgtcctctaacgtttggacgtaaaacgggttcggggttaccctaagtaccgtaaaggtttacgaacggccggacgtaggtacggtacgtaccgggttaggggaaacaacgggttaaacttccggtaaacgtccttaaccgaccctaagtcgacgtacgtacggccgttagacgacggtcctagtaaccggtagtttacgacgttaacctttacgtaccttacgacgtaacggtntaacgtaagtaataacgtttaccgtaaggtttccgggtaacgggtaacgggtaaaccgtaagggttcgggaaccggtactacggaaaccgtagtaggtaccgggtattacggacaccgtacgtacgtacgttccgttacacggtttacccc

SEQ ID NO: 227051 - DNA, 899 bp, Homo sapiens
  misc_feature: GYAE6OF02JLFFF.15.28.C06.1.454.CMB.1.raw
  modified_base (819)..(819): a, c, t, g, unknown or other
  misc_feature (819)..(819): n is a, c, g, or t
tcagtctacgtagccacgaccggtgctcgatttagagctcacgtattgggtttggaggtctcagagaggagccttagccctggactccaaggcctttccacttggtcgatcagcactgagcacagaggactcaccatggaagttggggctgagcgtgggttttccttgtgactatcttaaaggtgtccagtgtgagtgcgtaggtggtggaggtcggtgggggacgtccgttaggtaaacggtccggtcggggggtacccttaggacggttcttccgtggtcggtcggccttccgtggtacttcctactttactaagtaacgttcggtcgtggtagtaggtacgggttcggggtacccggtaccgtacgggtccgttacccgggacgggggtaacgggggtaccggtaggggtacgggttcgggggtttacgggttaaaccggttttaaacgtaaaaaacgggttaaaaaggttcgggttaaagttacggggtaaggtaaaacggtaaaacggtaacgggtaacggtaacgggtaccggtaacccggtaacccgggtaaggggtaaaacggtaacggttaacgttaccgtaaaccgtacgttacgtaaaccggtaaggtaacggttaaacttaaaacggttaaaccggaaaaaccggttccggttaagttacgtttaacgaaccgtaaaaggttccggaaaccgtaacgtaaccgggttaagaaaaacccggtaggtaacctaacgggtacggttacccttacgttaacttaccgtaaccggttaaccctaaacggtacgtaaggttaccggtaacgtntacgacggtaacggtaaacggaagggtccgtattaaccggtgttaaccggtttcgacgttacggtccgtacgggtaaccg

SEQ ID NO: 227052 - DNA, 530 bp, Homo sapiens
  misc_feature: GYAE6OF02G8GKF.15.28.C06.1.454.CMB.1.raw
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (507)..(507): a, c, t, g, unknown or other
  misc_feature (507)..(507): n is a, c, g, or t
  modified_base (523)..(530): a, c, t, g, unknown or other
  misc_feature (523)..(530): n is a, c, g, or t
tcagtctacgtagccacgaccggtgctcgatttagagctcacgtattggggtttggggggggggggtccctgagactctcctgtgaagcctctggattcaccttgagcacttattggatgacttgggtccgccaggctccagggaaggggctggagtgggtggccaccataacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgtctgcgttggggccagggaccctggtcaccgtcncctcngcctccaccaacgggcccagtccggtccttccccctggcccgccctgcctccgaggacgccacctccgagcgcacacgccggcccgtgggctcgcccgtggtaccgaaggtaccttacgttcccggacttacgtacgacgtgacgcgggcngggcaggcgcagtagnnnnnnnn

SEQ ID NO: 227053 - DNA, 779 bp, Homo sapiens
  misc_feature: GYAE6OF02FT01C.15.28.C06.1.454.CMB.1.raw
tcagtctacgtagccacgaccggtgctcgatttagagctcacgtattgggtttggggagtcagactcagtcaggacacagcatggacatgagggtccccgctcagctcctggggctcctgctgctctggctcccaggtcgccaaatgtgacatccagatcgacccagtcctccgtccaccctgtctgcatctgtcggagacagagtccaccatcacttcggccggcagtcagtagtattaactaaagttggttggcttggttcagacaacgaaaccgagggaaaccgacccgaaaagtcctagatctcgtcgccgtcctctactttcgacgtaaacggtcgggtacctagtacgtaacggttcgacggcggacgtaggtacggtacgtacggtagggaacgtaagtaacgtttaccgacgttacctaccgtaccgtaacgtccgacgtaccgacggtacctagacccgtacggtacccgttaacgggtaccgttaacggttttacgaacccgtttaaaccgtttaccttaaccgttaccggtaaccgtaaaggttaccgtaaacgttaaacttaaaaccgtttaaccgttaaccgtttaacgggttttaccggggaacgggggtaaaccgggttaacccggtaaagggggttaccggtaacggtaacgttaaaccggtaaaacggttaaccggtacggttaccgggtaaccgtaccgtaaccgtaaccgttaccggttcctttaccgggtttacctttacccggtactttaccccccgg

SEQ ID NO: 227054 - DNA, 652 bp, Homo sapiens
  misc_feature: GYAE6OF02GT0IX.15.28.C06.1.454.CMB.1.raw
  modified_base (414)..(414): a, c, t, g, unknown or other
  misc_feature (414)..(414): n is a, c, g, or t
  modified_base (458)..(458): a, c, t, g, unknown or other
  misc_feature (458)..(458): n is a, c, g, or t
  modified_base (510)..(510): a, c, t, g, unknown or other
  misc_feature (510)..(510): n is a, c, g, or t
  modified_base (543)..(543): a, c, t, g, unknown or other
  misc_feature (543)..(543): n is a, c, g, or t
  modified_base (561)..(561): a, c, t, g, unknown or other
  misc_feature (561)..(561): n is a, c, g, or t
tcagtctacgtagccacgaccggtgctcgatttagagctcacgtattgggtttggaggtctcagagaggagccttagccctggactccaaggcctttccacttggtgatcagcactgagcacagaggactcaccatggaattggggctgagctgggttttccttgttgctagttttagaaggtgtccagtgtgaggtgcaactggtggagtcgtgggggagtcctcggtccaggccgggggggtccctggacgtacgtcctccgtggtagaacggcctcgtaggtacttctaacccgttgacggtccaacgttaacgttggagttgacgtttggggtcccggtacccaagggtccttaccgaggggaacggggctgggagtcgggggtgccctaacggaactaacgaaaaacgngttacggagtagaccgtacgaacttagtcgtagaacttcaagtnagtcgggaccgattcgaaccgttcgtccaaggtcgaacgaccggtaccaaanacgtccaactacaagtctagaccaaatcgaaanacctagagactcgagacncggactgttactagtacttcgagtaggagtaacacggttcttacggcgttacggttcggggccttaaggggaccctcggttaccaacccgg

SEQ ID NO: 227055 - DNA, 655 bp, Homo sapiens
  misc_feature: GYAE6OF02JQZUH.15.28.C06.1.454.CMB.1.raw
  modified_base (174)..(174): a, c, t, g, unknown or other
  misc_feature (174)..(174): n is a, c, g, or t
  modified_base (500)..(500): a, c, t, g, unknown or other
  misc_feature (500)..(500): n is a, c, g, or t
  modified_base (600)..(600): a, c, t, g, unknown or other
  misc_feature (600)..(600): n is a, c, g, or t
  modified_base (638)..(638): a, c, t, g, unknown or other
  misc_feature (638)..(638): n is a, c, g, or t
tcagtctacgtagccacgaccggtgctcgatttagagctcacgtattgggtttggggagtcagactcagtcaggacacagcatggacatgacgggtccccgctcagctcctggggctcctgctgctctggctcccgaggtgccaaatgtcgacatccagactgacccagttccnccgtccacccttggtctcgacacttgtgtcggaagtacaggtactaccaccacttacgtactgggcccgggaccctaggcgtaagattaacttaactaaggttggtcggtccttggttcacgagaaaccggaacggtagggaaaccctacccgaacgtcgtacgacttccgtcgcggtacctcctttctttaaccgtagtaaccggtaacggttccggtcctagtaaccgtaacggttcgaacggtcggacgtagtggtactcggaaggctaagtcttacgacgtctaaccggctagtacgacgtacacggtctacgcctacggtntcgtaaacttccggttactaaccgttaacttactcgggccaacttaggtacaacgttaataactattccttcgggaacgggtagaccgttaagacggtanaactgttaaccgaatcggttagcgactcgaccattcgnttacttctacgtcctcg

SEQ ID NO: 227056 - DNA, 840 bp, Homo sapiens
  misc_feature: GYAE6OF02IZI3W.15.28.C06.1.454.CMB.1.raw
  modified_base (66)..(66): a, c, t, g, unknown or other
  misc_feature (66)..(66): n is a, c, g, or t
  modified_base (783)..(783): a, c, t, g, unknown or other
  misc_feature (783)..(783): n is a, c, g, or t
tcagtctacgtagccacgaccggtgctcgatttagagctcacgtattgggtttggagggtctcagngaggagccttagccctggactccaaggcctttccacttggtgatccagcactgagcacagaggactcaccatggtaagttggggctggagtcgtttcgggttttccttggttcgtacttaattttaaggaaggttcgtcccgtagtgtggtacggtgctaacgtgggtggtagttcgggtgggggacggcccgtcggtaccgacggggtccggggggttccctaggacgtcgtccgtcgtcggtacgtaccgtccgtacgtaggtacttcctaccgttggacgtcgttaacttagttaggacgttacgtacggttccgggtacccgcgtacggtccgtacggaagggtaaccgggtgtaggggtagtcggggtcgacccgaaccgtaaagtaaaaccggtaaaaggtagtagggaaaccgttacggaaacgtacccgtaacgtttaaggtacgtaacgttcccggttagtacggttacggtaacgggttaccgggaccgtttacgtaacccggtacccgttaccgtaaccggaacggaaccccgtaaacgccccgaaacgtaaaccgtaacctaccgtaccgaccttaacggttacacgtaaaccgtaagtaaccaaccgttaaccggcgaacggtaacccggtaacggacgtaaccccgtgtaacggttgttaacgtcctttaacggcggtttacgaggtaaggtacttacggttnttccggttaacggcgggttaccgggtaccgaaccggtttcggccgttacccgtcccg

SEQ ID NO: 227057 - DNA, 780 bp, Homo sapiens
  misc_feature: GYAE6OF02GFVW0.15.28.C06.1.454.CMB.1.raw
  modified_base (190)..(190): a, c, t, g, unknown or other
  misc_feature (190)..(190): n is a, c, g, or t
  modified_base (220)..(220): a, c, t, g, unknown or other
  misc_feature (220)..(220): n is a, c, g, or t
  modified_base (482)..(482): a, c, t, g, unknown or other
  misc_feature (482)..(482): n is a, c, g, or t
tcagtctacgtagccacgaccggtgctcgatttagagctcacgtattgggtttggggagtcagactcagtcaggacacagcatggacatgagggtccccgctcagctcctggggctcctgctgctcgtggcctcccaggtcgaccaaatgtagacatccagatcgacccagtcctccgtaccacctgtcngctatctggtcgaagacagacgtcaacctntactacgttcggccggcagtcaagtaagtaacttaacgtaagttcggttcggtccgttaggttacacgtaacgaaacggaaaaccggtaacgggaaaaccgaaccccgtaaaagtccgtaagtacgttaccgtacggtccgaccgtaccttacgttacgtacgtaacgtaacggtcggtacctagtaacgtacggtacacggtcgtagtacggagtatcggtacggaacagttaactacgtacgttacctaccgaccgtaanacccgtaggacctacgccgtagacctacggtacgtacggttaacgtaaccttacgaaaccttaacgttaaccgtaaccgacggtaaccttaaaggtaccaaagttaacttaaaacttacgtttacggtaacccgggtttaacgggacccgggtaaacggtaaacggtaacgggtacgtaaaccgttaacgtaacccgtaaaagggttcccggtaagggtacccgtaacccggttacgaacccgttaccgttaaccgttacggttaaccgtttaacttaccggtaccctttaaccccgg

SEQ ID NO: 227058 - DNA, 625 bp, Homo sapiens
  misc_feature: GYAE6OF02JBFQO.15.28.C06.1.454.CMB.1.raw
  modified_base (359)..(359): a, c, t, g, unknown or other
  misc_feature (359)..(359): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatctgtcggagacagagtcaccatcacttgccgggccagtcagagtattaacgtaagtggttagccgtggtttcagcagaaaccgagggaaacgaccccaaaagtcctagatctcgtcgcccgcctcttacttcgacaaggtcgggtacccagtcgtaaggttcgagcgganagtggtatcggtaggactagtaacttcgtagtctaccacctactcgagccgacgtccgtacgctacgtaccgtacgtaacgtttactttcggaaccttaaactttaccgtacgtcgaccgtaagtcgtaactaagttaactacgtacttacggttacgggacgggtaacggacggtaaggtagggacgtacgtaacgaaaccggtagttacgggacgtcgtacgaccctacgtacttccgtacggttcttaccgtcgtttaccccg

SEQ ID NO: 227059 - DNA, 756 bp, Homo sapiens
  misc_feature: GYAE6OF02JUYW4.15.28.C06.1.454.CMB.1.raw
  modified_base (179)..(179): a, c, t, g, unknown or other
  misc_feature (179)..(179): n is a, c, g, or t
  modified_base (696)..(696): a, c, t, g, unknown or other
  misc_feature (696)..(696): n is a, c, g, or t
  modified_base (734)..(734): a, c, t, g, unknown or other
  misc_feature (734)..(734): n is a, c, g, or t
  modified_base (739)..(739): a, c, t, g, unknown or other
  misc_feature (739)..(739): n is a, c, g, or t
  modified_base (746)..(746): a, c, t, g, unknown or other
  misc_feature (746)..(746): n is a, c, g, or t
  modified_base (749)..(749): a, c, t, g, unknown or other
  misc_feature (749)..(749): n is a, c, g, or t
  modified_base (752)..(752): a, c, t, g, unknown or other
  misc_feature (752)..(752): n is a, c, g, or t
  modified_base (755)..(755): a, c, t, g, unknown or other
  misc_feature (755)..(755): n is a, c, g, or t
tcagtctacgtagccacgaccggtgctcgatttagagctcacgtattgggtttgggggggggggtccctgagactctcctgtgaagcctctggattcaccttgagcacttattggatgacttgggtccgccaggctccgagggaaggggctggagtgggtggccaccataacaaaaagnagggaagtgacacaaacctatgtacgaacttctgtgagtcgggccgtattccaccggtcctccgaggacggaacgaccgccaaaggaacctcaacctaacgatcctgacaaaagtcgaacctaaccgtgaacgacggacccggaaggtaccacggtcgtgtacggttaacttcgtgtcgggtagagacgtattcggtcgtcggtgggtttacgggaccggaacggtacccgttggtaccacccggttcctacccgaccgtacgtccccgtacgaacccggtaacggccccttcggtcccgtttaccctccccggtacgggtcccttacccgcggtccccaccggtacgggacccgtccgaccccgttaccggacgacccgtccgaaacggtacccgggtcccgggacccggttccgggtcccgttcgggtacccctcggggaacccgtaaccggtaccgtttacccgttaccggtaacggtaacccgtacggttaccgtcgggaacggttcccgggngttaccgggtacgaaccgggccgtacggtaacgcggtnacggncgtgcgngangcncgnc

SEQ ID NO: 227060 - DNA, 786 bp, Homo sapiens
  misc_feature: GYAE6OF02I285S.15.28.C06.1.454.CMB.1.raw
  modified_base (501)..(501): a, c, t, g, unknown or other
  misc_feature (501)..(501): n is a, c, g, or t
tcagtctacgtagccacgaccggtgctcgatttagagctcacgtattgggtttggggggagtcagactcagtcaggacacagcatggacatgagggtccccgctcagctcctggggctcctgctgctctggcctcccgaggtcgaccaaatggtgacatccagatcgacccagtcctcccgtccaccctgtctgctactcgtggtcggacgacgagacgtccaccactacgtaccgttcggcccggggccagtaccaggtacgttaattaacgtaaagttcggttcggtccgttacgggttcaggacgaacggaaaccgaagggaaaccgacccgtaaaactcctagtactctcctcggtcctcctaccttagttcgacgtaacggtccgggtacctagtaccgtaacggttacgacggtcgacgtaggtcggtacgtacggtacggtaactaaggtaacttcgtacgtcctaccactaacgtcgacgacgtaccgtccgngaccgtcgtacgtacgtacgtttacgttaccgtaaccgtttaacttacgttaaccgtccgtaaaccgttaaggtaccgtaaacttaaaccgtaaacttacgtttaaccgttagggttacccgggaacgggttaaacccggggtaaacggtaacgggttacgggtaaacgttaaccgtaaacgggttaaaccggtacggttaccgggtacgtccggtaaaccgtacccgttaacgttacggttacccgtttacggtttacccttaaccggttccctttacccccgg

SEQ ID NO: 227061 - DNA, 743 bp, Homo sapiens
  misc_feature: GYAE6OF02JJN3Y.15.28.C06.1.454.CMB.1.raw
tcagtctacgtagccacgaccggtgctcgatttagagctcacgtattgggtttgggggagtcagactcagtcaggacacagcatggacatgagggtccccgctcagctccgtgggctcctgctgctctggcctcccaggtgccaaatgtgacatccagatgacccagtcctccgtcccacccttgtctgctatctgtacggagacagagtaccacatctacgttcggccggcagtcagtagtattaacgtaagtggtgtccgttgttcgagacaacgaaccgaggaaaccgacccaaagtcctagtactcgtcgtcgaccgtcctacttacgttacgacgtaaggttcggtaccctagtacgtaacggttacgacggtcggtacgaggtggacgttcggtacgggaacgtaacgtaacttacgacgttaccgtaacctaccgtaacgtacgacgacgtacgtaccggtacgaccgtaccgtccgtacgtaaccgtttacgtttacgtaacccttaaaccgtttacctaaccgttaccgtaaccgtagttaccgtaacttaaagttaaaccgtttaacgttaccgttaccgggttaaccgggtacggggaaccgtaacggtaaacgggtaccggtaaagtacgttaaaccggaaaccgttacgggtacggttacggtaccgaaccggttaccgtaccgttaccgtttaccgttcccgttaccgtttacctaccccgttaccccg

SEQ ID NO: 227062 - DNA, 762 bp, Homo sapiens
  misc_feature: GYAE6OF02F89XH.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtcccaccctgtctgcatctgtcggagacagagtcaccatctacgttggccgggccaggtcagagtattaactaagtggttggtccttggtttcagacaacgaaaccgaagggaacgaccccaaaagtccagtatctcgtcgccgcctctacgttgacgtaaacggtcgggtacccagtacgtaacggttcgacggacggtacgtacggttacggtaacgttccggtaggggtaaccgtaaacggtaaacgtttaccgtaacggttaccctacctaaaccctaacgttaccgaacggtaccgtacggttaacccgtcgggaccgtaacggtaccgttaccggtaaccggttttaacgttttaccgtaaccggttaaaacccttttaaccgttaaccgttaccggtaaccgtaaacggtacgtaactaaacgttaaaacttaaactttacgttaacggttttacggggaaccgggtaacggtaaccggtaaaggtacgggaagtaacgtaaccggaaaacgtacgttaggtacgtacgtccgtaccgtacctacgtttcgttacgttccgttaccgttaccgttacccccg

SEQ ID NO: 227063 - DNA, 944 bp, Homo sapiens
  misc_feature: GYAE6OF02HS0LZ.15.28.C06.1.454.CMB.1.raw
  modified_base (193)..(193): a, c, t, g, unknown or other
  misc_feature (193)..(193): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (908)..(908): a, c, t, g, unknown or other
  misc_feature (908)..(908): n is a, c, g, or t
tcagtctacgtagccacgaccggtgctcgatttagagctcacgtattgggtttgggggggggggtccctgagactctcctgtgaagcctctggattcaccttgagcactttattggatgtacttgggtcccgccaggcctccgaaggggaaggggcttgggagtggggtcggcccaccgaataacaaaaaagngtaggaaagtgaccactaacctagtgtagaacttcgtggtagagtcgggcctattccaccgttctacgagacgaccgacgccgaaagtactcgaacctactatccgtagacaaaagtgaaaccaaccgtgagacgaccgtaggaccaggtctgttacgtatttacgnggttnggaagtagtagtttcgggttctacgggtccggggtttacggggacccgtaaccgggtaccccgttagggtcccctaccgggttaccttccccgttaacgccggttaccccgtacccgaaaccggtaaccgggtcccccttaacgggtttccccggtttaccccgttaccccccgggtcgggtacccccgttaccccggtttacgacccccggttaaccggtaaccgggtaacccgtacccggtttaaacccccggtccgggtaaacccggtaacccggtaccccgtaaacccgggtaccgggttccccggggtaaccccggtccgggggttacccgtttacccgggtacccgggtttaccggggttaacccgtaaaccgggtttaaccccgttttacccggttaccccggttacccggtttaacccggtacgggtttaacccggttaccgggttaaccgggtaccccgggttacgttacccggggtaaccgggttccgggaaccgggttaccttaacgggtccggtacgtcggaacggttacncgtaaggttcaacgtccgtaacgtccgagttcccgg

SEQ ID NO: 227064 - DNA, 895 bp, Homo sapiens
  misc_feature: GYAE6OF02GKLHS.15.28.C06.1.454.CMB.1.raw
  modified_base (101)..(101): a, c, t, g, unknown or other
  misc_feature (101)..(101): n is a, c, g, or t
  modified_base (860)..(860): a, c, t, g, unknown or other
  misc_feature (860)..(860): n is a, c, g, or t
tcagtctacgtagccacgaccggtgctcgatttagagctcacgtattgggtttgggggagtcagactcagtcaggacacagcatggacatgagggtcccgntcagctcctgggctcctgctgctctacggcctcccgaggtcgacctaaagtggtcgaacactaccgaaggtattacggacccctaaggttcccttaccccgtaccgtaacccccgttgtaccgttcggacctacgttcgttacggggttaccgggaacgtaaccgtaacggttaccgttacccgaaacctaacgtttaccgacggggttttccgggaccccggggtacccctaaggttccgaaacgggttaacgttaaaccgttttaaacgttaaaacgggttccgggggttttcggaccccgtttttcggggtttaaccgaacggaccgttaaaaccggaaaaaccggtaaaccgggggaaaaccggttaaaccccccgtaaaaggttccccttaacggtaagttcccgtaccggttaaccgtccccggttcctttaacggtttaaccgttaggaaccggtttaaacgggtcccgggtaacccttagttaacggtacggttacgtacgggacgtaccgtaggtacgtacgttacggaacggaacacgttacgtacacggttccaaccgacctagtacccgtacgtaccgacggttccgtaccgtaacggtaccggtccgtacggttaacgttacgttaccgtaaccttaccggtttaacctacggtaccgtacgtactacgactaacgtacttaacgttcgtacgtacggacgggtaacgacgtacgtggactacgtaacgtacgtacgcgtcggtancctacgtactacgtagtacctctacgtccttaccg

SEQ ID NO: 227065 - DNA, 738 bp, Homo sapiens
  misc_feature: GYAE6OF02I82RJ.15.28.C06.1.454.CMB.1.raw
  modified_base (177)..(177): a, c, t, g, unknown or other
  misc_feature (177)..(177): n is a, c, g, or t
  modified_base (708)..(708): a, c, t, g, unknown or other
  misc_feature (708)..(708): n is a, c, g, or t
  modified_base (717)..(717): a, c, t, g, unknown or other
  misc_feature (717)..(717): n is a, c, g, or t
  modified_base (727)..(727): a, c, t, g, unknown or other
  misc_feature (727)..(727): n is a, c, g, or t
tcagtctacgtagccacgaccggtgctcgatttagagctcacgtattgggtttggggggggggggtccctgagactctcctgtgaagcctctggattcaccttgagcacttattggatgacttgggtccgccaggctccgagggagggctggagtgggtggccacataacaaaaagntggaagtgacacaacctatgtagaactctgtgatgggccattcaccgtctccagagacgacgccaagactcactacatcagacaaatgaaacacgtgagacgccgaggacacggctgtgtattactgtagtgagagtattggttctggtcgggtttcgggggaccaacgggggtaaccccttgggacctaccgttcctcctacgacgtccctaccgaaccgaacgggcccctaaggttccggttccccttccccgtggcccgtaccctcggtaccctccggacggaccgacccgtaccccgtaccggtaacgacgtaccgaaccggaacgggtccccggtacccgggtacgggttccttaccgggtacccgttaccggggtaacccggtaaaaccgggttaaccccgtttaccggtttaaccccggtaaccgtttaaaccgggtacggtaaccgttcggggaaacccggggtccggggttaccgtaccgggacgggtaaccgggtccgtaacgtacggttaaggctaacgngttacgacncgtaactggngcgtcacgacg

SEQ ID NO: 227066 - DNA, 781 bp, Homo sapiens
  misc_feature: GYAE6OF02HRKAA.15.28.C06.1.454.CMB.1.raw
  modified_base (103)..(103): a, c, t, g, unknown or other
  misc_feature (103)..(103): n is a, c, g, or t
  modified_base (129)..(129): a, c, t, g, unknown or other
  misc_feature (129)..(129): n is a, c, g, or t
  modified_base (603)..(603): a, c, t, g, unknown or other
  misc_feature (603)..(603): n is a, c, g, or t
tcagtctacgtagccacgaccggtgctcgatttagagctcacgtattgggtttgggggagtcagactcagtcaggacacagcagtggacatgagggtccccgntcagctccgtgggctcctgctgctcnggctccaggtgaccaaatgtgaacatccgagatcgaccctagttcctcccgtccacccttgtcctgactatcgtggtacggagacaggacgtcacctatccgtcgtcggacccgggtcctaagtccaacgtaggttaactttaacgtaaagtcgggtttacggtccgtttaggtttcgaagtaccgtaacggaaaaccggaacgggaaaaccgtaaccccgtaaaagtcccgtagacttccgtcgtccggtacccgtccgttcgtttaaccgttcgaacgttaacgggttccgggtacctacgtacgtaagttacgacggcgtagtaacggtgtacgttacggaggaacgtagtaacttcgtaacggttctaccacgtaactccgaatcccgaagtcccagaccgtcgtaaccgtacgtacgtttaacgttacgaacccgttaacgttaaccgttacgttacaacgtaacggtnttaaacgtaaagttaaagtttaccgtacgtttaacgggttaccgggaacgggtaacggtaacggtaaagggtgtaaccggttaacgtacccggtaaaacggtaaggtcggttaacggtacgttacgacccgttaatccggttacccgttaagtccctttacggtaccgtttacccccg

SEQ ID NO: 227067 - DNA, 626 bp, Homo sapiens
  misc_feature: GYAE6OF02H4J7U.15.28.C06.1.454.CMB.1.raw
  modified_base (100)..(100): a, c, t, g, unknown or other
  misc_feature (100)..(100): n is a, c, g, or t
  modified_base (367)..(367): a, c, t, g, unknown or other
  misc_feature (367)..(367): n is a, c, g, or t
  modified_base (554)..(554): a, c, t, g, unknown or other
  misc_feature (554)..(554): n is a, c, g, or t
tcagtctacgtagccacgaccggtgctcgatttagagctcacgtattgggttggggagtcagactcagtcaggacacagcatggacatgagggtccccgntcagctcctggggctcctgctgctctggcctcccaggtcgacctaaagtgtgacataccagatcgaccctagtcctcccgtccaccctgctgctattctggtacggagtacagtacgtcaactatcctacttcggccgggcagtcagtattattaaactaaggttggttacgtcgttaggttcagtacaacgaaacgaggaaaccacccaaagtccagctcgtctcgcctcttactactgaactaggtcggacctagtacgaggtcnggcgtctaggtcgtacgtcggtacggaataacgtacgttacgacgttacctacgaacctagtacgacgtacgaccgtctacggactacgttccgtacgtaattacgttacgaaccttacgtactacgtcgaactagctaataataaattcgtacgtacggttaccgggagtaaccgggacgtaaggngaactaacgtacgtaaacgcgtcggtcgtactacggacctacgtactaccgttcgtccttacgacttccccg

SEQ ID NO: 227068 - DNA, 639 bp, Homo sapiens
  misc_feature: GYAE6OF02G11V5.15.28.C06.1.454.CMB.1.raw
  modified_base (630)..(639): a, c, t, g, unknown or other
  misc_feature (630)..(639): n is a, c, g, or t
tcagtctacgtagccacgaccggtgctcgatttagagctcacgtattgggtttgggggggggggtccctgagactctcctgtgaagcctctggattcaccttgagcacttattggatgacttgggtccgccaggctccgaggggaaggggctggagtgggtggccaccatacaaaaagatggaagtgacacaaacctatgtgaacttctgtgagtgggccgattcaccgtctccagacgacgacgccaagaactccaactacatctgacaaatagaacaactgagagccgaggacacggctgtagtattactgtgtggagagagtcgttcgtggtccgggttggggaccgtaacggggacccttcgggtccctaccggttcctcccgtcgaccgtccctaccccacccggtaaccgggcccacgttccgggtaccctttccccccggtggcccgtcccgtcgcccgtccgtaacggaccgccacccgtccggaacgtacgaccgaacgccgggtaccggccccggtcgggtcgtccggtaccgtgggtaccgtaaccgggtacttaccgttacccggtacgtaccgtacgacgtggaccgggtcggtcgcggacgtggacgcatcggtannnnnnnnnn

SEQ ID NO: 227069 - DNA, 559 bp, Homo sapiens
  misc_feature: GYAE6OF02G6T6H.15.28.C06.1.454.CMB.1.raw
  modified_base (522)..(523): a, c, t, g, unknown or other
  misc_feature (522)..(523): n is a, c, g, or t
  modified_base (526)..(526): a, c, t, g, unknown or other
  misc_feature (526)..(526): n is a, c, g, or t
  modified_base (529)..(530): a, c, t, g, unknown or other
  misc_feature (529)..(530): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(544): a, c, t, g, unknown or other
  misc_feature (538)..(544): n is a, c, g, or t
  modified_base (546)..(559): a, c, t, g, unknown or other
  misc_feature (546)..(559): n is a, c, g, or t
tcagtctacgtagccacgaccggtgctcgatttagagctcacgtattgggtttgggggggaagaggaagactgacggtcctgccacaggtggtgctggagtgggtggccaccatacaaaaaagatggaagtgacacaacctatgtgaactctgtgatgggccgattcaccgtctccagagacgacgccaagaactcactacatctgcaaaatgaaacaacctgagagccgaggacacggctgtgtattactgtgtgagagatgttctgcgttggggccagggaaccctggtcaacgtctcctcacgccctccaaccgaacgggcccagtccggtccttcccccgtggcccgtccctcgcctccgagggacgccacccgtccgaaggacgccacgacggccggcccgtggggcctcggcccgttgggtaccgaaacgggtaccttaccgttcccggacgttaacggtacgacgtacggacgggccgggacgttcgggacgaacgggtccgacgtaagtaggcnncgnagnngacngncnnnnnnngnnnnnnnnnnnnnn

SEQ ID NO: 227070 - DNA, 588 bp, Homo sapiens
  misc_feature: GYAE6OF02F2BNQ.15.28.C06.1.454.CMB.1.raw
  modified_base (286)..(286): a, c, t, g, unknown or other
  misc_feature (286)..(286): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacattcagatgacccagtctccgtccaccctgtctgctatcgtgtcggagacagagtccaccatccacttcgccgggccagtcagtagtattaactaaatggttaggcctggtttcagtacaagaaaccaggaaacnccccgaaaagtcctagatcgtctgccgcctctacttgacaagtcgggtccatgtaacgtcagcgcgagtgatcgtggacgatcatctaccacatcagcagcngcngcctagacgttattcgactactactactcgaccaagtcactaagtaataacttctacggtttcggacgggtaacggtaccgaagggttacgggagtacttaaccggaaacgtaacgttcggtacggtacctaccggaccttaacccgtacgtttcgttacggttacccgtttacgtaccgttaccccgttaccccgg

SEQ ID NO: 227071 - DNA, 685 bp, Homo sapiens
  misc_feature: GYAE6OF02GURW1.15.28.C06.1.454.CMB.1.raw
  modified_base (211)..(211): a, c, t, g, unknown or other
  misc_feature (211)..(211): n is a, c, g, or t
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtccaaccntccacgttcggccgggccagtcagtatattaactaagtggttggccttgttcgagcaaacgaaacgaaggggaaaccacccgtaaaagtcctagactctcgtcgcccgtccttacttacgttacgacgtaaagggttccggggtacccctagtacgtaacggtacgacgggtacgcgtaagggtcggtacgtcgggtagggaactaagtaaacgttcgtaacttccgtacctaaccgtaactccgtacgacgaccgtcccgtagacccgtacgaccgttacggtaacgttcgtttaccggactttaaaccttaccgtacgtaccgtaaccgtagttcaaccttaaataaacgtttactacgttaccggttaccgggacgggtaacggtaccgtaaggtacgagtaaccgtacgaaacggttgagtcggtacacgtaccacgttacgttcttaccgttactactcccgttacccg

SEQ ID NO: 227072 - DNA, 808 bp, Homo sapiens
  misc_feature: GYAE6OF02FWF4M.15.28.C06.1.454.CMB.1.raw
tcagtctacgtagccacgaccggtgctcgatttagagctcacgtattgggtttggaggtctcgagagaggagccttagccctggacgtccaaggcctttccacttggtgatcagcactgagcacagagactcaccatggaattgggctgagctgggttttccttgttgcttatttagaggtgtccagtgtgaggtgcaactggtggagtcgtgggggacgcctcgtccgagggtccggggggtccctaggacgtaccgtcctccgtgtagaacgcctcgtggtacttctaccttgacgtctacgttacttaggtacgtgtacgttcgggtccgccgacggtccgtaccggaaggggtaacggggacggtagggtagggtcggggtcggacccgtaacctaacggggggggggtaaaccaaaaaggtagtaggaaggtacgacgaaccgtaaaccgtagtacgtacgtaaccgtacgtacgtaggtacggtcgggtaccgtacgttaccgtaacccggttaccgtaccgtaacgggaacggaaccggacccgtaaccgtaaacgtaacctacctaaccgtaaccgtacgtacgttacgaacaaactaccgaaaccgtaaacccgtacggtaacggacggaacccgggaacggaaccgaaccgggtaccggtacggttacgttacgttacggttacggtaggtacggtaacggtaggttacggttacggttacggttaccgggttacgggtttaccggggtacccgggtacccgggtaaccccggttaccgggttacccgttaaccccgg

SEQ ID NO: 227073 - DNA, 822 bp, Homo sapiens
  misc_feature: GYAE6OF02JKZ18.15.28.C06.1.454.CMB.1.raw
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatcgacccagtctccgtccaccctgtcctagcactctgtcggagacagacgtcaccatcctacgttcgcccgggtccagtacgagtaggttacttaaccgttaaagttcgggttcggtccgttacggttttcaggtacctaaacggtaaaaccgaacggggaaaccgaaccccccgtaaaaaggttccccttaggtaaccttaccttaccgttcgccccggtaccctttaccttaccgttttcggaaccgttaaacgggttccgggggttaccccctagttaccgtaacgggtttaccgaacggccgggtccgtaacggttcggtaacgtccgttagggaccgtaagtaacgttaccgtaacggttcctaccgaacctacgttacccgagtaccgtacgtccgtagaccgtaaccgtccgtacggtacgttaccgtttacgtaaccgttaactttaccgttacgtaccgtaccgtaacggtcacgtaaacgttaaattaaccgttacgtacggttttaccggaacgggtaaccggtaaccggtaaaggttacgggaacttacgttaaacccgaacgttaacggttaccggtagtacccgtaaccggtaacctacccgtaacgtttcgttcccggtttaaacgttcccgtaacccggtttaccccgg

SEQ ID NO: 227074 - DNA, 142 bp, Homo sapiens
  misc_feature: GYAE6OF01BYOGK.46.44.D11.1.454.CMB.1.raw
  modified_base (140)..(142): a, c, t, g, unknown or other
  misc_feature (140)..(142): n is a, c, g, or t
tcagactagcagtacacgaccggtgctcgatttagcgcagtacgatcgcggggagatcaaacgaactgtggctgcaccatctgtcttcatcttccgccatctgaacgcactcgtctgagcgggctggcaaggcgcatagnnn

SEQ ID NO: 227075 - DNA, 149 bp, Homo sapiens
  misc_feature: GYAE6OF01BD8QH.46.44.D11.1.454.CMB.1.raw
  modified_base (141)..(149): a, c, t, g, unknown or other
  misc_feature (141)..(149): n is a, c, g, or t
tcagactagcagtacacgaccggtgctcgatttagcgcagtacgatcgcgggggagatcaaacgactgtggctgcaccatctgtcttcatcttcccgccatctgaacgcactcgtctgagcgggctggcaaggcgcatagnnnnnnnnn

SEQ ID NO: 227076 - DNA, 141 bp, Homo sapiens
  misc_feature: GYAE6OF01DBZCQ.46.44.D11.1.454.CMB.1.raw
tcagactagcagtacacgaccggtgctcgatttagcgcagtacgatcgcgggggagatcaaacgagctgtggctgcaccatctgtcttcatcttcccgccatctgaacgcactcgtctgagcgggctggcaaggcgcatag

SEQ ID NO: 227077 - DNA, 627 bp, Homo sapiens
  misc_feature: GYAE6OF01EJSQ3.25.3.A03.1.454.CMB.1.raw
  modified_base (614)..(614): a, c, t, g, unknown or other
  misc_feature (614)..(614): n is a, c, g, or t
tcagactgtacagtcacgaccggtgctcgattttagagagcgtcactaggtaggggagaacgggggaggaagtagagggaatccgagaactctgggttgtctcaccatggcctggactccctctacttctcccctcctccactcctctcgcaccaggctctgaggtcctcctatgtacgctagacaaccacgccacccctggtagtcctagttgtcccccgaggtacgagaccggcctaggtatccaaccgtgcctctcggagatggccattgacccaaaacctagtactgcgttagtttccggtacctagcagtaacgtcgacggttcaggcccctggtcgacttggttcgactagtataaacgaactagtgacgacggtcccctacgtacgggactcccgtgacgcgtacttcctcgtcggctcccagtctcgagggacaagtacgtcaccttgacctatcgacgtggacgtccgagggctaggaggtaacgtaggtcgtcgtacttatttctgtaccaagtacgaaggtacggtaccaaccgtactcgactattagtcgttcggtttcgggcggacggtacctagtcgtacgtaccgttccgtaccggtcncgtcccgtaacgg

SEQ ID NO: 227078 - DNA, 765 bp, Homo sapiens
  misc_feature: GYAE6OF01DUW4C.25.3.A03.1.454.CMB.1.raw
  modified_base (355)..(355): a, c, t, g, unknown or other
  misc_feature (355)..(355): n is a, c, g, or t
tcagactgtacagtcacgaccggtgctcgatttagagagcgtcacagagaggaagggggagaagtagagggatccagaactcgtgggtgtctcaccagtggcctggactccctctaccttcctccccctcctcactctctgcacaggctctgacggcctcctatgagctgacacacgcccacccgtcggtgtcacggtccgtaccccgaggacgacggaccggccaaggactccacccgtgccttacgtggagtatggactatacgaaccctaaaactatactgtactttaagtcggtaaccagacgaaggtaacgtccgacggtaccgaccggtcccgtggtagtagttggtanaataataagtaaacggagtaggttacgacggtaccggtcccgtacggaagggtacccttacccgaggaccggtacgtcttccgtcgtccggcctaccgacgtcgtaacggaacggaacttaacggtacgtacccgtacgtaaccggtacctacgttcggaagtacggtacgccggtaaggcgtaaggaccgggtacgacgggtccttagtactttacgttcgtacgttaacgacgtaccgggtaccgtaacccggaaccctacccgtacgttacccgtaagttacggtttacggttcgggtttaccgggggtttacgggaaccggggtaacggtacccggtaacggttcccggttaccccgggtacccggttccggacccggtaccggaacccggacccggtaccccggg

SEQ ID NO: 227079 - DNA, 808 bp, Homo sapiens
  misc_feature: GYAE6OF01BJ1M6.25.3.A03.1.454.CMB.1.raw
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (394)..(394): a, c, t, g, unknown or other
  misc_feature (394)..(394): n is a, c, g, or t
tcagactgtacagtcacgaccggtgctcgatttagagagcgtcacagagaggaagggggagaagtagagggatccagaactcgtgggtgtctcaccagtggcctggactccctctaccttcctccccctcctcactctctcgcacgnggcctcgtgacggccttcctatggacgctgaccacaccgccctacccgtcggtntacgaggttccgtaccccgaggaccgaggaccggccgaggactccgaccgtgaccttcgaggagtactggacttatacgaacccctaaaacctaattagttcgttaactttacgtttaccggaaccgaacggacgaacggtaacgtacggtaacgggtccgtacccgggtcccttaggtacgtagttagttanaagtttaaactaagtaaacgagtacggtaggacggaccgttaccgtagggacggtaccgtccggtggacgtacgttacgttcctacgggtctaccgtccgacgtcgtacggaaagtaactacgtccgtaccttacggtacacctaagtacgtaggtacgaccgtaacggacggacggtagggtaacggacggtaccggtagttaacctacgtttacgtttacggtaacgaacttaacggccgtaacgggtaccacccgtaccgttaccgaaacgtttactacggttaaggttttccggggttaccgggttaccggggaaccgggcggggttaaaccctaggggttacccccggtacggtaaccccggggtttcctaaccgggtaacccggtcccgggaaacgttccccccgggg

SEQ ID NO: 227080 - DNA, 154 bp, Homo sapiens
  misc_feature: GYAE6OF01DHXF6.48.35.D02.1.454.CMB.1.raw
  modified_base (154)..(154): a, c, t, g, unknown or other
  misc_feature (154)..(154): n is a, c, g, or t
tcagagtatacatacacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagn

SEQ ID NO: 227081 - DNA, 495 bp, Homo sapiens
  misc_feature: GYAE6OF01BGZYL.48.35.D02.1.454.CMB.1.raw
  modified_base (489)..(489): a, c, t, g, unknown or other
  misc_feature (489)..(489): n is a, c, g, or t
tcagagtatacatacacgaccggtgctcgatttagcacacgatagttgggtttggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaatattttgcaacttattactgtctgcagattacaattaccctcggacgttcggaccaagggacccaaggtaggaacgtacaaacgaactggtaggctgcncctaag

SEQ ID NO: 227082 - DNA, 247 bp, Homo sapiens
  misc_feature: GYAE6OF01ESEJ3.48.35.D02.1.454.CMB.1.raw
  modified_base (246)..(247): a, c, t, g, unknown or other
  misc_feature (246)..(247): n is a, c, g, or t
tcagagtatacatacacgaccggtgctcgatttagcacacgatagttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnn

SEQ ID NO: 227083 - DNA, 157 bp, Homo sapiens
  misc_feature: GYAE6OF01A4M0D.48.35.D02.1.454.CMB.1.raw
  modified_base (152)..(157): a, c, t, g, unknown or other
  misc_feature (152)..(157): n is a, c, g, or t
tcagagtatacatacacgaccggtgctcgatttagcacacgatagtgggttggaccaaggtaggaagtcaaacgaactgtggctgcaccatctgtcttcatcttcccgccatctgatatgtatactctgagcgggctggcaaggcgcatagnnnnnn

SEQ ID NO: 227084 - DNA, 493 bp, Homo sapiens
  misc_feature: GYAE6OF01BON2P.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcgagggactcccgtgagcgattctctggctccagctcgtgggacacactcactctgactatcagtgaagtcgggcagagacgaggctagactactattgtcagtcaggagacaatactcgcacgcaagtctgtcggcggaggaccaaggctagacagtccaggtcacggccaagggtcc

SEQ ID NO: 227085 - DNA, 277 bp, Homo sapiens
  misc_feature: GYAE6OF01A7VHB.48.35.D02.1.454.CMB.1.raw
  modified_base (248)..(277): a, c, t, g, unknown or other
  misc_feature (248)..(277): n is a, c, g, or t
tcagagtatacatacacgaccggtgctcgatttagcacacgatagttgggtttgggggtgtggtggtctccactcccgccttgacgaggctgattactactgtcagtcttttgataacaacaatcacgtggtcttcggcggagggaccagcctgaccgtcctaggtcagcccaaggtctgcccccctggtcactctgttcccacctcctctatgtatacgtctgagcgggctggcgaaggcgcatagnnnnnnnnnnnnnnnnnnnnnnnnnnnnnn

SEQ ID NO: 227086 - DNA, 153 bp, Homo sapiens
  misc_feature: GYAE6OF01DOARL.48.35.D02.1.454.CMB.1.raw
tcagagtatacatacacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatag

SEQ ID NO: 227087 - DNA, 246 bp, Homo sapiens
  misc_feature: GYAE6OF01C13XO.48.35.D02.1.454.CMB.1.raw
  modified_base (245)..(246): a, c, t, g, unknown or other
  misc_feature (245)..(246): n is a, c, g, or t
tcagagtatacatacacgaccggtgctcgatttagcacacgatagttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatagnn

SEQ ID NO: 227088 - DNA, 249 bp, Homo sapiens
  misc_feature: GYAE6OF01AYKT4.48.35.D02.1.454.CMB.1.raw
  modified_base (246)..(249): a, c, t, g, unknown or other
  misc_feature (246)..(249): n is a, c, g, or t
tcagagtatacatacacgaccggtgctcgatttagcacacgatagttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnnnn

SEQ ID NO: 227089 - DNA, 584 bp, Homo sapiens
  misc_feature: GYAE6OF01A2UFX.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtcccccaggacagacggccagggatcacgtgctctgcagagacgttgccaagtcaattttggttttgatcagcagaagtcaggccaggccccaagactgcctcatgtatagagacagtgagaggtcctgagggactcccgtgacgcgtattccgtacgtggccttcccgagtcctcgtacggggaccactcctacacttctagtaactactcgaggttacgaacggttcccgggacaaaggaacggtacgagggtctagtaaccgttactagtttcgtacgagtcgaagggacaactaacgttactccggataccggactaacggttacgtggttaccgggacgggacggacctaaggctagacgtacgtccgtaggccacgcccgtaagggtccc

SEQ ID NO: 227090 - DNA, 155 bp, Homo sapiens
  misc_feature: GYAE6OF01BDGAR.48.35.D02.1.454.CMB.1.raw
  modified_base (154)..(155): a, c, t, g, unknown or other
  misc_feature (154)..(155): n is a, c, g, or t
tcagagtatacatacacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagnn

SEQ ID NO: 227091 - DNA, 497 bp, Homo sapiens
  misc_feature: GYAE6OF01BCGOU.48.35.D02.1.454.CMB.1.raw
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttgatcagcagaagtcaggccaggccccaagactgctcatgtatagagacagtgagaggtcctcgagggactccctgacgcgattctctggctccgagcctcgtgggacacactcactctgactatcagtgaacgtccggganaagaagacgaggctgactactagttgcagtcagganacatactcgacacgcaagtactgtcggcggaggaccaggctagacacgtccaggacacgcccgaggtcc

SEQ ID NO: 227092 - DNA, 155 bp, Homo sapiens; identical to SEQ ID NO: 227090
  misc_feature: GYAE6OF01AO0SJ.48.35.D02.1.454.CMB.1.raw
  modified_base (154)..(155): a, c, t, g, unknown or other
  misc_feature (154)..(155): n is a, c, g, or t

SEQ ID NO: 227093 - DNA, 547 bp, Homo sapiens
  misc_feature: GYAE6OF01C5LZ2.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtctaattttggttttggtatcagcagaagtcaggccaggccccaagctgctcatgtatagagacagtgagacggtcctagagggactcccgtgacgcgtatttctcgtcggcctccgagtctcgtgggaccacactcacgtctagactatacagtgaacggtcggacaaggacgacgagtctagtacttacgtagttgtacagtcgaggaacaactaactacgtcgacacgacgtaagttcgtggttcgggacggtaacggaccaagtctagactacggtccgtacggtacacggcccgtaaggtcccg

SEQ ID NO: 227094 - DNA, 567 bp, Homo sapiens
  misc_feature: GYAE6OF01D8555.48.35.D02.1.454.CMB.1.raw
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagcccaccctcggtgtcagtgtccccaggacagacggccaggatcacgtgctctgcagagacgttgccaagtctaattttggttttggtatcagcagaagtcaggccaggccccaagactgctcatgtatagagacagtgagagtccagagggactcccgtgagcgtattctcgtggctccgagtctcgtcggggaccactactcacttctagacttancgtagtagaacggtccggganaaggaacggacgaggtctacgtaacttactatttcgtacgagtcgaaggacaacgtaattaccgtcgacacgactaaagttccgtggttccgggacggtaacgggaaccaaggccgtacggacaacggtccgtaaggaccaacggcccgaaggtccccg

SEQ ID NO: 227095 - DNA, 249 bp, Homo sapiens
  misc_feature: GYAE6OF01CG3K6.48.35.D02.1.454.CMB.1.raw
  modified_base (246)..(249): a, c, t, g, unknown or other
  misc_feature (246)..(249): n is a, c, g, or t
tcagagtatacatacacgaccggtgctcgatttagcacacgatagttgggtttgggggtggtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatagnnnn

SEQ ID NO: 227096 - DNA, 247 bp, Homo sapiens
  misc_feature: GYAE6OF01BK7YM.48.35.D02.1.454.CMB.1.raw
  modified_base (245)..(247): a, c, t, g, unknown or other
  misc_feature (245)..(247): n is a, c, g, or t
tcagagtatacatacacgaccggtgctcgatttagcacacgatagttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctctctatgtatactctgagcgggctggcaaggcgcatagnnn

SEQ ID NO: 227097 - DNA, 248 bp, Homo sapiens
  misc_feature: GYAE6OF01D24XN.48.35.D02.1.454.CMB.1.raw
  modified_base (246)..(248): a, c, t, g, unknown or other
  misc_feature (246)..(248): n is a, c, g, or t
tcagagtatacatacacgaccggtgctcgatttagcacacgatagttgggtttggggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccgccctcctctatgtatactctgagcgggctggcaaggcgcatagnnn

SEQ ID NO: 227098 - DNA, 751 bp, Homo sapiens
  misc_feature: GYAE6OF01CIVO9.48.35.D02.1.454.CMB.1.raw
  modified_base (738)..(738): a, c, t, g, unknown or other
  misc_feature (738)..(738): n is a, c, g, or t
tcagagtatacatacacgaccggtgctcgatttagcacacgatagttgggtttgggggagtcagacccactcaggacacagcatggacatgagggtccccgctcagctcctggggctcctgctgctctggctcccaggtgccagatgtgccatccagatcgacccagtctccatcctccctgtctgcatctggtaggagacagagtcaccttcacttcgccgggacaagtcgaggtactaagttaaaagtgtatttagcctggtatcaagacaaggaaaccgaggggaacgacgaccccctaaaggccttcctctaacttctaagtcgcttcgtacctttacctaagttttaacgaaaaggtttcggaacttcctaacaacgttaaccgtaaaggggttccaacggggtccgggtcgggttaggtaacgttccgttaacgggacctaaccggttaagttaacctttttaccaacccgtttaccttacccaaacccgttaactacccgaacggacccgtaacggtccccgttaggacccgtaacgggtacccgttaaggttaaaacgtttctttttaccggaacctttaaaacttttacgtttaacctcgggttactacggtaacctaaccgttaacttaacccgtaaccgtttaccccggacggtaccgttaccgggaccgtaaacggggtacgaacggtaggaaacgtaaccgtaaaacggtgttcggtaggtaccncgtaccgcttacg

SEQ ID NO: 227099 - DNA, 586 bp, Homo sapiens
  misc_feature: GYAE6OF01EXT84.48.35.D02.1.454.CMB.1.raw
  modified_base (178)..(178): a, c, t, g, unknown or other
  misc_feature (178)..(178): n is a, c, g, or t
  modified_base (443)..(443): a, c, t, g, unknown or other
  misc_feature (443)..(443): n is a, c, g, or t
  modified_base (569)..(569): a, c, t, g, unknown or other
  misc_feature (569)..(569): n is a, c, g, or t
  modified_base (579)..(579): a, c, t, g, unknown or other
  misc_feature (579)..(579): n is a, c, g, or t
tcagagtatacatacacgaccggtgctcgatttagcacacgatagttgggtttggggctgtgggtccaggaggcagaactctgggtgtctcaccatggcctggatccctctacttctccccctctcattctctgcacaggctctgagcctcctatgaactgacacagcccacctggtntcagtcgtccccaggcaggaccgccaggatcacgtgctctgcagacgtacgttgccaagttctaagttttggttttagatcgagcaagaacgtcaggccacggaccccaagctgctacgagttgtaatacgagacgtaggtcgaggtacgtcctacgaacggtacctcccgtagacgtcgtactttcgcgttcggactcgaagtctcgtacgggacctaacactacacttacgtacgacttagcgtagtacgaacggtccggganaacggaacgacgacgtacagtactaacttgtcgacagtccgaaggacactaattacgcacgactacgaagtttcgtaccgggtgacgggacgaactacggcgtacgaccgtacgtacgcggtaacncgtaacccgngtccccg

SEQ ID NO: 227100 - DNA, 785 bp, Homo sapiens
  misc_feature: GYAE6OF01BQ0EV.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagcccacccgtcggtgtcagtcgtccccgaggacagacggccaggactcacgtgctcgtgacagacgtacggttcgccaaaggttctaagtttttgggtttttaggtatcgagtacgaaggtaacgtccgacggacccgtaacggggaccccccaaaaggtacctcgccttacgtaagttcggttaagtacggaacgaacgtaggtaggaacggtacggtacccgacggtaacgggtaccttcccgtaaggtacggtaccgtaagtttccggtacgtcggacctccgaaggttcccgttacggtaccggggtaaccgtacctaacccgtcctaacggttctaaccggtaactttaacgtgtaacggttaacgggacggtaccgggacgaaaggtaaacgggtacggacggtacgtacgtaactttacgtacgtttacggtacctaaggttaccgaaggggtacaaactaacggttaccgccgggtaacctagtacccggtaaagtttccggttaacggttaccggggaacgggtcccgggtaaaccaagggtccgttaagaacccgttaccgggtacccggtacggaccgaaaccccgtccggaggttaccccccgg

SEQ ID NO: 227101 - DNA, 671 bp, Homo sapiens
  misc_feature: GYAE6OF01AIJ6U.48.35.D02.1.454.CMB.1.raw
tcagagtatacatacacgaccggtgctcgatttagcacacgatagttgggtttggggctgtgggtccaggaggcagaactctgggtgtctcaccatggcctggactccctctacctcctcccctcctcacttctctgcacagctctgacgtcctctatcgaactcgaacactacgccctacctcggtagtctagtccgtacccaggaccaggacgcgaggactcacgtcgctcgtgacgtagtacgtcgtacgaccgtagttacgttaagtttttgggttttaggttactacgtacgtacgtaacggtacgtacgtaccggaccgtaccgaccgtacgtaccgtacgtacgtactagtacgtacgtaacgtacgtacgtaggtacgtacgtacgtcgtacggtacgtacgtacgtacgtacgtactacgtcgtacgtcgtaccgtcgtcgtacgtcggtacgacgtacgtcgtactacgtacgtacgtacgtagtacgtacggtacgtacgtacgacgaggaacggtacgtacgtagtacgtactacgttacgtacgtacgtacgtacgtacgacgtagtacgtaccgtacacgacgtacgtacgtacgtcggtacgtacggtacgtacgacgcgtacacgtacggtacgacgtacgacgcgtcggtaccc

SEQ ID NO: 227102 - DNA, 663 bp, Homo sapiens
  misc_feature: GYAE6OF01EZKTL.48.35.D02.1.454.CMB.1.raw
  modified_base (88)..(88): a, c, t, g, unknown or other
  misc_feature (88)..(88): n is a, c, g, or t
  modified_base (191)..(191): a, c, t, g, unknown or other
  misc_feature (191)..(191): n is a, c, g, or t
  modified_base (643)..(643): a, c, t, g, unknown or other
  misc_feature (643)..(643): n is a, c, g, or t
  modified_base (654)..(654): a, c, t, g, unknown or other
  misc_feature (654)..(654): n is a, c, g, or t
tcagagtatacatacacgaccggtgctcgatttagcacacgatagttgggtttgggggctgtgggtccaggaggcagaactctgggtntctcaccatggcctggatccctctacttcctcccccctctcattctctgcacaggcctctgacggccttctatcgaactgaccacgacgccctacccgtggtntcgaggtccgtccccgaggacacggaccggccaggactcgacgtcgctctcggacaggacggtaccgtttcgaccttaagttcttaaggtttttggttttacgatcgaagcgaagtacgtacgacggccgaacggacccctaaggtctcgtcgtatagtacgtaagtaacggagtacgtaggtacggaacggtaccggtccgtaggtacgggtacctccggtggacggtactacgttcgcgtggacctcggaacgtcgtacgtacgggactaccgtctacgtaccttgtaccgacgttacacggtacgtaacggacccgggtgaaccgtaagggtaccggaacggtgtacgtaacttaccgtaagttcgtacgtgacggtacgaggtacagtactcgactacgagtctaggtcgcgggacggagacgactacggctacgacgtagtccgganaccggtaccgngtaccgccg

SEQ ID NO: 227103 - DNA, 151 bp, Homo sapiens
  misc_feature: GYAE6OF02I2VPT.48.35.D02.1.454.CMB.1.raw
  modified_base (149)..(151): a, c, t, g, unknown or other
  misc_feature (149)..(151): n is a, c, g, or t
tcagagtatacatacacgaccggtgctcgatttagcacacgatagttggtttggaccaaggtggaagtcaacgaactgtggctgcaccatctgtcttcatcttccgccatctgatatgtatactctgagcggctggcaaggcgcatagnnn

SEQ ID NO: 227104 - DNA, 243 bp, Homo sapiens
  misc_feature: GYAE6OF02GVKOD.48.35.D02.1.454.CMB.1.raw
  modified_base (243)..(243): a, c, t, g, unknown or other
  misc_feature (243)..(243): n is a, c, g, or t
tcagagtatacatacacgaccggtgctcgatttagcacacgatagttgggttggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccaccctcctctatgtatactctgagcgggctggcaaggcgcatagn

SEQ ID NO: 227105 - DNA, 155 bp, Homo sapiens; identical to SEQ ID NO: 227090
  misc_feature: GYAE6OF02HWXN3.48.35.D02.1.454.CMB.1.raw
  modified_base (154)..(155): a, c, t, g, unknown or other
  misc_feature (154)..(155): n is a, c, g, or t

SEQ ID NO: 227106 - DNA, 248 bp, Homo sapiens
  misc_feature: GYAE6OF02HXIYX.48.35.D02.1.454.CMB.1.raw
  modified_base (246)..(248): a, c, t, g, unknown or other
  misc_feature (246)..(248): n is a, c, g, or t
tcagagtatacatacacgaccggtgctcgatttagcacacgatagttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnn

SEQ ID NO: 227107 - DNA, 154 bp, Homo sapiens; identical to SEQ ID NO: 227080
  misc_feature: GYAE6OF02GV6NE.48.35.D02.1.454.CMB.1.raw
  modified_base (154)..(154): a, c, t, g, unknown or other
  misc_feature (154)..(154): n is a, c, g, or t

SEQ ID NO: 227108 - DNA, 154 bp, Homo sapiens; identical to SEQ ID NO: 227080
  misc_feature: GYAE6OF02HODAD.48.35.D02.1.454.CMB.1.raw
  modified_base (154)..(154): a, c, t, g, unknown or other
  misc_feature (154)..(154): n is a, c, g, or t

SEQ ID NO: 227109 - DNA, 157 bp, Homo sapiens
  misc_feature: GYAE6OF02GSM3H.48.35.D02.1.454.CMB.1.raw
  modified_base (154)..(157): a, c, t, g, unknown or other
  misc_feature (154)..(157): n is a, c, g, or t
tcagagtatacatacacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagnnnn

SEQ ID NO: 227110 - DNA, 153 bp, Homo sapiens; identical to SEQ ID NO: 227086
  misc_feature: GYAE6OF02GEVLL.48.35.D02.1.454.CMB.1.raw

SEQ ID NO: 227111 - DNA, 247 bp, Homo sapiens; identical to SEQ ID NO: 227082
  misc_feature: GYAE6OF02GZ39B.48.35.D02.1.454.CMB.1.raw
  modified_base (246)..(247): a, c, t, g, unknown or other
  misc_feature (246)..(247): n is a, c, g, or t

SEQ ID NO: 227112 - DNA, 510 bp, Homo sapiens
  misc_feature: GYAE6OF02HS22K.48.35.D02.1.454.CMB.1.raw
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttggtatcagcagaagtcaggccaggccccaagactgcccatgtatagagacagtgagaggtcctcgagggactccctgagcgtattcctctggctccgagctcgtgggacacactcactctgactatcagtgaacgtcggnagaagacgagctagactactattgtacagtcagganacaatacgtcgacacgcaagtctggttacggcggacggaccaagctagacagtaccgtaggccacggacccaggcctaccgg

SEQ ID NO: 227113 - DNA, 248 bp, Homo sapiens; identical to SEQ ID NO: 227106
  misc_feature: GYAE6OF02JFA5S.48.35.D02.1.454.CMB.1.raw
  modified_base (246)..(248): a, c, t, g, unknown or other
  misc_feature (246)..(248): n is a, c, g, or t

SEQ ID NO: 227114 - DNA, 265 bp, Homo sapiens
  misc_feature: GYAE6OF02IC1EY.48.35.D02.1.454.CMB.1.raw
  modified_base (250)..(265): a, c, t, g, unknown or other
  misc_feature (250)..(265): n is a, c, g, or t
tcagagtatacatacacgaccggtgctcgatttagcacacgatagttgggtttgggggtgtggtggtctccactcccgccttgacgaggctgattactactgtcagtcttttgataaacaacaatcacgtggtcttcggtcggagggaccagccttagaccgtcctaggtcagcccaaggctgccccctggtcactctggttcccgccctcctctatgtatactctgagcgggctggcaaggcgcatagnnnnnnnnnnnnnnnn

SEQ ID NO: 227115 - DNA, 498 bp, Homo sapiens
  misc_feature: GYAE6OF02GHUGO.48.35.D02.1.454.CMB.1.raw
  modified_base (391)..(391): a, c, t, g, unknown or other
  misc_feature (391)..(391): n is a, c, g, or t
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttggtatcagcagaagtcaggccaggccccaagactgctcatgtatagagacagtgagaggtcctcagggatccctgagcgattcgtctaggctccgagtctcgtgggacacactcactctgactatcagtgaagtccggnagaagacgaggctgactatattgtcagtcaggacgacaatactcgacacgacaagtactgtacggacggaaggaccaggctagacagtcctaggcacgcccaggtcc

SEQ ID NO: 227116 - DNA, 526 bp, Homo sapiens
  misc_feature: GYAE6OF02GB8FM.48.35.D02.1.454.CMB.1.raw
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttgtatcagcagaagtcaggccaggccccaagactgctcatgtatagagacagtgagaggtcctcgagggatcccgtgacgcgtattctctggctccagctcgtgggacacactcactctgactancagtgaacgtccggganaagagacgagctagactatattgcagtacaggagacaatacctcgaccacgactaagttacgtcggttcgggacgggaacggaccgaagtcgtacgacgaggttccgtaaggtccacggacccgaaggtcccg

SEQ ID NO: 227117 - DNA, 154 bp, Homo sapiens; identical to SEQ ID NO: 227080
  misc_feature: GYAE6OF02ILPVY.48.35.D02.1.454.CMB.1.raw
  modified_base (154)..(154): a, c, t, g, unknown or other
  misc_feature (154)..(154): n is a, c, g, or t

SEQ ID NO: 227118 - DNA, 154 bp, Homo sapiens; identical to SEQ ID NO: 227080
  misc_feature: GYAE6OF02GMRDR.48.35.D02.1.454.CMB.1.raw
  modified_base (154)..(154): a, c, t, g, unknown or other
  misc_feature (154)..(154): n is a, c, g, or t

SEQ ID NO: 227119 - DNA, 522 bp, Homo sapiens
  misc_feature: GYAE6OF02GUDJ2.48.35.D02.1.454.CMB.1.raw
  modified_base (400)..(400): a, c, t, g, unknown or other
  misc_feature (400)..(400): n is a, c, g, or t
  modified_base (431)..(431): a, c, t, g, unknown or other
  misc_feature (431)..(431): n is a, c, g, or t
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttgtatcagcagaagtcagccaggccccaagactgctacatgtatagagacaggtgagaggtcctcgagggtactcccgtgacgcgtattctcgtgcctccagtctcgtagggaccacgactcactctagactatcagtgacggtccggnaaggaacgacgaggctagactacgtatcgtnagtacgaggacaactactacgcgacacgactaagtcttggtcggacggacggacagcgtagacacgtcgtaacgtcacgaccgaggtcccg

SEQ ID NO: 227120 - DNA, 616 bp, Homo sapiens
  misc_feature: GYAE6OF02JMC6R.48.35.D02.1.454.CMB.1.raw
  modified_base (309)..(309): a, c, t, g, unknown or other
  misc_feature (309)..(309): n is a, c, g, or t
  modified_base (455)..(455): a, c, t, g, unknown or other
  misc_feature (455)..(455): n is a, c, g, or t
tcagagtatacatacacgaccggtgctcgatttagcacacgatagttgggtttggggctgtgggtccaggaggcagaactctgggtgtctcaccatggcctggatccctctacttctccccctcctcattctctgcacaggctctgaggcctcctatgaactgacacagccaccctggtgtccagtgtcccccaggacagaccggccaggactcacgtgctcgtgcagagaccgttgccaagtctaattttggtttttgatcgagctagaagtcaggccaggccccaaagcttgctacgatgtactagnacagtgaagagtcctgagggtactcccgtagacgtcgtattccgtcgtcggcctaccaggtccttacggtcgggaccacaccgttcacgttcgagaccttatcgtacgtacgtaacggtcgggacaaggtaacgacgagtccgtanacgtacttattcgactaagcgtaagggacaacgtaacttaaccgcgtaacctaccggaacgtaacgttacggttccggtacggacgggggtaaacgactaacggtcctaacggtaacctacgggtacctacggttacgaaccggtaccgtaacggtccccg

SEQ ID NO: 227121 - DNA, 811 bp, Homo sapiens
  misc_feature: GYAE6OF02IR9ZQ.48.35.D02.1.454.CMB.1.raw
tcagagtatacatacacgaccggtgctcgatttagcacacgatagtttggtttgggggctgtgggtccaggaggcagaactctgggtgtctcaccatggcctggatccctctacttcctccccctcctcattctctgcacaggctctgaggcctcctatgaactgacacagcccaccctcggtgtcagtcgtccccaggacagaccggccaggatcacgtgctctgcagagacgttgccaagtctaattttggttttgtatcagcaagaagtcaggccacggaccccaagactgctacataggttataggagacaggtgaggtacggtcctacggagggtactcccgtaggacgtccgtaatttccgttaccgtcgggtccttacccacggtccgttaccgggtacggggaaacccgtaaccctaaccgttactaacccgttacgttacggttaaacctttaacgttcgtaaaggggtttaaccgggaaaccgggttacccggggaactaaaacggggaaacgggtaaccgggaaccgggttaccttaacgggtaaccctttaacgtttaacgtttcggaacccggttaaggttaaccgaaggggtaacgaaaccttaaacggttacccgtaccgggaaccgtaacggtaacccttaaacgggtttccgttacggggttacccggggggaacccggggtaaacggggaacccctaaagggtccccgtttaacgggaaccggtttaacccgggttacccgttaaccggggttacccgaaaccgggttaccccccgggtaaggggtccccccg

SEQ ID NO: 227122 - DNA, 664 bp, Homo sapiens
  misc_feature: GYAE6OF02GNS2Q.48.35.D02.1.454.CMB.1.raw
tcagagtatacatacacgaccggtgctcgatttagcacacgatagttgggtttgggggctgtgggtccaggaggcagaactctgggtgtctcaccatgacctggatccctctacttctccccctcctcattctctgcacaggctctgaggcctcctatgaactgacacagcccaccctcggtgtcagtcgtccccaggacagacggccaggatcacgtgctctgcagagacgttgaccaagtctaagttttggtttttgatcagcagaagtcaggccaggccccaagactgctcatgtatagagacagtgagagtcctgagggtactccgtgacgcgtattctcgtcggcctacccgagtccgtcgtacggggaaccaaccgtaccgtcctaacgttccgtacggtaaccttaagtccgtaagggttacggtaaaccgggttcccggggaactaaagggaaaccggacggaacgggtacttacggtaaccttaacttagtttcgtacgtagtaccgaaggtacgaactaaacgtccgtacgaccgtaaccgaacgtaacgttacgttcgggttaccgggacgggaaacgggtaacctaacggccgtaacggtaaccgtacggtttaccggtaacggttacccacggaccccgtaagggtccccg

SEQ ID NO: 227123 - DNA, 733 bp, Homo sapiens
  misc_feature: GYAE6OF02G8CMY.48.35.D02.1.454.CMB.1.raw
tcagagtatacatacacgaccggtgctcgatttagcacacgatagttggggtttgggggcgtgtggggtccaccgggacggcgtacgaacgtcttgggtgtcttcgaccatggcctggatccctctacttctcccctacctcattctctggctacgaggctcgtgtagggttcccttcttagtcgtaaactttaggactaccagtcctacccgtgggtgtcaggtcgtccccgtagggactacggacgggggccaggtacgtccacggtcgtcgggttcctggactacgacgtaccgttggccaaggttcctaacgtttttgggtttttggtaattccgaacgtcgaaggtaacgttcgaggtcctaggcccccaaagtaccgtcgggtcctcgagtcgtacgtaagggaggactaggtagaggtacggtcctaggaagggtacttaccggtagtacgtacgtacttactcgtgtactactagtctaccgtaggactacgtacgtacgactacgtacactactacgtaggtacggaacggtaccgactaaggaacgacggtacgtgtacgtaacttacttaagtcgtacgtacgacgaggtacgaatacgtaccgtacgacgtaaccgtagtaacgttgtacggttacgggacgggtaacgggacgtaaggtcggtaaggtaccgtaacggttaccggttaaggtacggtaccggtcccgggtaaggtcccgg

SEQ ID NO: 227124 - DNA, 679 bp, Homo sapiens
  misc_feature: GYAE6OF02JCZ54.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgacggcctcctatgaactgacacagcccacccgtcggtgtcagtcgtccccgaggacaggacggccaggactcacgtgctctgcagagacgttgaccagtctaattttggttttgtatcagcaagtagtcgagccgacggacccaagactgctacagtagtagtagacgacaggtgaggtacgtctagacgggtactccgtaggacgtcgtagttctcgtcgtcctcgagtccgtcggacgggaacctacgtacctcgtaccttcgttacgtaactactcggtaacgggtacggaacgggtccggggtaacaacgggaaaggacgggtaacgtctaacggtaccttacgtttagtttacgtaccgaggttacgaggggtaaacctaactaacgttacccgtacgacgtaaaccggtagttaaaccggttcggtgggttaccggacgggggtaacgggaaccaaacgggtcgttaacccggaagttaccccggtttacgtaacggtaccgaacggtaccccggaaggtccccgg

SEQ ID NO: 227125 - DNA, 272 bp, Homo sapiens
  misc_feature: GYAE6OF02F5UJZ.48.35.D02.1.454.CMB.1.raw
  modified_base (250)..(272): a, c, t, g, unknown or other
  misc_feature (250)..(272): n is a, c, g, or t
tcagagtatacatacacgaccggtgctcgatttagcacacgatagtggtttgggggtgtggtggtctccactcccgccttgacgaggctgattactactgtcagtcttttgataacaacaatcacgtggcttcggcggagggaccagcctgaccggtcctaggtcagtcccaaggctgccccctcggttcactctgttcccaccctctctatgtatactctggagcggggctgggtcaaggcgcagtagnnnnnnnnnnnnnnnnnnnnnnn

SEQ ID NO: 227126 - DNA, 680 bp, Homo sapiens
  misc_feature: GYAE6OF02J1TUA.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagcccaccctggtgtcaggtcgtccccaggacagacggccaggactcacgtgctctgcagagcgttgccaagtctaattttggttttagatcagcgagaagtcaggccaggccccaagctgctcagttgtagtacgagacgtaggtgaagcgggttacctcggaacggggtacttcccgtaggaaccgcggtactttcccgtagtcgggtccttccggacggccgttacggtacggggtaaccgtaccgtaacccgttccgtaaccttcgtacggtaaccttcgtaccgtaggtacggtacggtacccgggacgtaaagggaaccgtaacggtacggaccttaggtaacccttacgttagttacgtaccggtagttacgacggtaacgtaacgtaacgttccgacgtacgtaaccgtacgtaacgttccgttacggtagggtacccgggtaaggtaaccgaacgttcgtacgacgtacggtacgtacggtcgaaccgaccgtacggtccccg

SEQ ID NO: 227127 - DNA, 624 bp, Homo sapiens
  misc_feature: GYAE6OF02I13WZ.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtcgtccccaggacagacggccaggatcacgtgctctgcagagacgttgccaagttcaattttggttttggatcagcagaagtcaggccaggccccaagactgctcatgtatagagacagtgagaggtcctagaggggtactcccgtaggacgtaccgatttccgtcgttggaccttccgaagtcctacgtggggaaccactaacctccacctcgtacgactactcgaaggtcgaacggtccgggactaagggaagtacgaggcttcgaaccgttattattgacgtagtcgaagggagaactaattaccgtacgctaaccggtacaaaggttcgttacggttaccggggccgggtaaaacgggtaccccaaaggtcccgtagtaacccggtagttacccggttaagggaccctaacgggtaccccgtaacgggtccccg

SEQ ID NO: 227128 - DNA, 649 bp, Homo sapiens
  misc_feature: GYAE6OF02G1XQQ.48.35.D02.1.454.CMB.1.raw
tcagagtatacatacacgaccggtgctcgatttagcacacgatagttgggtttgggggctgtgggtccaggaggcagaactctgggtgtctcaccatggcctggatccctctacttcctccccctcctcacttctctgcacaggctctgaggcctcctatgaactgacacagcccaccctcggtgtcaggtcgtcccccaggaccagaccggccaggatcacgtgctctgcagagacgttgaccagtctaagttttggttttgatcgagcagaagtcgaggccacggccccaagacctgctacatgtatacgagactaggtagagacggtcctgagggtactcccgtgacgcgtattctcgtcggacctcgagtcctcgtagggaccacgtacttccacgttcctacgtaactacgtcgtacggtacggtaaacggttccgggaacaaacgggaaaccggtaaccgggacgggtacccgtttaacggtaacctttaacgttacggtttacgtaaccgaacggttcggaaacggtaagaacttaacgttaccgaccgtactaacgaccgtaaggtaccgttcggttacgggacgggaacgtaccgaagtccgtaagacgtacgtcgtacgcgtacgaccgacggtacccg

SEQ ID NO: 227129 - DNA, 406 bp, Homo sapiens
  misc_feature: GYAE6OF01ES2YT.36.72.G06.1.454.CMB.1.raw
  modified_base (397)..(397): a, c, t, g, unknown or other
  misc_feature (397)..(397): n is a, c, g, or t
  modified_base (403)..(406): a, c, t, g, unknown or other
  misc_feature (403)..(406): n is a, c, g, or t
tcagtacgctgtctcacgaccggtgctcgatttagctacgactgcaagggaaaggggctggagtgggtctctggtatttattcgaatggtggtagtacagggtatgcagactctgtgaagggccgattcatcatctccagagacaacgccaagaattccctggatctggaaatgaacagtctgagagccgaggacacggccttgtactactgtgcgagagctccgtgggctgaccatggggccagggaaccctggtcaccgtctcctcagcctccaccaaggcccatcggtctccccctggcaccctcctccaagagccacctctggggcacagcggccctgggctgcctggtcaaggactacttccagacagcgtactgagcgggctggcaaggcncatagnnnn

SEQ ID NO: 227130 - DNA, 450 bp, Homo sapiens
  misc_feature: GYAE6OF01DDKHP.36.72.G06.1.454.CMB.1.raw
  modified_base (431)..(450): a, c, t, g, unknown or other
  misc_feature (431)..(450): n is a, c, g, or t
tcagtacgctgtctcacgaccggtgctcgatttagctacgactgcaagggaaaggggctggagtgggtctctggtatttattcgaatggtggtagtacagggtatgcagactctgtgaagggccgattcatcatctccagagacaacgccaagaattccctggatctggaaatgaacagtctgagagccgaggaccacggccttgtactactgtgcgagagctccgtgggctgaccacgtgggggccaggggaacccctggtccacccgtctcctcagcctccaccaaggcccatcggtcctccccctggccaccctcctccaagacgccaccgtcgtgggggcacaggccggcccgtgggctcgccgtggtcaacggactaccttaccagacagcgtacgtgaggcgggctgggcgaaggcgacagtagnnnnnnnnnnnnnnnnnnnn

SEQ ID NO: 227131 - DNA, 580 bp, Homo sapiens
  misc_feature: GYAE6OF01C6RK8.36.72.G06.1.454.CMB.1.raw
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(543): a, c, t, g, unknown or other
  misc_feature (537)..(543): n is a, c, g, or t
  modified_base (545)..(549): a, c, t, g, unknown or other
  misc_feature (545)..(549): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(559): a, c, t, g, unknown or other
  misc_feature (555)..(559): n is a, c, g, or t
  modified_base (561)..(565): a, c, t, g, unknown or other
  misc_feature (561)..(565): n is a, c, g, or t
  modified_base (567)..(580): a, c, t, g, unknown or other
  misc_feature (567)..(580): n is a, c, g, or t
tcagtacgctgtctcacgaccggtgctcgatttagctacgactgcaaggggaaagggctggagtgggtctcctggtatttaattcgaagtggtcggtagtacagggtatgtcagtaccttctgtgaagggccgtattcactcatctccagagacaacgccaagaattcccgtggatctggaaatgaacagtctgagagccgaggacgacggccttcgactctgtgcgagagctccggtggctgaccagtcgggaccacgggaccctggtaccaccggtctacctcgacgccctaccgaccgaaccgggccctacgttccggtcccttcccccgtacggccctaccccgttccctacccaacgaccgaccgacccgtcgttcgggggacctacccgacggcccggtccgttcgggcttcggacccgttgggtaccgtaaacgggtacctaccgttacccgaggtaccgacgtaccgttacgacggaacgccggggtacctaggggaccgtagggccgacgtaagtagagtctantntnnnnnnnannnnngngngnnnnngnnnnngnnnnnnnnnnnnnn

SEQ ID NO: 227132 - DNA, 487 bp, Homo sapiens
  misc_feature: GYAE6OF01CKGAP.36.72.G06.1.454.CMB.1.raw
  modified_base (310)..(310): a, c, t, g, unknown or other
  misc_feature (310)..(310): n is a, c, g, or t
  modified_base (470)..(487): a, c, t, g, unknown or other
  misc_feature (470)..(487): n is a, c, g, or t
tcagtacgctgtctcacgaccggtgctcgatttagctacgactgcaagggaaaggggctggagtgggtctctggtatttattcgaatggtggtagtacagggtatgcagactctgtgaagggccgattcatcatctccagagacaacgccaagaacttccctggatctggaaatgaacagtctgagagccgaggacacggccttgtactactgtgcgagacgctccgtggctgaccacgtggggccaggggaccctggtccaccgtctcctcagccctccaccaacgggcccatccggtccttccccccnggccacccctcctcccaagcgccaccctcgtcgggggccacgacgcccgggcccgtgggcctcggcccgttcgggtaccgaaagggtaccctaccgtacccacggaaccacggccgttacgtggacggccggggctgggaccgaagggccgcagtacggnnnnnnnnnnnnnnnnnn

SEQ ID NO: 227133 - DNA, 754 bp, Homo sapiens
  misc_feature: GYAE6OF01E2TLB.36.72.G06.1.454.CMB.1.raw
  modified_base (713)..(713): a, c, t, g, unknown or other
  misc_feature (713)..(713): n is a, c, g, or t
  modified_base (715)..(754): a, c, t, g, unknown or other
  misc_feature (715)..(754): n is a, c, g, or t
tcagtacgctgtctcacgaccggtgctcgatttagctacgactgcaaggggaaaggggctggagtgggtctctggtatttattcgaatggtggtagtacagggtatgcagactctgtgaagggcctattcatcatctccagagacaacgccaagaattccctggatctaggaaatgaacagtctaggagagccgaggaccacggtccttgtactactgtcgcgaagagcctccgggtgggctcggaaccccgtacggtcggggggacccaacgggggtaaccccttggggtacccgtaacccggttcccttccccgttaccgacccggtacccccttacccccgaaaccccggtaaaccgggggtcccccctaacggtttcccccggggtttacccccttttcccccccccggttacggggtaccccctaaccccccgttacccccttaacccggaaaacggtaacccggacccccgtaaccccggttaccggggtaccgggggggacccaacccgggtaaccggggcccccggggtccccggttcgggggtacccgttccgggtaccccggttacggggtaacccgtaaaacgggtaacccgtaacccgttaacccggaaccggtaaccggaacggtaccggtaaccgtagggaccgggtacccggggtaccgttacggggaccggaacgggtaccgaaccgtaagtacggncnnnnnnnnnnnnnnnnnnnnnnnnnnnnnnnnnnnnnnnn

SEQ ID NO: 227134 - DNA, 416 bp, Homo sapiens
  misc_feature: GYAE6OF02HBO1C.36.72.G06.1.454.CMB.1.raw
  modified_base (409)..(416): a, c, t, g, unknown or other
  misc_feature (409)..(416): n is a, c, g, or t
tcagtacgctgtctcacgaccggtgctcgatttagctacgactgcaagggaaaggggctggagtgggtctctggtatttattcgaatggtggtagtacagggtatgcagactctgtgaagggccgattcatcatctccagagacaacgccaagaattccctggatctggaaatgaacagtctgagagccgaggacacggccttgtactactgtgcgagagctccgtgtgctgaccactggggccagggaaccctggtcaccgtctcctcagcctccaccaagggcccatcggtcttccccctggccaccctcctccaagacgcacctcgtgggggcacagcggccctgggctgcctggtcaaggactacttccagacagcgtactgagcgggctggcaaggcgcatagnnnnnnnn

SEQ ID NO: 227135 - DNA, 414 bp, Homo sapiens
  misc_feature: GYAE6OF02GJODB.36.72.G06.1.454.CMB.1.raw
  modified_base (403)..(403): a, c, t, g, unknown or other
  misc_feature (403)..(403): n is a, c, g, or t
  modified_base (409)..(414): a, c, t, g, unknown or other
  misc_feature (409)..(414): n is a, c, g, or t
tcagtacgctgtctcacgaccggtgctcgatttagctacgactgcaagggaaaggggctggagtgggtctctggtatttattcgaatggtggtagtacagggtatgcagactctgtgaagggccgattcatcatctccagagacaacgccaagaattccctggatctggaaatgaacagtctgagagccgaggacacggccttgtactactgtgcgagagctccgtgggctgaccacgtggggccagggaaccctggtcaccgtctcctcagcctccaccaagggcccatcggtcttccccctggcacccctcctccaagacgcacctctcgggggcacagcggccctgggctgcctggtcaaggactacttcagacagcgtactgagcgggctggcaaggcncatagnnnnnn

SEQ ID NO: 227136 - DNA, 430 bp, Homo sapiens
  misc_feature: GYAE6OF02HTOI0.36.72.G06.1.454.CMB.1.raw
  modified_base (414)..(430): a, c, t, g, unknown or other
  misc_feature (414)..(430): n is a, c, g, or t
tcagtacgctgtctcacgaccggtgctcgatttagctacgactgcaagggaaaggggctggagtgggtctctggtatttattcgaatggtggtagtacagggtatgcagactctgtgaagggccgattcatcatctccagagacaacgccaagaattccctggatctggaaatgaacagtctgagagccgaggacacggccttgtactactgtgcgagagctccgtggctgaccactggggccagggaccctggcaccgtctcctcagcctccaccaagggccccaatcggtcttcccccgtggccacccctcctccaagacgccacctcgtgggggcacgagccggcctgggctgcctggtcaaggactacttccagacagcgtactggagcgggctagggcaggcacatagnnnnnnnnnnnnnnnnn

SEQ ID NO: 227137 - DNA, 202 bp, Homo sapiens
  misc_feature: GYAE6OF01B5M3I.7.71.G05.1.454.CMB.1.raw
  modified_base (201)..(202): a, c, t, g, unknown or other
  misc_feature (201)..(202): n is a, c, g, or t
tcagcgtgtctctacacgaccggtgctcgatttagtgtcgtcgcaagagagaggggtttggtctgagcctcagtcactgtgttatgtcttcggaactgggaccaaggtcaccgtcctaggtcagcccaaggccaaccccactgtaactctgttcccaccctcctctagagacacgctgagcgggctggcaaggcgcatagnn

SEQ ID NO: 227138 - DNA, 205 bp, Homo sapiens
  misc_feature: GYAE6OF01EGM7C.7.71.G05.1.454.CMB.1.raw
  modified_base (202)..(205): a, c, t, g, unknown or other
  misc_feature (202)..(205): n is a, c, g, or t
tcagcgtgtctctacacgaccggtgctcgatttagtgtcgtcgcaagagagaggggttttggtctgagcctcagtcactgtgttatgtcttcggaactgggaccaaggtcaccgtcctaggtcagcccaaggccaaccccactgtcactctgttcccactctcctctagagacacgctgagcgggctggcaaggcgcatagnnnn

SEQ ID NO: 227139 - DNA, 203 bp, Homo sapiens
  misc_feature: GYAE6OF01BNDBC.7.71.G05.1.454.CMB.1.raw
  modified_base (200)..(203): a, c, t, g, unknown or other
  misc_feature (200)..(203): n is a, c, g, or t
tcagcgtgtctctacacgaccggtgctcgatttagtgtcgtcgcaagagagagggtttggtctgagcctcagtcactgtgttatgtcttcggaactgggaccaaggtcaccgtcctaggtcagcccaaggccaaccccactgtcactctgttcccaccctcctctagagacacgctgagcgggctggcaaggcgcatagnnnn

SEQ ID NO: 227140 - DNA, 202 bp, Homo sapiens
  misc_feature: GYAE6OF01B5DL6.7.71.G05.1.454.CMB.1.raw
  modified_base (200)..(202): a, c, t, g, unknown or other
  misc_feature (200)..(202): n is a, c, g, or t
tcagcgtgtctctacacgaccggtgctcgatttagtgtcgtcgcaagagagaggggtttggtctgagcctcagtcactgtgttatgtcttcggaactggaccaaggtcaccgtcctaggtcagcccaaggccaaccccactgtcactctgttcccgccctcctctagagacacgctgagcgggctggcaaggcgcatagnnn

SEQ ID NO: 227141 - DNA, 718 bp, Homo sapiens
  misc_feature: GYAE6OF01B26BP.7.71.G05.1.454.CMB.1.raw
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
tcagcgtgtctctacacgaccggtgctcgatttagtgtcgtcgcaagagagaggggcctggaagcccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctnatctatggtgcatccaacgngggcccactggacactcccagccaggtttcaggtggcaggtgggctgggacagacttcactcacaccatcatcgacgtccgtggacgcctaggaaagtacttgttgacgttaagttttaatttaaccgttggtaactaaacgtaacgttacccggttaaaccggtacgggtccgggtaccccgggttaccccggggggtacccgttaacccggtttttcccggggaccccggtttacggggaacccgttaaacggggtacgggttaacttaacggttaacccgtaaaaccggtaacggttacggtacgggtacccgttacggtacccgtaacctacgttaccgtttcggttacccgtttactaccgtttcccgtttacccccgtaccgttaaccgttccgttaacggtaacgttaaacggtaccggtaaacccgg

SEQ ID NO: 227142 - DNA, 205 bp, Homo sapiens
  misc_feature: GYAE6OF01AJ959.7.71.G05.1.454.CMB.1.raw
  modified_base (203)..(205): a, c, t, g, unknown or other
  misc_feature (203)..(205): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctaggtcagcccaaggccaaccccactgtcactctgttcccgccctcctctagagacacgctgagcgggctggcaaggcgcatagnnn

SEQ ID NO: 227143 - DNA, 683 bp, Homo sapiens
  misc_feature: GYAE6OF01DIDCL.7.71.G05.1.454.CMB.1.raw
  modified_base (176)..(176): a, c, t, g, unknown or other
  misc_feature (176)..(176): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (441)..(441): a, c, t, g, unknown or other
  misc_feature (441)..(441): n is a, c, g, or t
tcagcgtgtctctacacgaccggtgctcgatttagtgtcgtcgcaagagagaggggcctggaagccccagctcagcttctcttcctcctgctactctggctcccagtttcagataccaccggagagattgtgttgacacagtctccagccaccctgtcttgtctccgaggggaaanacgccaccctctcctgcagggccagtcagagtgtggcgcctacgtagcctaggtaccaacacgaaacctggaccaggcctccccgacggcccctnatcctagtggtnaccactaccaacgacgggcccaacgtcggaccactccccgacgccgtaaggttccgaggttcggacgtagggtcgggtcgtaggggactacgtactcacttcgtacacctatacgatcgacgcgtagacgcctagagtagttgtagtacttaagtttnttaacgcgttaaacaaccgtgttaccggacggtaggttcccgggtcccggttcccggggtacttcccggtttcccgggaccgttacgggaaacgttaaggtcggtaataccgtaacgaaacggttacgtcgggttcgacgttccggaacctccgtaacgttccgttcgtttaccttaccgtaccgtttccccgttaccccgaccgttacttacgaggttaaacgtaggtaccccgtaaccgg

SEQ ID NO: 227144 - DNA, 576 bp, Homo sapiens
  misc_feature: GYAE6OF01A5Q5C.7.71.G05.1.454.CMB.1.raw
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
tcagcgtgtctctacacgaccggtgctcgatttagtgtcgtcgcaagagagaggagcccagcactagaagtcggcggtgtttccattcggtgatcagcactgaacacagaggactcaccatggagtttgggctgaacttgggtttttcctcgtttgcttcttttaaggaggtgtccagtgtcaagtgcaactggtggagtcgtgggggagcgtggtccagccgtgggacgtnacaggagactctcctgtcgcacgtcctcgtgggttccaccttcgagttacgctacggcatgcacgtgggtcccncgaacgcctccgaggacaagggtcttgggagtcgggtgctagtttgttacagtcgtggaggctagttcgtacaagttgatgactagactcggagaacggtctactcactatcctacgagacgactataccgaagacataatgtattagaaattacgaacacgtacgtaagtacgtagacgagtacggtatatacgtagtaggacggaacgggacgggaacaggacggtacgttacaggtacttcgttacgacggtcgtcgggcgtaacgg

SEQ ID NO: 227145 - DNA, 213 bp, Homo sapiens
  misc_feature: GYAE6OF01CONIY.7.71.G05.1.454.CMB.1.raw
  modified_base (203)..(213): a, c, t, g, unknown or other
  misc_feature (203)..(213): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctaggtcagcccaaggccaaccccatgtcactctcgttcccaccctcctctagagacacgctgagcgggctggcaaggcgcatagnnnnnnnnnnn

SEQ ID NO: 227146 - DNA, 204 bp, Homo sapiens
  misc_feature: GYAE6OF01DXENY.7.71.G05.1.454.CMB.1.raw
  modified_base (199)..(204): a, c, t, g, unknown or other
  misc_feature (199)..(204): n is a, c, g, or t
tcagcgtgtctctacacgaccggtgctcgatttagtgtcgtcgcaagagagagggggttttggtctgagcctcagtcactgtgttatgtcttcggaactggaccaaggtcaccgtcctagtcagccaagccaaccccatgtcactctcgttcccgccctcctctagagacacgctgagcgggctggcaaggcgcatagnnnnnn

SEQ ID NO: 227147 - DNA, 203 bp, Homo sapiens
  misc_feature: GYAE6OF01DKIXE.7.71.G05.1.454.CMB.1.raw
  modified_base (139)..(139): a, c, t, g, unknown or other
  misc_feature (139)..(139): n is a, c, g, or t
  modified_base (192)..(192): a, c, t, g, unknown or other
  misc_feature (192)..(192): n is a, c, g, or t
  modified_base (198)..(203): a, c, t, g, unknown or other
  misc_feature (198)..(203): n is a, c, g, or t
tcagcgtgtctctacacgaccggtgctcgatttagtgtcgtcgcaagagagagggggttttgtctgagcctcagtcactgtgttatgtcttcggaactgggaccaaggtcaccgtctaggtcagcccaaggccaacccntgtcactctgttccccgcctctctagagacacgctgagcgggctggcaaggcncaatgnnnnnn

SEQ ID NO: 227148 - DNA, 724 bp, Homo sapiens
  misc_feature: GYAE6OF01ECN4O.7.71.G05.1.454.CMB.1.raw
  modified_base (327)..(327): a, c, t, g, unknown or other
  misc_feature (327)..(327): n is a, c, g, or t
  modified_base (437)..(437): a, c, t, g, unknown or other
  misc_feature (437)..(437): n is a, c, g, or t
  modified_base (458)..(458): a, c, t, g, unknown or other
  misc_feature (458)..(458): n is a, c, g, or t
  modified_base (519)..(519): a, c, t, g, unknown or other
  misc_feature (519)..(519): n is a, c, g, or t
tcagcgtgtctctacacgaccggtgctcgatttagtgtcgtcgcaagagagaggggcctggaagccccagctcagcttctcttcctcctgctactctggcctcccagtttcagactaccgaccggagagatttggtcgtttgacacagtcctccgacgcccacccttgttctttgtacctaccggaaggggaaagcgccctaccctcctccgtgacgacggcctaggtcgaaggtggttggttcgggcctaccgtacggtacgtcccgttacggtaacccaaacgaacggtaaaccgtggacccacggcctcccgacggtacccctnacttctagtggcacactacaacggcggccacgcgacaccgtccgacgccgtaggtcgaggtcgagtacgggttgggcgtacggactagtccttacaccgtcaccacctancgaactcgacgcctacggacncggtagaacgtgttcgtatacgttacgtttaatacgttagtacacgtacgtccggtaacgnggttacccgggccggtccggggtcctttaccggtacccggacccgggttaggaaacccgtaggttaagaaccttaataaccggtaaacgttcgtcgggtcggtaacacgtacccgtaccgtagtttcccgttacgttcccgtaacgttccctaccggtttaccccgacttaaccgttcgaacggtactaacggcgttaaacccgg

SEQ ID NO: 227149 - DNA, 208 bp, Homo sapiens
  misc_feature: GYAE6OF01CKVMO.7.71.G05.1.454.CMB.1.raw
  modified_base (203)..(208): a, c, t, g, unknown or other
  misc_feature (203)..(208): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctaggtcagcccaaggccaaccccatgtcactctcgttcccgccctcctctagagacacgctgagcgggctggcaaggcgcatagnnnnnn

SEQ ID NO: 227150 - DNA, 826 bp, Homo sapiens
  misc_feature: GYAE6OF01DYLMK.7.71.G05.1.454.CMB.1.raw
tcagcgtgtctctacacgaccggtgctcgatttagtgtcgtcgcaagagagaggagcccagcactagaagtcggcggtgtttccattcggtgatcagcactgaacacagagactcaccatggaggtttggctgtaacgttgggttttcctcgtttgacttacgttttaaggagggttcgtcctagtcgtacaaggtgactaacggttgggtaggacgtcgggtggggggacggtcggtacggtccgaggccggtagggggaggtccaacgaggtaacgtcctccgttccgtggtcgccgacggtccttcggttcgggtttaccctaccgttacgaggttacggtacctacgggaactgttcgaccgttacggttccggggaccccaccgtaacgccgtaccggaggtaaccggaagggtgttagggacgggtgggtacggtacgttaggttttcgttacgtaggttacggtagggtacggtacgttaaggtttcgttaacgtaaaggttcggtaacgtcggtacgtaaccggtccggttacggtacggggaaaccggtcccgttaacgttacccgtactaccggtaccgtaaccggaagtaacccggaaccttaacggtaacgaacggtaactacgtaacgttagttaaacgttagaacgtacgaactcggtaacgtaccgtacggtaagtacgtacggtagttacgtaactcgtaaacggtggtaaaacggggaagggtacgggaacgttaggggtacggtaaccgtaccggttaacgttaccggttacgtacggttaccggccggttacgggaccggttaccgg

SEQ ID NO: 227151 - DNA, 212 bp, Homo sapiens
  misc_feature: GYAE6OF01DQ6VJ.7.71.G05.1.454.CMB.1.raw
  modified_base (199)..(212): a, c, t, g, unknown or other
  misc_feature (199)..(212): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctagtcagcccaaggccaacccatgtcactctgttcccaccctctctagagacacgctgagcgggctggcaaggcgcatagnnnnnnnnnnnnnn

SEQ ID NO: 227152 - DNA, 207 bp, Homo sapiens
  misc_feature: GYAE6OF01BZF21.7.71.G05.1.454.CMB.1.raw
  modified_base (203)..(207): a, c, t, g, unknown or other
  misc_feature (203)..(207): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctaggtcagcccaaggccaaccccactgtcactctgttcccaccctcctctagagacacgctgagcgggctggcaaggcgcatagnnnnn

SEQ ID NO: 227153 - DNA, 758 bp, Homo sapiens
  misc_feature: GYAE6OF01BT7N9.7.71.G05.1.454.CMB.1.raw
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
  modified_base (491)..(491): a, c, t, g, unknown or other
  misc_feature (491)..(491): n is a, c, g, or t
  modified_base (685)..(685): a, c, t, g, unknown or other
  misc_feature (685)..(685): n is a, c, g, or t
  modified_base (708)..(708): a, c, t, g, unknown or other
  misc_feature (708)..(708): n is a, c, g, or t
  modified_base (748)..(748): a, c, t, g, unknown or other
  misc_feature (748)..(748): n is a, c, g, or t
tcagcgtgtctctacacgaccggtgctcgatttagtgtcgtcgcaagagagaggggcctggaagccccagctcagcttctcttcctcctgctactctggcctcccagtttcagataccaccggagagattgtgttgacacagtctccacgccaccttcggttctttgtccgtaccggaagggggaaacgacgcccctacccctcttccgtgccgacgggccagtcgagcggtgttacggcgtcctacgtcgcgtacgaaccanaacggaactcggaccacggctaccccgacggtcccctaacncgttactaacggttcggtaccgactaaccgttaacccgaaacggtaaccggggcccctaacggttccggaccgtaccgtaaccccgtaacgtccccggtaagtttacccgaagggttccggaccggtagggttgggttacgacgggtacgaacgttctacctaacgttccaacctaaccacgttacnccgtacgacccgtagggtcgtacggacttaggattcggagtttcgactttagtttacttagtacttaagtaacgtacgtaccgggtaacggtcggttccgggaccgggtccgggtacccttcggttcccggtacggtaaccggaacgtaaggtacgtagtaacgtaaccgtagttaccgtggacgctacgtacnccgttagtaccgtgtaccgttanccccgtttccgtacgacccttacgttctaagtacgtaacncggtaaaccg

SEQ ID NO: 227154 - DNA, 732 bp, Homo sapiens
  misc_feature: GYAE6OF01BMSWM.7.71.G05.1.454.CMB.1.raw
tcagcgtgtctctacacgaccggtgctcgatttagtgtcgtcgcaagagagaggggcctggaagccccagctcagcttctcttcctcctgctactctggctcccagtttcagataccaccggagagattgtgttgacacagtctccagcccaccctgtctttgtctccgaggggaaagagcccaccctctcctgcgagggccagtcagagtgttggcgtcctacgtagcctaggtaccaacacgaaacctggaccaggcctcccgacggccccctcgatcctatcggtgcactaccaaacgacgggacccacgtcgggaccacgttccccgaacggccctacgggtttcaaggtgggcgtaacgggttggggttacgtagggaactacggtacttccgtaacttccttccaccgtactctactccaacgtccgtcggacgccgtagaacgtatgtttacgcgttaacgttttaacgttacgtagtaacccgaaacttaccgtaccggttaccggtaacggttccgggtaccccggtcccgggggtacccttacccggtttccgggtaccccggtacgggaacctaagggtacggtacgtaacgtaacccgtaaaacggtacttacggaggtaccgtccgactaccgaacttcgtacgtttaccttaccgtaaccttcccgtttaccccccggtctaaccttacgtaacgtagtaacccggtacgtaacccgg

SEQ ID NO: 227155 - DNA, 203 bp, Homo sapiens
  misc_feature: GYAE6OF02I1Q8Z.7.71.G05.1.454.CMB.1.raw
  modified_base (200)..(203): a, c, t, g, unknown or other
  misc_feature (200)..(203): n is a, c, g, or t
tcagcgtgtctctacacgaccggtgctcgatttagtgtcgtcgcaagagagaggggtttggtctgagcctcagtcactgtgttatgtcttcggaactgggaccaaggtcaccgtcctaggtcagcccaaggccaacccactgtcactctgttcccaccctcctctagagacacgctgagcgggctggcaaggcgcatagnnnn

SEQ ID NO: 227156 - DNA, 206 bp, Homo sapiens
  misc_feature: GYAE6OF02IWCDN.7.71.G05.1.454.CMB.1.raw
  modified_base (203)..(206): a, c, t, g, unknown or other
  misc_feature (203)..(206): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctaggtcagcccaaggccaaccccactgtcactctgttcccgccctcctctagagacacgctgagcgggctggcaaggcgcatagnnnn

SEQ ID NO: 227157 - DNA, 506 bp, Homo sapiens
  misc_feature: GYAE6OF02FSSFG.7.71.G05.1.454.CMB.1.raw
  modified_base (360)..(360): a, c, t, g, unknown or other
  misc_feature (360)..(360): n is a, c, g, or t
tcagcgtgtctctacacgaccggtgctcgatttagtgtcgtcgcaagagagaggggcctggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtggtctgggacagacttcactctcaccatcatcagcctggacncctgaagatgttgctagtttattactgtcaacatcgtaccgagtcggccgtccggggcctacgttcggccctgggaccaagtggatatacaaacgactgtggctgcacatctgtcttcactccttcccgcctactctgatagagac

SEQ ID NO: 227158 - DNA, 204 bp, Homo sapiens
  misc_feature: GYAE6OF02IT64Y.7.71.G05.1.454.CMB.1.raw
  modified_base (202)..(204): a, c, t, g, unknown or other
  misc_feature (202)..(204): n is a, c, g, or t
tcagcgtgtctctacacgaccggtgctcgatttagtgtcgtcgcaagagagaggggttttggtctgagcctcagtcactgtgttatgtcttcggaactgggaccaaggtcaccgtcctaggtcagcccaaggccaaccccactgtcactctgttcccaccctcctctagagacacgctgagcgggctggcaaggcgcatagnnn

SEQ ID NO: 227159 - DNA, 205 bp, Homo sapiens
  misc_feature: GYAE6OF02ILF8K.7.71.G05.1.454.CMB.1.raw
  modified_base (203)..(205): a, c, t, g, unknown or other
  misc_feature (203)..(205): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctaggtcagcccaaggccaaccccactgtcactctgttcccaccctcctctagagacacgctgagcgggctggcaaggcgcatagnnn

SEQ ID NO: 227160 - DNA, 202 bp, Homo sapiens
  misc_feature: GYAE6OF02ILSD3.7.71.G05.1.454.CMB.1.raw
  modified_base (200)..(202): a, c, t, g, unknown or other
  misc_feature (200)..(202): n is a, c, g, or t
tcagcgtgtctctacacgaccggtgctcgatttagtgtcgtcgcaagagagaggggttttggtctgagcctcagtcactgtgttatgtcttcggaactgggaccaaggtcaccgtcctaggtcagcccaaggccaacccactgtcactctgttcccaccctctctagagacacgctgagcgggctggcaaggcgcatagnnn

SEQ ID NO: 227161 - DNA, 263 bp, Homo sapiens
  misc_feature: GYAE6OF02I99FY.7.71.G05.1.454.CMB.1.raw
  modified_base (259)..(263): a, c, t, g, unknown or other
  misc_feature (259)..(263): n is a, c, g, or t
tcagcgtgtctctacacgaccggtgctcgatttagtgtcgtcgcaagagagagggggaaccagcgggagttccaagtactcctttgacgtctggggccagggtaccctggtcaccgtctcctcagcctccaccaagggcccatcggtcttccccctggcgccctgctccaggagcacctccgagagcacagcggccctgggctgcctggtcaaggactacttcctagagcacgctgagcgggctggcaaggcgcatagnnnnn

SEQ ID NO: 227162 - DNA, 210 bp, Homo sapiens
  misc_feature: GYAE6OF02ICJEU.7.71.G05.1.454.CMB.1.raw
  modified_base (201)..(210): a, c, t, g, unknown or other
  misc_feature (201)..(210): n is a, c, g, or t
tcagcgtgtctctacacgaccggtgctcgatttagtgtcgtcgcaagagagaggggttttggtctgagcctcagtcactgtgttatgtcttcggaactgggaccaaggtcaccgtcctaggtcagcccaaggccaaccccactgtcactctgttcccaccctcctctgagacacgctgagcgggctggcaaggcgcatagnnnnnnnnnn

SEQ ID NO: 227163 - DNA, 258 bp, Homo sapiens
  misc_feature: GYAE6OF02H32KF.7.71.G05.1.454.CMB.1.raw
  modified_base (202)..(205): a, c, t, g, unknown or other
  misc_feature (202)..(205): n is a, c, g, or t
  modified_base (207)..(207): a, c, t, g, unknown or other
  misc_feature (207)..(207): n is a, c, g, or t
  modified_base (211)..(213): a, c, t, g, unknown or other
  misc_feature (211)..(213): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (223)..(224): a, c, t, g, unknown or other
  misc_feature (223)..(224): n is a, c, g, or t
  modified_base (226)..(258): a, c, t, g, unknown or other
  misc_feature (226)..(258): n is a, c, g, or t
tcagcgtgtctctacacgaccggtgctcgatttagtgtcgtcgcaagagagagggggtttggtcgtgagcctcagtcactgtgttatgtcttcggaactgggaccaaggtcaccgtctaggtcagcccaaggccaacccatgtcactctgttcccaccgtcctctagagactacgcttgagcgggctggcaaggcgcatagnnnngnagcnnntantncntcnntnnnnnnnnnnnnnnnnnnnnnnnnnnnnnnnnn

SEQ ID NO: 227164 - DNA, 737 bp, Homo sapiens
  misc_feature: GYAE6OF02HY7K9.7.71.G05.1.454.CMB.1.raw
  modified_base (319)..(319): a, c, t, g, unknown or other
  misc_feature (319)..(319): n is a, c, g, or t
tcagcgtgtctctacacgaccggtgctcgatttagtgtcgtcgcaagagagaggagcccagcactagaagtcggcggtgtttccattcgggtgatcagcacgtgaacacagaggactcaccatggagtttggctgaacttgggttttcctcgttgcttcttttaagaggtgtccagtgtcaagtgcaactggtggagtcgtgggggagcgtggtccagcctgggagtcacagagactctcctgtgcagcctgtgggttcaccttcgagtagctacggcatgcacgtcgggtccaccaagcctccgagggacgaagggtntttggacggttgggtggctaggtttgtttcagttcgtggacgggtctaggttcgttacaagtttggtatggactaagtaccttaccgggtaggaacggggtccgtaacgtttaccgaccgtactaccgtaccgaaggtaacgtaacctaacgttaccgaacggaaaccaacgtaaacgtttacgttaacgttttaaggaaaacgtacgaaaccgtaacgtaacccgttaaacggttaccgtaacgggtaacggtaacggttaacgggttacgttaaacgttaacgttaacgttacggtaacgggaacggggtaaccgggggtaaaccgacgggtaccggggtaacgttaaccgtaacggtttaccgtttaccggttacggtaccggttacgggttaccggggtaccggtaacccgggg

SEQ ID NO: 227165 - DNA, 528 bp, Homo sapiens
  misc_feature: GYAE6OF02F6PFV.7.71.G05.1.454.CMB.1.raw
tcagcgtgtctctacacgaccggtgctcgatttagtgtcgtcgcaagagagaggggcctggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcaggtgggtctgggacagacttcactctcaccatcatcagcctggagcctgaacgtatgttgctagtttattactgtcaactatacgtaccgagtttcggccgtccggggcctaccgttcggcccgtacgggaaccgtaaagtacggatactacaacgtaactgtgctgcacatctgtcttcacttccttcccgcctactctagacgagacacg

SEQ ID NO: 227166 - DNA, 698 bp, Homo sapiens
  misc_feature: GYAE6OF02JJXC6.7.71.G05.1.454.CMB.1.raw
  modified_base (276)..(276): a, c, t, g, unknown or other
  misc_feature (276)..(276): n is a, c, g, or t
  modified_base (330)..(330): a, c, t, g, unknown or other
  misc_feature (330)..(330): n is a, c, g, or t
  modified_base (391)..(391): a, c, t, g, unknown or other
  misc_feature (391)..(391): n is a, c, g, or t
tcagcgtgtctctacacgaccggtgctcgatttagtgtcgtcgcaagagagaggagcccagcactagaagtcggcggtgtttcctattcggtgatcagcactgaacacagaggactcaccatggagtttgggctgaactgggttttcctcgttgctcttttaagaggtgtccagtgtcaagtgcaacgtggtgggagtcgtgggggaggcgtggtccgaggccgtggggaggtcacgtaggacgacgtcctcctgtagccagcctcgtgggttacnccttcagtagctacggcatgcactgggtccgaccaagtcctccgaggcaagggngttggagtggggtgtcgtggttgtttccagtccgtgacgggctagttgtacaagttggtanggtacaagtcgtccgggtagaacggggcctagttaccaaccgtagtcctccgaagacgtacctaacgttaccggaacggaacctaacgaattacggtttaagttaacggaaataacggaacgtacgtaacccgttaacgtacggtaacggacggtaaccgaacggggtttagtaaacgttaccgtaacggttacggtacggtaaacggggacggggggtaaaacccgtggaaccggggtaacgtacccggtaaagttaccccggttcgtttaccggacggtccggttaggggtaccccgtaacgggg

SEQ ID NO: 227167 - DNA, 589 bp, Homo sapiens
  misc_feature: GYAE6OF02JCDXB.7.71.G05.1.454.CMB.1.raw
  modified_base (177)..(177): a, c, t, g, unknown or other
  misc_feature (177)..(177): n is a, c, g, or t
  modified_base (275)..(275): a, c, t, g, unknown or other
  misc_feature (275)..(275): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (582)..(582): a, c, t, g, unknown or other
  misc_feature (582)..(582): n is a, c, g, or t
tcagcgtgtctctacacgaccggtgctcgatttagtgtcgtcgcaagagagaggggcctggaagccccagctcagcttctcttcctcctgctactctggctcccagtttcagataccaccggagagattgtgttgacacagtctccagccaccctgtctttgtctccaggggaaagngcccaccctctcctgcagggccagtcagagtgtggcgcctagtgcctggtaccaacagaaacctggaccaggcctcccgaggcccctcatctatggtncactccaagcgggccagtcggcactcccagccaggttcaggtcggcaggttgggtctagggacagaccttcactcncaccntcatcagtccnggacncctaggaancttgtagacttagttttacttacgtcgtacaactacttacggtaccgaggttcggacccggtccggggtaccctacgtttcccggcccggtacggaaccgtaaggtacggaactacaaccgtaaacgtacgtcggtacgactcgaccaccgtactacgttcgtaccttactcttccgttacccgctactcgtagtatacgngtaaccg

SEQ ID NO: 227168 - DNA, 673 bp, Homo sapiens
  misc_feature: GYAE6OF02FQ1XV.7.71.G05.1.454.CMB.1.raw
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
tcagcgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccaggcctggggaggtcacagagactctcctgtgcagcctcgtgggttccaccttcagtagctacggcatgcacgtcgggccnccaagcctccgaggcaagggnttgggagtgggtgctagttgttcatcgtaggaggcagttgttacaagttgggtaatggacaaggtactccggtaggaacgggccgtattccgacccgtctaccgaggaacgactaacttaccgaacggaaccaactaagttgtaagtttaaggaaactcgaaactacggtaccgttaagtccgtaggaacgggtaacgtacgggttacgttaactaaccgttaacgtaggttaaccgggaaggggtaacgggggaacccgtacggggtaccggggtaacgttaacccggtaaacgttaccgttacccgtttaggtacccggttcggtaccggggtacccggtacgggttaccccgg

SEQ ID NO: 227169 - DNA, 210 bp, Homo sapiens
  misc_feature: GYAE6OF02HGSEJ.7.71.G05.1.454.CMB.1.raw
  modified_base (196)..(196): a, c, t, g, unknown or other
  misc_feature (196)..(196): n is a, c, g, or t
  modified_base (202)..(210): a, c, t, g, unknown or other
  misc_feature (202)..(210): n is a, c, g, or t
tcagcgtgtctctacacgaccggtgctcgatttagtgtcgtcgcaagagagagggggttttggtctgagcctcagtcactgtgttatgtcttcggaactgggaccaaggtcaccgtcctaggtcagcccaaggccaaccccatgtcactctgttcccaccctcctctagagacacgctgagcgggctggcaaggcncatagnnnnnnnnn

SEQ ID NO: 227170 - DNA, 216 bp, Homo sapiens
  misc_feature: GYAE6OF02FTLLB.7.71.G05.1.454.CMB.1.raw
  modified_base (206)..(216): a, c, t, g, unknown or other
  misc_feature (206)..(216): n is a, c, g, or t
tcagcgtgtctctacacgaccggtgctcgatttagtgtcgtcgcaagagagagggggttttgggtctgagcctcagtcactgtgttatgtcttcggaactgggaccaaggtcaccgtcctaggtcagcccaaggccaaccccactgtcactctgttcccaccctcctctagagacacgcctgagcgggctggcaaggcgtcatagnnnnnnnnnnn

SEQ ID NO: 227171 - DNA, 766 bp, Homo sapiens
  misc_feature: GYAE6OF02HZ4DE.7.71.G05.1.454.CMB.1.raw
tcagcgtgtctctacacgaccggtgctcgatttagtgtcgtcgcaagagagaggagcccagcactagaagtcggcggtgtttccattcggtgatcagcactgaacacagaggactcaccatggagttttgggctgaacttgggtttttcctcgtttgcttcttttaagaggtgtccagtgtcaagtgcaactggtggagtcgtggggagcgtggtcagccgtgggaggtcacagagactctcctgtacgcagcctcgtggttctaccttcagtagcgtacggcatgctacgtcggtcccacgaagtcctccgaggacgaacgggtgttaggaagggtttcggggcggtacgtaggttttgtttacgacgttacgtggacggtccttaggtttacggttacgtaaggttgggttaacgtacggacgaacggttacccgttacccgggtagggaaaccggggtaccctaacgttttaccggaaccccttagttacccggttacccgaaaggtaaccgtaaaccgtaaccgttacccgaaacggtaaacccgtaactaaacggtttagttaacgtttaggaaaacgttagaaacgtacgtaactttaacgccggttaaggacggtaacgttacggggtaattaacgtaacgttacgtagggtaacggaaaggggtaccgggggaaacgtacgggacgggtacttaacccggaggttacccgttacggtttaaccggaccggttacggtaccggggtaccgtaaccgggg

SEQ ID NO: 227172 - DNA, 753 bp, Homo sapiens
  misc_feature: GYAE6OF02JCVL3.7.71.G05.1.454.CMB.1.raw
  modified_base (196)..(196): a, c, t, g, unknown or other
  misc_feature (196)..(196): n is a, c, g, or t
tcagcgtgtctctacacgaccggtgctcgatttagtgtcgtcgcaagagagaggagcccagcactagaagtcggcggtgtttccattcggtgatcagcactgaacacagaggactcaccatggagttttgggctgaacttgggttttcctcgttgcttcgttttaagaggtgtccagtgtcaagtgactaactggnggagtcgtgggggacgcgtggtccagccgtgggaggtcacgaggagactcctccgtggtcgcgacgtccttcggttacggttctaccttacgaaggtacgtcccgttaacggcctaagttcggtaacctcgggttcgggaccccgtaccgaacggtccctacccgaagggtaccggtaaaggggtcgttacggggaacggttcggggtacgggtcgttaggtttcgtttacgcgttacggtcggaagggtcgttaggtcgttacgtaagttcgttaacgtcgacgtaaccgttcgtacggtaacgggtaacgtccgtacttaccgtaaccgtacgaccgttacggaacgaaacgtaacctaacggttacccgtaaacgaagtaaaccttaacgtttacgtaagttaacggtaagtaacgaaacggtctaaccgttaacgtcgtaacggacggtactaacggtagtactaacgtacgtacgtaacgggtacgggtacgggacgtaggaccgtaacgttacgacgttacgtcgtaggccgtcggtacggtcccgtacgg

SEQ ID NO: 227173 - DNA, 418 bp, Homo sapiens
  misc_feature: GYAE6OF01EBOTL.29.62.F07.1.454.CMB.1.raw
  modified_base (411)..(418): a, c, t, g, unknown or other
  misc_feature (411)..(418): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagtattaaacgactgtgctgcaccatctgtcttcatccttcccgcctatctgtaagtactctatctgagcgggctggcaaggcgacatagnnnnnnnn

SEQ ID NO: 227174 - DNA, 412 bp, Homo sapiens
  misc_feature: GYAE6OF01A0049.29.62.F07.1.454.CMB.1.raw
  modified_base (398)..(398): a, c, t, g, unknown or other
  misc_feature (398)..(398): n is a, c, g, or t
  modified_base (403)..(412): a, c, t, g, unknown or other
  misc_feature (403)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactgggcctgaagatgcatcagtgtattactgtcatcaatatggttcttcagtttcgctcaccttcggccaagggacacgactggagattaaacgactgtggctgcacatctgtcttcatcttccgccatctgaagtactctatctgagcgggctggcaaggcnatagnnnnnnnnnn

SEQ ID NO: 227175 - DNA, 409 bp, Homo sapiens
  misc_feature: GYAE6OF01D47LU.29.62.F07.1.454.CMB.1.raw
  modified_base (400)..(400): a, c, t, g, unknown or other
  misc_feature (400)..(400): n is a, c, g, or t
  modified_base (406)..(409): a, c, t, g, unknown or other
  misc_feature (406)..(409): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactgggcctgaagatgcatcagtgtattactgtcatcaatatggttcttcagtttcgcttcaccttcggccaagggacacgactggagattaaacgactgtggctgcaccatctgtcttcatcttcccgcatctgaagtactctatctgagcgggctggcaaggcncatagnnnn

SEQ ID NO: 227176 - DNA, 412 bp, Homo sapiens
  misc_feature: GYAE6OF01EZN7N.29.62.F07.1.454.CMB.1.raw
  modified_base (406)..(412): a, c, t, g, unknown or other
  misc_feature (406)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagttttcgcttcaccttcggccaagggcacgactggagattaaacgaactgtgctgcaccatctgtcttcatctcccgcatctgaagtactctatctgagcgggctggcaaggcgcatagnnnnnnn

SEQ ID NO: 227177 - DNA, 411 bp, Homo sapiens
  misc_feature: GYAE6OF01CYTJU.29.62.F07.1.454.CMB.1.raw
  modified_base (401)..(401): a, c, t, g, unknown or other
  misc_feature (401)..(401): n is a, c, g, or t
  modified_base (407)..(411): a, c, t, g, unknown or other
  misc_feature (407)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcaccatctgtcttcatcttcccgcctatctgaagtactctatctgagcggctggcaaggcncatagnnnnn

SEQ ID NO: 227178 - DNA, 409 bp, Homo sapiens
  misc_feature: GYAE6OF01D6I03.29.62.F07.1.454.CMB.1.raw
  modified_base (401)..(409): a, c, t, g, unknown or other
  misc_feature (401)..(409): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagattaaacgactgtgctgcaccatctgtcttcatctcccgcatctgaagtctctatctgagcggctggcaaggcgcatagnnnnnnnnn

SEQ ID NO: 227179 - DNA, 407 bp, Homo sapiens
  misc_feature: GYAE6OF01EFLA2.29.62.F07.1.454.CMB.1.raw
  modified_base (320)..(320): a, c, t, g, unknown or other
  misc_feature (320)..(320): n is a, c, g, or t
  modified_base (399)..(407): a, c, t, g, unknown or other
  misc_feature (399)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactgggcctgaagatgcatcagtgtatactgtcatcaatatggttcttcagtttcgctcaccttcggccaagggacacgactgganattaaacgactgtggctgcacatctgtctcatctccgcatctgagtactctatctgagcgggctggcaaggcgcatagnnnnnnnnn

SEQ ID NO: 227180 - DNA, 410 bp, Homo sapiens
  misc_feature: GYAE6OF01DXXZQ.29.62.F07.1.454.CMB.1.raw
  modified_base (405)..(410): a, c, t, g, unknown or other
  misc_feature (405)..(410): n is a, c, g, or t
tcagatagagtactcacgaccggtgctcgatttagtagtcgcataaaggggaaagggccacgttctcctgcagggccagtcaaagtattagcagcagaaacttagcctagtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagattaaacgactgtggctgcacatctgtctcatcttcccgcatctgaagtactctatctgagcgggtctggcaaggcgcatagnnnnnn

SEQ ID NO: 227181 - DNA, 411 bp, Homo sapiens
  misc_feature: GYAE6OF01AYXZ0.29.62.F07.1.454.CMB.1.raw
  modified_base (406)..(411): a, c, t, g, unknown or other
  misc_feature (406)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcaccatctgtcttcatcttcccgcatctgaagtactctatctgagcggctggcaaggcgcatagnnnnnn

SEQ ID NO: 227182 - DNA, 410 bp, Homo sapiens
  misc_feature: GYAE6OF01B34KO.29.62.F07.1.454.CMB.1.raw
  modified_base (404)..(410): a, c, t, g, unknown or other
  misc_feature (404)..(410): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagattaaacgactgtggctgcacatctgtcttcatcttcccgcatctgaagtactctatctgagcgggctggcaaggcgcatagnnnnnnn

SEQ ID NO: 227183 - DNA, 411 bp, Homo sapiens
  misc_feature: GYAE6OF01A1JFG.29.62.F07.1.454.CMB.1.raw
  modified_base (404)..(411): a, c, t, g, unknown or other
  misc_feature (404)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagattaaacgaactgtggctgcacatctgtctcatcttcccgcatctgaagtactctatctgagcggctggcaaggcgcagtagnnnnnnnn

SEQ ID NO: 227184 - DNA, 413 bp, Homo sapiens
  misc_feature: GYAE6OF01BAGOS.29.62.F07.1.454.CMB.1.raw
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
  modified_base (403)..(413): a, c, t, g, unknown or other
  misc_feature (403)..(413): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactgggcctgagatgcatcagtgtatactgtcatcaatatggttcttcagtttcgctcacctttcggccaagggcacgactgganattaaacgactgnggctgcacagtctgtcttcatctccgcatctgaagtactctatctgacgcggntcggcaaggcanatacgnnnnnnnnnnn

SEQ ID NO: 227185 - DNA, 410 bp, Homo sapiens
  misc_feature: GYAE6OF01A8VGI.29.62.F07.1.454.CMB.1.raw
  modified_base (407)..(410): a, c, t, g, unknown or other
  misc_feature (407)..(410): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactgggcctgaagatgcatcagtgtattactgtcatcaatatggttcttcagttttctctcaccttcggccaagggacacgactggagattaaacgaactgtggctgcacatctgtcttcatcttcccgcatctgaagtactctatctgagcgggctggcaaggcgcatagnnnn

SEQ ID NO: 227186 - DNA, 529 bp, Homo sapiens
  misc_feature: GYAE6OF01CPGRS.29.62.F07.1.454.CMB.1.raw
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (480)..(481): a, c, t, g, unknown or other
  misc_feature (480)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(501): a, c, t, g, unknown or other
  misc_feature (500)..(501): n is a, c, g, or t
  modified_base (503)..(504): a, c, t, g, unknown or other
  misc_feature (503)..(504): n is a, c, g, or t
  modified_base (506)..(506): a, c, t, g, unknown or other
  misc_feature (506)..(506): n is a, c, g, or t
  modified_base (508)..(509): a, c, t, g, unknown or other
  misc_feature (508)..(509): n is a, c, g, or t
  modified_base (511)..(511): a, c, t, g, unknown or other
  misc_feature (511)..(511): n is a, c, g, or t
  modified_base (513)..(515): a, c, t, g, unknown or other
  misc_feature (513)..(515): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
tcagatagagtactcacgaccggtgctcgatttagtagtcgcataaagggtaaggggtccgacgttctcctggcagggccacgtcaaagtagttagcagctagaaacttagcctggtaccagcaaaaacctggaccaggctcccaggctcctcatctttgggtgcatctaccgagggtcctacgtggcattacccagaccggttcagtggcagtgggtctggggacaggacgttcgactctcaaccatcaggcaagactgggcctgaagatgtcagtcagttgtaattacngtcatanaatagtggttcttcaggtttcnctacgaccgttcggcgaagggcacggactggaagtaaattaaacggaacttgaggcgtagacacatctagtcttcattctaccgctaatccagaacgttctactatcgtagacggtcgggtctagggccaaagggcctactaagttacgntanananacnnananacganacanancntnncnncncnncncnnncncananangngng

SEQ ID NO: 227187 - DNA, 411 bp, Homo sapiens
  misc_feature: GYAE6OF01AKMDB.29.62.F07.1.454.CMB.1.raw
  modified_base (408)..(411): a, c, t, g, unknown or other
  misc_feature (408)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagttttcgctcaccttcggccaagggacacgactggagattaaacgaactgtggctgcaccatctgtcttcatcttcccgcatctgaacgtctctatctgagcgggctggcaaggcgcatagnnnn

SEQ ID NO: 227188 - DNA, 411 bp, Homo sapiens
  misc_feature: GYAE6OF01B6458.29.62.F07.1.454.CMB.1.raw
  modified_base (334)..(334): a, c, t, g, unknown or other
  misc_feature (334)..(334): n is a, c, g, or t
  modified_base (404)..(411): a, c, t, g, unknown or other
  misc_feature (404)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagataaacgactgnggctgcacatctgtctcatctcccgcatctagaactactctatctgagcggctggcaaggcgacagtagnnnnnnnn

SEQ ID NO: 227189 - DNA, 411 bp, Homo sapiens
  misc_feature: GYAE6OF01BYEF1.29.62.F07.1.454.CMB.1.raw
  modified_base (407)..(411): a, c, t, g, unknown or other
  misc_feature (407)..(411): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcacatctgtcttcatcttcccgcatctgaacgtactctatctgagcggctggcaaggcgcatagnnnnn

SEQ ID NO: 227190 - DNA, 419 bp, Homo sapiens
  misc_feature: GYAE6OF01BVAWY.29.62.F07.1.454.CMB.1.raw
  modified_base (407)..(419): a, c, t, g, unknown or other
  misc_feature (407)..(419): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagttttcgctcaccttcggccaagggcacgactggagattaaacgaactgtggctgcaccatctgtcttcatcttcccgcatctgaatctctatctgagcgggctggcaagggcgcagtagnnnnnnnnnnnnn

SEQ ID NO: 227191 - DNA, 411 bp, Homo sapiens
  misc_feature: GYAE6OF01AG0BO.29.62.F07.1.454.CMB.1.raw
  modified_base (406)..(411): a, c, t, g, unknown or other
  misc_feature (406)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccgggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcacatctgtcttcatcttcccgccatctgaagtactctatctgagcgggctggcaaggcgcatagnnnnnn

SEQ ID NO: 227192 - DNA, 435 bp, Homo sapiens
  misc_feature: GYAE6OF01ADQXD.29.62.F07.1.454.CMB.1.raw
  modified_base (279)..(279): a, c, t, g, unknown or other
  misc_feature (279)..(279): n is a, c, g, or t
  modified_base (428)..(435): a, c, t, g, unknown or other
  misc_feature (428)..(435): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactggggcctggaagatgcatcagtgtattactgtcatcaatntggttcttcagtttcgctcaccttcggccaagggacacgactggagtaattaaacgaactgtggctgcaccatctgttcttcacttccttcccgctatctagaacgttactctatcgtggacgcgggtctcgggacaaggcgcagtagnnnnnnnn

SEQ ID NO: 227193 - DNA, 411 bp, Homo sapiens
  misc_feature: GYAE6OF01EHI8J.29.62.F07.1.454.CMB.1.raw
  modified_base (405)..(411): a, c, t, g, unknown or other
  misc_feature (405)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactggggcctgaagatgcatcagtgtattactgtcatcaatatggttcttcagtttcgctcaccttcggccaagggcacgactggagattaaacgaactgtggctgcaccatctgtcttcatcttcccgcatctgaagtctctatctgagcggctggcaaggcgcatagnnnnnnn

SEQ ID NO: 227194 - DNA, 407 bp, Homo sapiens
  misc_feature: GYAE6OF01BWXGQ.29.62.F07.1.454.CMB.1.raw
  modified_base (321)..(321): a, c, t, g, unknown or other
  misc_feature (321)..(321): n is a, c, g, or t
  modified_base (396)..(396): a, c, t, g, unknown or other
  misc_feature (396)..(396): n is a, c, g, or t
  modified_base (402)..(407): a, c, t, g, unknown or other
  misc_feature (402)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccaggccggttcagtggcagtgggtctgggacagacttcactctcaccatcagcagactggggcctgaagatgcatcagtgtattactgtcatcaatatggttcttcagtttcgctcaccttcggccaagggcacgactgganattaaacgactgtggctgcaccatctgtcttcatcttccgcatctgagtactctatctgagcggctggcaaggcncatagnnnnnn

SEQ ID NO: 227195 - DNA, 411 bp, Homo sapiens
  misc_feature: GYAE6OF01BQ78D.29.62.F07.1.454.CMB.1.raw
  modified_base (404)..(411): a, c, t, g, unknown or other
  misc_feature (404)..(411): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcacatctgtctcatcttcccgcatctgaagtctctatctgagcgggctggcaaggcgcatagnnnnnnnn

SEQ ID NO: 227196 - DNA, 431 bp, Homo sapiens
  misc_feature: GYAE6OF01A2E93.29.62.F07.1.454.CMB.1.raw
  modified_base (423)..(431): a, c, t, g, unknown or other
  misc_feature (423)..(431): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactggggcctgaagatgcatcagtgtattactgtcatcaatatggttcttctagtttcgctcaccgttcggccaagggacacgacgtggagattaaacgaactgtggctgcacatctgtcttcattccttcccgctactctagtaacttactctatctggaggcgggtctgggacaaggcgcagtagnnnnnnnnn

SEQ ID NO: 227197 - DNA, 407 bp, Homo sapiens
  misc_feature: GYAE6OF01ENVXP.29.62.F07.1.454.CMB.1.raw
  modified_base (321)..(321): a, c, t, g, unknown or other
  misc_feature (321)..(321): n is a, c, g, or t
  modified_base (396)..(396): a, c, t, g, unknown or other
  misc_feature (396)..(396): n is a, c, g, or t
  modified_base (401)..(407): a, c, t, g, unknown or other
  misc_feature (401)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgcttcaccttcggccaaggcacgactgganattaaacgactgtggctgcaccatctgtcttcattctcccgcatctagatactctatctgagcggctggcagcgnatagnnnnnnn

SEQ ID NO: 227198 - DNA, 445 bp, Homo sapiens
  misc_feature: GYAE6OF01CPKLF.29.62.F07.1.454.CMB.1.raw
  modified_base (250)..(250): a, c, t, g, unknown or other
  misc_feature (250)..(250): n is a, c, g, or t
  modified_base (437)..(445): a, c, t, g, unknown or other
  misc_feature (437)..(445): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcaggtgggtctgggacagacttcactctcaccatcagcagactgggcctgaagntgcatcagtgtattactgtacatcaatatggttcttcagtttcgctcaccttcggacctaagggacacgactggaagaattaaacgaactgtacggctgaccacatctgtcttcattccttcccgctatctagtaacgtacttctatcgtaggacggtcgggtctgggaaccaagggccgacatagnnnnnnnnn

SEQ ID NO: 227199 - DNA, 425 bp, Homo sapiens
  misc_feature: GYAE6OF01BG0LH.29.62.F07.1.454.CMB.1.raw
  modified_base (253)..(253): a, c, t, g, unknown or other
  misc_feature (253)..(253): n is a, c, g, or t
  modified_base (410)..(410): a, c, t, g, unknown or other
  misc_feature (410)..(410): n is a, c, g, or t
  modified_base (412)..(425): a, c, t, g, unknown or other
  misc_feature (412)..(425): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctaggccaggcgtcccacggctccctcatctttggtgcatctaccagggccactggcatcccagaccggttcagtggcagtgggtctgggacagacttcactctcaccatcagcagactggggcctggaanatgcatcagtgtatactgtcatcaatatggttcttcagtttcgctcaccttcggccaagggcacgactggagattaaacgactgtggctgcaccatctgtcttcatcttcccgcatctgaagttactctatctgagcgggctggcaaggcgcatagnannnnnnnnnnnnnn

SEQ ID NO: 227200 - DNA, 405 bp, Homo sapiens
  misc_feature: GYAE6OF01ESECK.29.62.F07.1.454.CMB.1.raw
  modified_base (401)..(405): a, c, t, g, unknown or other
  misc_feature (401)..(405): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagattaaacgaactgtggctgcacatctgtcttcatctccgcatctgaagtactctatctgagcggctggcaagcgcatagnnnnn

SEQ ID NO: 227201 - DNA, 425 bp, Homo sapiens
  misc_feature: GYAE6OF01AVNQP.29.62.F07.1.454.CMB.1.raw
  modified_base (321)..(321): a, c, t, g, unknown or other
  misc_feature (321)..(321): n is a, c, g, or t
  modified_base (414)..(425): a, c, t, g, unknown or other
  misc_feature (414)..(425): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactgganataaacgatgtggctgcacatctgtcttcactcctcccgctatctagaacgtactctatctgacggtcgggcgtggacaaggcgacagtacgnnnnnnnnnnnn

SEQ ID NO: 227202 - DNA, 416 bp, Homo sapiens
  misc_feature: GYAE6OF01BKZ1G.29.62.F07.1.454.CMB.1.raw
  modified_base (287)..(287): a, c, t, g, unknown or other
  misc_feature (287)..(287): n is a, c, g, or t
  modified_base (335)..(335): a, c, t, g, unknown or other
  misc_feature (335)..(335): n is a, c, g, or t
  modified_base (401)..(401): a, c, t, g, unknown or other
  misc_feature (401)..(401): n is a, c, g, or t
  modified_base (407)..(416): a, c, t, g, unknown or other
  misc_feature (407)..(416): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactggggcctgaagatgcatcagtgtattactgtcatcaatatggttcttnagtttcgctcaccttcggccaaggcacgactggagattaaacgactgnggctgcacatctgtctcactctcccgcatctgaattctctatctgacgtcggctggaccaaggccncatagnnnnnnnnnn

SEQ ID NO: 227203 - DNA, 408 bp, Homo sapiens
  misc_feature: GYAE6OF01BQ6H5.29.62.F07.1.454.CMB.1.raw
  modified_base (396)..(396): a, c, t, g, unknown or other
  misc_feature (396)..(396): n is a, c, g, or t
  modified_base (401)..(408): a, c, t, g, unknown or other
  misc_feature (401)..(408): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagattaaacgactgtggctgcacatctgtcttcatcttcccgctatctgaatctctatctgagcggctggcaaggcnatagnnnnnnnn

SEQ ID NO: 227204 - DNA, 407 bp, Homo sapiens
  misc_feature: GYAE6OF01DKPH7.29.62.F07.1.454.CMB.1.raw
  modified_base (250)..(250): a, c, t, g, unknown or other
  misc_feature (250)..(250): n is a, c, g, or t
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
  modified_base (403)..(407): a, c, t, g, unknown or other
  misc_feature (403)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcaggtgggtctgggacagacttcactctcaccatcagcagacgtgggcctgaagntgcatcagtgtattactgtcatcaatatggttcttcagtttcgctcaccttcggaccaaggcacgactggagattaaacgactgngctgcacatctgtctcatccttcccgctatctagaagtactctatctgagcggctggacaggcnatgnnnnn

SEQ ID NO: 227205 - DNA, 406 bp, Homo sapiens
  misc_feature: GYAE6OF01BHO8H.29.62.F07.1.454.CMB.1.raw
  modified_base (396)..(396): a, c, t, g, unknown or other
  misc_feature (396)..(396): n is a, c, g, or t
  modified_base (402)..(406): a, c, t, g, unknown or other
  misc_feature (402)..(406): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactggggcctgaagatgcatcagtgtattactgtcatcaatatggttcttcagtttcgctcaccttcggccaagggcacgactggagattaaacgactgtgctgcacatctgtcttcatctcccgcatctagagtactctatctgagcggctggcaaggcncatagnnnnn

SEQ ID NO: 227206 - DNA, 435 bp, Homo sapiens
  misc_feature: GYAE6OF01CWRJW.29.62.F07.1.454.CMB.1.raw
  modified_base (423)..(435): a, c, t, g, unknown or other
  misc_feature (423)..(435): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactgggcctgaagatgcatcagtgtattactgtcatcaatatggttcttcagttttcgcttcacctttcggccaagggaccacgactggagtaattaaacgaactgtaggctggcaccatctgtcttcacttccttcccgctatcctagaacgttcctctatctggagcgggctggcaagcgcatagnnnnnnnnnnnnn

SEQ ID NO: 227207 - DNA, 415 bp, Homo sapiens
  misc_feature: GYAE6OF01D5N8A.29.62.F07.1.454.CMB.1.raw
  modified_base (322)..(322): a, c, t, g, unknown or other
  misc_feature (322)..(322): n is a, c, g, or t
  modified_base (407)..(415): a, c, t, g, unknown or other
  misc_feature (407)..(415): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgcttcaccttcggccaagggcacgactgganattaaacgactgtggctgcacatctgtcttcatctcccgcatcagaagtctcttatctgagcgggctggcaacggcgacagtagnnnnnnnnn

SEQ ID NO: 227208 - DNA, 626 bp, Homo sapiens
  misc_feature: GYAE6OF01EBX7O.29.62.F07.1.454.CMB.1.raw
  modified_base (517)..(517): a, c, t, g, unknown or other
  misc_feature (517)..(517): n is a, c, g, or t
tcagatagagtactcacgaccggtgctcgatttagtagtcgcataaaggggaaagggccgacggttctcctgcagggccattcaaagtattagcagcagaaacttagcctggtaccagcaaaaacctggccaggctcccaggctcctcatctttggtgcatctacagggccactggcatcccagaccgttcagtggcagtggtctgggacaggacttcgactctcaccatcagcagacgtggggcctgaagatgcattcagttgtaattctgtcatacaaatagtggttctctagtttcgcttctaccttcggcctaagggcaacgtactcggtaagtactttaaaacggacgttcgtaggactaggccaacccgtattcgtagtccgtttacacgttcccgtttaccccggcctaattcccttacggaaactttaccctccttaagttaccgtacggaagggtccccggggtacttacggggaaccgaaagggttccccggattaaacgttacggnttaccgtagtacgagtactagtacgtactactactacgtacgtacgtacgtacgtacgtacgacgtagtacgtacgagacgtacgacgtagacgtcgacatctcgtgtc

SEQ ID NO: 227209 - DNA, 413 bp, Homo sapiens
  misc_feature: GYAE6OF01BT7HA.29.62.F07.1.454.CMB.1.raw
  modified_base (323)..(323): a, c, t, g, unknown or other
  misc_feature (323)..(323): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (406)..(413): a, c, t, g, unknown or other
  misc_feature (406)..(413): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagttttcgctcaccttcggccaagggacacgactgganattaaacgactgtggctgcaccatctgtcttcatccttcccgcatctgaagtctctatctgagcggntggcaaggcgnatagnnnnnnnn

SEQ ID NO: 227210 - DNA, 431 bp, Homo sapiens
  misc_feature: GYAE6OF01ESYZI.29.62.F07.1.454.CMB.1.raw
  modified_base (413)..(413): a, c, t, g, unknown or other
  misc_feature (413)..(413): n is a, c, g, or t
  modified_base (418)..(431): a, c, t, g, unknown or other
  misc_feature (418)..(431): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactgggcctgaagatgcatcagtgtattactgtcatcaattatggttcttcagttttcgcttcctaccttcggaccaaagggaccacgactggaacgtaattaaacgactgtgctgcacatctgtctcattcctcccgctatctagactctctatctgacgcggctggcgaaggccanatagnnnnnnnnnnnnnn

SEQ ID NO: 227211 - DNA, 444 bp, Homo sapiens
  misc_feature: GYAE6OF01D4MI5.29.62.F07.1.454.CMB.1.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (413)..(444): a, c, t, g, unknown or other
  misc_feature (413)..(444): n is a, c, g, or t
tcagatagagtactcacgaccggtgctcgatttagtagtcgcataaagggaaagggccacgttctcctgcagggccagtcaaagtattagcagtcagaaacttagcctggtaccaggcaaaaacctggccaggctcccaggctcctcatctttggtgcatctaccagggccactggcatcccgagaccggttcagtggcaggtgggtctaggggacagacttcactctcaccatcagcagactgggcctgaagntgcatcagtgtatacngtcatcaatntggttcttcgagtttcgctcaccttcggccaagggacacgactggaagattaaaacgactgaggctgccacatctgtctcatcttccgcatctagatactctatctgacgcggtctggcaaggcgcagtacgnnnnnnnnnnnnnnnnnnnnnnnnnnnnnnnn

SEQ ID NO: 227212 - DNA, 420 bp, Homo sapiens
  misc_feature: GYAE6OF01ECYK2.29.62.F07.1.454.CMB.1.raw
  modified_base (249)..(249): a, c, t, g, unknown or other
  misc_feature (249)..(249): n is a, c, g, or t
  modified_base (323)..(323): a, c, t, g, unknown or other
  misc_feature (323)..(323): n is a, c, g, or t
  modified_base (396)..(396): a, c, t, g, unknown or other
  misc_feature (396)..(396): n is a, c, g, or t
  modified_base (415)..(420): a, c, t, g, unknown or other
  misc_feature (415)..(420): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagntgcatcagtgtattactgtcatcaatatggttcttcagttttcgcttcaccttcggccaagggcacgactgganattaaacgactgtggctgcaccatctgtcttcattccttcccgcattctagaactcttctatctgagcgggtntgggacaagggcacatagnnnnnn

SEQ ID NO: 227213 - DNA, 416 bp, Homo sapiens
  misc_feature: GYAE6OF01EUEZV.29.62.F07.1.454.CMB.1.raw
  modified_base (408)..(416): a, c, t, g, unknown or other
  misc_feature (408)..(416): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagccgcctagagcctgaggattctgccgtttattattgtcttgggcgtagcaactggcctcccgtcacttttggcctaggggacccaagctggagatcagacgaactgtggctgcacatctgtcttcatctccgccatctgaagtactctatctgagcgggctggcaaggcgcatagnnnnnnnnn

SEQ ID NO: 227214 - DNA, 416 bp, Homo sapiens
  misc_feature: GYAE6OF01B9M55.29.62.F07.1.454.CMB.1.raw
  modified_base (408)..(416): a, c, t, g, unknown or other
  misc_feature (408)..(416): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagttttcgctcaccttcggcctaagggcacgactggagattaaacgaactgtggctgcaccatctgtcttcatcttcccgcatctgaagtactctatctgagcgggctggcaaggcgcatagnnnnnnnnn

SEQ ID NO: 227215 - DNA, 684 bp, Homo sapiens
  misc_feature: GYAE6OF01DPJBN.29.62.F07.1.454.CMB.1.raw
  modified_base (280)..(280): a, c, t, g, unknown or other
  misc_feature (280)..(280): n is a, c, g, or t
  modified_base (643)..(643): a, c, t, g, unknown or other
  misc_feature (643)..(643): n is a, c, g, or t
tcagatagagtactcacgaccggtgctcgatttagtagtcgcataaagggaagggtccgacgttctcctcgcagggccagtcaaagtattagcagcaggaaaccttagcctggtaccagcaaaaaccgtggccaggctcccaggctcctcatctttggtgcatctaccagggccactggcatcccagaccgttcagtggcagtgggtctgggacagacttcgactctcaccatcagcagactgggcctgaagatgcatcagtgtattactgtcatcaatntggttcttgagtttcgctcaccgttcggaccaagggaccacgacgtggaacgtaattaaaaccggaacttgggtacggtaccgtacgacctaaccgtagttcgtttgtaccgtttaccgaacgtttcccgtttacccggaccttaacgttccgttaacgtaaaccggtttaccttaacccgtttaacgttaccccgttaagggtaacccgggtaccggggtaccgttaccggggaaccgtaaacggggttacccggaccttaaaggtacgtcggaacgtttactacgtcgtacgaactacgtacgtagtacgtactacgtacgtacgtcgtacgtcgtaccgtacgtacgtaacgtaggtacncgtacgtacgtacgtacgtacggtacgtacgccgtcggtac

SEQ ID NO: 227216 - DNA, 407 bp, Homo sapiens
  misc_feature: GYAE6OF01CPS4V.29.62.F07.1.454.CMB.1.raw
  modified_base (286)..(286): a, c, t, g, unknown or other
  misc_feature (286)..(286): n is a, c, g, or t
  modified_base (401)..(407): a, c, t, g, unknown or other
  misc_feature (401)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttnagtttcgctcaccttcggccaaggcacgactggagataaacgactggtgctgcacatctgtcttcatcttcccgcatctgatactctatctgagcggctggacaggcacagtagnnnnnnn

SEQ ID NO: 227217 - DNA, 439 bp, Homo sapiens
  misc_feature: GYAE6OF01CCI8R.29.62.F07.1.454.CMB.1.raw
  modified_base (249)..(249): a, c, t, g, unknown or other
  misc_feature (249)..(249): n is a, c, g, or t
  modified_base (424)..(439): a, c, t, g, unknown or other
  misc_feature (424)..(439): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagntgcatcagtgtattactgtcatcaatattggttcttcagtttcgctcaccttcggcaagggcacgactggatataaacgactgtgctgcacatctgtcttcacttcctcccgctatctagaacgtctcttatctaggacggtccgggcttcggacgaagggccgtacgaatacgnnnnnnnnnnnnnnnn

SEQ ID NO: 227218 - DNA, 412 bp, Homo sapiens
  misc_feature: GYAE6OF01BF72M.29.62.F07.1.454.CMB.1.raw
  modified_base (399)..(399): a, c, t, g, unknown or other
  misc_feature (399)..(399): n is a, c, g, or t
  modified_base (405)..(412): a, c, t, g, unknown or other
  misc_feature (405)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcaccatctgtcttcatccttcccgcatctgaagtctctatctgagcggctggcaaggcncatagnnnnnnnn

SEQ ID NO: 227219 - DNA, 403 bp, Homo sapiens
  misc_feature: GYAE6OF01CMPAX.29.62.F07.1.454.CMB.1.raw
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (396)..(403): a, c, t, g, unknown or other
  misc_feature (396)..(403): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatgttctntagtttcgctcaccttcggccaagggacacgactggaanataaacgaactgtggctgcacatctgtctcatctccgcatcnacgtctctatctgagcggntggcaggcnatgnnnnnnnn

SEQ ID NO: 227220 - DNA, 557 bp, Homo sapiens
  misc_feature: GYAE6OF01DUNGK.29.62.F07.1.454.CMB.1.raw
  modified_base (543)..(557): a, c, t, g, unknown or other
  misc_feature (543)..(557): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcaggtgggtctgggacagacttcactctcaccatcagcagacgtgggcctgaagatgcatcagtgtacttactgtcatacaattgtggtttcttcgtagttttccgccttaccgtaccgttcgggaacccgaaagggtaccaacggtacttagggaacgttaaacgttaaaaccggaacgttggtacggtacgttaccggaactaaccgtacgtttccgttcgtttaccttaccgtaacctttccccgttaccccgaccttacgttaccgtacggtaacgtttccttacgtacttccgtagggaccggtcgggtacgttagggactaaacgggctaacgtagtacgnnnnnnnnnnnnnnn

SEQ ID NO: 227221 - DNA, 468 bp, Homo sapiens
  misc_feature: GYAE6OF01E58S9.29.62.F07.1.454.CMB.1.raw
  modified_base (251)..(251): a, c, t, g, unknown or other
  misc_feature (251)..(251): n is a, c, g, or t
  modified_base (388)..(388): a, c, t, g, unknown or other
  misc_feature (388)..(388): n is a, c, g, or t
  modified_base (432)..(432): a, c, t, g, unknown or other
  misc_feature (432)..(432): n is a, c, g, or t
  modified_base (438)..(468): a, c, t, g, unknown or other
  misc_feature (438)..(468): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcaggtgggtctgggacagacttcactctcaccatcagcagactggggcctgaagntgcatcagtgtatactgtcatcaatatgttcttcagtttcgctcaccttcggaccaagggaccacgacgtggaatattaaacgacgtgtcggctgacaccatctgtcttcattccctcccgctatctagaacgttcnctatcgtaggacggcgggactggacaaacgggccacgtataggnagtgcnnnnnnnnnnnnnnnnnnnnnnnnnnnnnnn

SEQ ID NO: 227222 - DNA, 707 bp, Homo sapiens
  misc_feature: GYAE6OF01D8JS8.29.62.F07.1.454.CMB.1.raw
  modified_base (163)..(163): a, c, t, g, unknown or other
  misc_feature (163)..(163): n is a, c, g, or t
  modified_base (201)..(201): a, c, t, g, unknown or other
  misc_feature (201)..(201): n is a, c, g, or t
  modified_base (677)..(707): a, c, t, g, unknown or other
  misc_feature (677)..(707): n is a, c, g, or t
tcagatagagtactcacgaccggtgctcgatttagtagtcgcataaagggggaaaggggccacggttctcctgtcagggccagttcaaagtattagcagcagaaacttagcctggtaccagcaaaaacctggccagggctccaggctccttcagtctttggtnacaatctaccagggccactggacatcccagaccggttnagtggcaggtgggtctgggacagtacttcatctcgaccgatcagcacgacctggggacctgaagtatcggccaagtccgaggttcgtacttaccgtcgtcattaccaattacgttacgggttcctttacgtacggtttttccgcccttccgtaaccccgttttcccggggacccctaaacgggggaacctaacggtaccttacgggtaacggtaacggttttaaaaacccgaacgttggtaccgggaccgttcggtacccgtaacccgtacgtttccccgtttagggtttaacccctttaccggtaaccttttaccccgtttaccccccggaacccgttaaacggtttcccggtttaacgggtaaaccggttttaacccgttcccggttaaggtttcccggtttacgggaaccgggggttaccccgggggctttaacgggggaccgtaaacggggcccgaaccgtatacggcatgnnnnnnnnnnnnnnnnnnnnnnnnnnnnnnn

SEQ ID NO: 227223 - DNA, 613 bp, Homo sapiens
  misc_feature: GYAE6OF01C0AO7.29.62.F07.1.454.CMB.1.raw
  modified_base (581)..(581): a, c, t, g, unknown or other
  misc_feature (581)..(581): n is a, c, g, or t
  modified_base (584)..(613): a, c, t, g, unknown or other
  misc_feature (584)..(613): n is a, c, g, or t
tcagatagagtactcacgaccggtgctcgatttagtagtcgcataaagggaaagggccacgttctcctgcagggccagtcaaagtattagcagcagaaacttagcctggtaccagacaaaaacctggccaggctcccaggctcctcatctttggtgcatctaccagggccactggcatccccagaccggttcagtggcaggtgggtctgggacagacttcactctcaccatcagcagacgtggggcctggaggtattcgtgtccgttttattatttgttcttgggtcgttagctaacgtcggtccctccccgtctaccgtttttgggcccgtaaggggggaccctaaaggcccgttaggggaacgtagttaccgaaggaacggtaaaccgtgggttcggggtccttcgggacctaaccctaagttccctttcggttccttttcctaactttccctttcccccggaccctaactttaccgttacggtaaaacgtttacccttaccttaacgtttccgtacgggacgggtccgggggtacgttacggggaccgtaaaacggggcccgtaacgtaaggttacgngcnnnnnnnnnnnnnnnnnnnnnnnnnnnnnn

SEQ ID NO: 227224 - DNA, 512 bp, Homo sapiens
  misc_feature: GYAE6OF01CM0ZB.29.62.F07.1.454.CMB.1.raw
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (472)..(473): a, c, t, g, unknown or other
  misc_feature (472)..(473): n is a, c, g, or t
  modified_base (475)..(476): a, c, t, g, unknown or other
  misc_feature (475)..(476): n is a, c, g, or t
  modified_base (478)..(480): a, c, t, g, unknown or other
  misc_feature (478)..(480): n is a, c, g, or t
  modified_base (482)..(487): a, c, t, g, unknown or other
  misc_feature (482)..(487): n is a, c, g, or t
  modified_base (489)..(495): a, c, t, g, unknown or other
  misc_feature (489)..(495): n is a, c, g, or t
  modified_base (497)..(508): a, c, t, g, unknown or other
  misc_feature (497)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
tcagatagagtactcacgaccggtgctcgatttagtagtcgcataaagggaaggggccacgttctcctcgcagggccagtcaaagtattagcagcagaaaccttagcctggtaccagcaaaaacctggccaggctcccgaggcgtcctcactcttttggtgcatctaccagggccactgggcactcccagaccggttcagtggcagtgggtctggggacaggacttcacgtctacgaccatcgagcgagacgtggggcctggaacgatgcagtcacgtgtattactgtacatnaatatggttcttcgagtttcnctcaccgtttcggccgtaagggacacggacgtgggaagattaaacgaactgtggctgacaaccatctgtcttcaacttccttacccggctacgttcacgtaacgtacctcgtatccgtgacggtcgggtactagggaccaaggccgactaagtacggnngnngnnncnnnnnncnnnnnnngnnnnnnnnnnnngngn

SEQ ID NO: 227225 - DNA, 482 bp, Homo sapiens
  misc_feature: GYAE6OF01C05FN.29.62.F07.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (364)..(364): a, c, t, g, unknown or other
  misc_feature (364)..(364): n is a, c, g, or t
  modified_base (466)..(482): a, c, t, g, unknown or other
  misc_feature (466)..(482): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcctagaccggttcaggtggcaggtgggtctgggacngacttcactctcaccntcagcagacgtgggcctagaagatgacatcgtagtgtattactgtcatcaattacgtgtttcttctagtttcgctctaccgttcgacgaaggacacgtacgtggaagtagttaaacgacgtgcggctcgacactntctcgtcttacgtactccgtcccactactcgtacgtaattaccgtacttagtaccgtaggacggtcggtaccgttagggaccgtaaagggcctacgaatcgnnnnnnnnnnnnnnnnn

SEQ ID NO: 227226 - DNA, 467 bp, Homo sapiens
  misc_feature: GYAE6OF01CK3MT.29.62.F07.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (429)..(429): a, c, t, g, unknown or other
  misc_feature (429)..(429): n is a, c, g, or t
  modified_base (453)..(467): a, c, t, g, unknown or other
  misc_feature (453)..(467): n is a, c, g, or t
tcagatagagtactcacgaccggtgctcgatttagtagtcgcataaaagggaaagggccacgttctcctgcagggccagtcaaagtattagcagcagaaacttagcctggtaccagacaaaaacctggccaggctcccaggctcctcatctttggtgcatctaccagggccactggcatcccagaccggttcagtggcaggtgggtctgggacagacttcactctcaccntcagcagacgtgggcctgaagntgctatcagttgtattactgtacatcaattgttggtttcttctagtttcgacttcctaccttcggaccaagggacacggatggaagtattaaacgacgtgtcggctgacacattctgtcttcacttcccttcccgctattcgtactacgtacttctatcgtggacggtcgggtacgnggaccgtaacggcgactagtagcnnnnnnnnnnnnnnn

SEQ ID NO: 227227 - DNA, 506 bp, Homo sapiens
  misc_feature: GYAE6OF01DSWV9.29.62.F07.1.454.CMB.1.raw
  modified_base (256)..(256): a, c, t, g, unknown or other
  misc_feature (256)..(256): n is a, c, g, or t
  modified_base (487)..(506): a, c, t, g, unknown or other
  misc_feature (487)..(506): n is a, c, g, or t
tcagatagagtactcacgaccggtgctcgatttagtagtcgcataaaagggggaaagggccacgttctcctgcagggccagtcaaagtattagcagcagaaacttagcctggtaccagcaaaaacctggccaggctcccaggctcctcatctttggtgcatctaccagggccactggcatccccagaccggttcagtggcaggtgggtctggggacagacttcactctcaccatcagcagacgtggggcctgaagntgcatcagtgtaattactgtcatcaattattggttctttactagttttccgcttccaccgtttcggaccgaaagggccaacgactggaagtaacttaaaacgactggtggctcgactacattctgttcttctacttccttaccccgctacttctagtaacgttccttacttaattcgtaggtacgggtcccgggtacttcggggaccgtaacgggccgtactaagttacgnnnnnnnnnnnnnnnnnnnn

SEQ ID NO: 227228 - DNA, 543 bp, Homo sapiens
  misc_feature: GYAE6OF01EEB9Q.29.62.F07.1.454.CMB.1.raw
  modified_base (508)..(508): a, c, t, g, unknown or other
  misc_feature (508)..(508): n is a, c, g, or t
  modified_base (512)..(543): a, c, t, g, unknown or other
  misc_feature (512)..(543): n is a, c, g, or t
tcagatagagtactcacgaccggtgctcgatttagtagtcgcataaagggaaagggccacgttctcctgcagggccagtcaaagtattagcagcagaaacttagcctggtaccagacaaaaaaccctggccaggctcccaggctcctcatctttggtgcatctaccagggccactggcatcccagaccggttcagtggcagtgggtctgggacagacttcactctcaccatcagcagactgggcctgaagatgcatcagtgtattactgtcatcaatattggttcttcagtttcgcttcaccgttcggaccaagggaccacgactaggaagtaacttaaaacgaacttggtcggacttggaccaaccgtatcgttcgttcctttaccaacgtttcccgttcccccgacctaattcctaaggtaaacgttaccttacttaagttcctagggtaaacgggtccggggtacctaggggaacccgtaaacggggccgtactaaagttacggnacgnnnnnnnnnnnnnnnnnnnnnnnnnnnnnnnn

SEQ ID NO: 227229 - DNA, 586 bp, Homo sapiens
  misc_feature: GYAE6OF01CRDJJ.29.62.F07.1.454.CMB.1.raw
  modified_base (251)..(251): a, c, t, g, unknown or other
  misc_feature (251)..(251): n is a, c, g, or t
  modified_base (559)..(586): a, c, t, g, unknown or other
  misc_feature (559)..(586): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagcgtggggcctggaagntgcatcagtgtattactgtctatcaattagttggtttcttcgtagtttccgctcctaccgtttcggaccgaagggtaccacggtacgtagggtaagtaaactttaaaaccggacgttggtcgggtctttacgggtaaccctagtttccttacggttttccctttacgtaaccgttttcccgtttaccccccggtacctaaacgtttcccgttaaacggttaacggtttacccttacgtttaacgttccgttacgggaacgggtccggggttacgtacgggacgaaacgggtccgtacgtaagtagcannnnnnnnnnnnnnnnnnnnnnnnnnnn

SEQ ID NO: 227230 - DNA, 487 bp, Homo sapiens
  misc_feature: GYAE6OF01EGPYM.29.62.F07.1.454.CMB.1.raw
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (458)..(474): a, c, t, g, unknown or other
  misc_feature (458)..(474): n is a, c, g, or t
  modified_base (476)..(487): a, c, t, g, unknown or other
  misc_feature (476)..(487): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctggggacagacttcactctcaccatcagcagactggggcctgaagatgcatcagtgtattactgtcatcaattattggttctttctagtttcgcctctaccgttcggaccaagggacacgacgtaggaagtaattaaaacgactggtggctgaccacatctgtcttcattcctcccgctactctagtaactactcttatcgtaggacgggtcgggtactcgggacgaaagggcgtaacgtaagtaggnantannnnnnnnnnnnnnnnngnnnnnnnnnnnn

SEQ ID NO: 227231 - DNA, 588 bp, Homo sapiens
  misc_feature: GYAE6OF01BRVQW.29.62.F07.1.454.CMB.1.raw
  modified_base (555)..(555): a, c, t, g, unknown or other
  misc_feature (555)..(555): n is a, c, g, or t
  modified_base (558)..(588): a, c, t, g, unknown or other
  misc_feature (558)..(588): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagacgtgggcctagaagatgcatcagttgttattactgtcatcaattgttgttcttctagtttccgctcctaccgttcggaccgtaaggaccacgtacgtaggaacgtaacgtaaaacgaacgttggtaggcttacgacctaacccgattctttacggtttcctttaccgtaccgttttccccgtttacccccgtaccttacgttaccgtttaaggttaaacccgttttaccttaccgttacgtttacgtaacggggtaccggggttccgggtacccggttacggggaaaccgtaaccgggggtcccaacgttaaacggtancgnnnnnnnnnnnnnnnnnnnnnnnnnnnnnnn

SEQ ID NO: 227232 - DNA, 447 bp, Homo sapiens
  misc_feature: GYAE6OF01B1JXD.29.62.F07.1.454.CMB.1.raw
  modified_base (432)..(432): a, c, t, g, unknown or other
  misc_feature (432)..(432): n is a, c, g, or t
  modified_base (436)..(447): a, c, t, g, unknown or other
  misc_feature (436)..(447): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctatgatgcatccaacagggccactggcatcccagccaggttcagtggcagtgggtctgggacagacttcactctcaccatcacgcccgcctagacgcctaggaggattctgccgttttattattgtcttgggcgtagcaacgtggccctcccgtctacgttttcggccgtaggggacccaaggcgttggagtatcagacaacgtggtaggctgcaccatctgtcttcatccttcccgctatctcgaagttctctactctggagtcgggctgggcaggcgctanacgnnnnnnnnnnnn

SEQ ID NO: 227233 - DNA, 613 bp, Homo sapiens
  misc_feature: GYAE6OF01BRWVE.29.62.F07.1.454.CMB.1.raw
  modified_base (529)..(529): a, c, t, g, unknown or other
  misc_feature (529)..(529): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (582)..(613): a, c, t, g, unknown or other
  misc_feature (582)..(613): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccatggcatcccagaccggttcagtggcaggtgggtctgggacagacttcactctcaccatcagcagacgtgggcctagaagatgcatcaagtagttacttacgtgtacctagttacctaaagtatttcggtttaccttacgttagttttccgccttaccgtaaccccgtttccgggaacccgtaacggggacctaaccggtacgttacgggaactaaaacgttaaaaaccggaacgttggtccggtacgtacggtacccgaaccgttacgttccgtttcgttaccctttcgtaacccgtttccccgttacccccgtactaaccgtttacgttaccgtaaacgttaaccttcgtaaccgttntacgggaacggtccgggtcgtaacgggaccgtaacgggctaactaagngtngnnnnnnnnnnnnnnnnnnnnnnnnnnnnnnnn

SEQ ID NO: 227234 - DNA, 732 bp, Homo sapiens
  misc_feature: GYAE6OF01APOSC.29.62.F07.1.454.CMB.1.raw
  modified_base (602)..(602): a, c, t, g, unknown or other
  misc_feature (602)..(602): n is a, c, g, or t
  modified_base (611)..(611): a, c, t, g, unknown or other
  misc_feature (611)..(611): n is a, c, g, or t
  modified_base (728)..(728): a, c, t, g, unknown or other
  misc_feature (728)..(728): n is a, c, g, or t
tcagatagagtactcacgaccggtgctcgatttagtagtcgcataaagggaaagggggccacgttctcctgcagggccagtcaaagtattagcagcagaaacttagacctggtaccagcaaaaacctggccaggcctccacggctcctcatcttgtgcatctacgaggccacgtcgacactccgagtaccggttcagtgcacggtgggtctgggacacggaccgttacgaccgtctacgacctactcacgctacggtacgtcgggactagaacgtatacgacaagttacgaaggtttactacttacgtcgtactaactacgtaaaattcgttacggttactacgttaacggtttccgaaccttaccgtcccgttaacgggacccgaaagggtaccctaaacggtccgttaaaggaaacggttaaaccgtttaaaaccgacggttcgggttaccgggtaccacggtaacccaacctagttccgtacgttacttacgtactttcccgtaccgtactacttacgagggttaaacctacttgtaactcggtagtacgggtccgggtacgttacggaacgggtaacgtcggtaccgtaagacggtanaccggttancgtacgacgtacgtacgtacgaccgtactaacgtagtagtactacgtacgtacgtacgtacgtacggtacggtggtaggtacggtacggtacgacgtacgtacgtacgtacgtcgtntacg

SEQ ID NO: 227235 - DNA, 539 bp, Homo sapiens
  misc_feature: GYAE6OF01CRUPD.29.62.F07.1.454.CMB.1.raw
  modified_base (155)..(155): a, c, t, g, unknown or other
  misc_feature (155)..(155): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (481)..(481): a, c, t, g, unknown or other
  misc_feature (481)..(481): n is a, c, g, or t
  modified_base (510)..(539): a, c, t, g, unknown or other
  misc_feature (510)..(539): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtncatctaccagggccactggcatcccagtaccggttcagtggcaggtgggtctggggacagtacttcactctcacatcagcagacgtgggcctgaaagntcganatcagtgtaattacgngtactagtactaattagttcggttctttacgttaacggttttccgccttaccgtaccggtttaccggaccgtaaaacggggcaacggtaacgtaggaaacgtaaacgttaaaccgaagtggtcgacgtacgactaccgtattcttgtaccttcgtaacttcccttacgctattcgagtagttctatacgttgacggaggtcccggtnacgggtacgaaggccgtaagtaagagcannnnnnnnnnnnnnnnnnnnnnnnnnnnnn

SEQ ID NO: 227236 - DNA, 574 bp, Homo sapiens
  misc_feature: GYAE6OF01ENGUA.29.62.F07.1.454.CMB.1.raw
  modified_base (540)..(540): a, c, t, g, unknown or other
  misc_feature (540)..(540): n is a, c, g, or t
  modified_base (542)..(545): a, c, t, g, unknown or other
  misc_feature (542)..(545): n is a, c, g, or t
  modified_base (547)..(574): a, c, t, g, unknown or other
  misc_feature (547)..(574): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcaggactggggcctagaagatgctatcagtgtattactgtcatacaattagttggttctttcgtagttttccgccttccgtacccgttccgggacccgaaaggggacctaacggtacggtacggaaagtaacttaaaaccggaacgttggtacggcctgaccaccgtacttacgtgttaccttactaccttcccgttccccgctaacttctacggtaacgttaccttctaacgttcgtgggtaacccgggtccggggtaccgttagggaacccggtaaacggggtccctaccgtaaggttacgcgtancnnnngnnnnnnnnnnnnnnnnnnnnnnnnnnnn

SEQ ID NO: 227237 - DNA, 528 bp, Homo sapiens
  misc_feature: GYAE6OF01BLLJI.29.62.F07.1.454.CMB.1.raw
  modified_base (256)..(256): a, c, t, g, unknown or other
  misc_feature (256)..(256): n is a, c, g, or t
  modified_base (504)..(528): a, c, t, g, unknown or other
  misc_feature (504)..(528): n is a, c, g, or t
tcagatagagtactcacgaccggtgctcgattttagtagtcgcataaaggggaaagggccacgttctcctgcagggccagtcaaagtattagcagcagaaaccttagcctggtaccagcaaaaacctggccaggctcccgaggctcctcatcgtttggtgcatctaccagggccactggcatcccagaccggttcagtggcaggtgggtctgggacagacttcactctcaccatcagcagacgtggggcctgaagntgcatcgagtgttattactgtcatacaattagttggtttccttcgtagttttccggccttccgtacccgtttcgggacccaaggggaccacggtacgtagggaacgtaattaaaacggaacgttggtggcgttagccacctattctgttccttcacttcccttcccgactattcctagtaacgttactcgttaactcgtaggacgggtcggtacgtcgggaacgacgggtccacgttaagagtcagcnnnnnnnnnnnnnnnnnnnnnnnnn

SEQ ID NO: 227238 - DNA, 609 bp, Homo sapiens
  misc_feature: GYAE6OF01CON8Z.29.62.F07.1.454.CMB.1.raw
  modified_base (577)..(578): a, c, t, g, unknown or other
  misc_feature (577)..(578): n is a, c, g, or t
  modified_base (580)..(609): a, c, t, g, unknown or other
  misc_feature (580)..(609): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatattcggttactttcaaggttttcgccttacctacctttccgggaccctaaaagggggacccaacggacgttagggaacgtaagttttaaaaaccggaaaaccttggttaggggcctttaggaccctaacccgtaagttcccttaggtttccttttactaaacgttttcccctttccccccggtaacccctaatttcccgtagggtaaaacgtttaacccttccttaaacgttccgttagggtaacgggcccgggggtattacgggggtaccaaaagggggttccgtaccgaaagttaaggnntnnnnnnnnnnnnnnnnnnnnnnnnnnnnnn

SEQ ID NO: 227239 - DNA, 566 bp, Homo sapiens
  misc_feature: GYAE6OF01BJU2D.29.62.F07.1.454.CMB.1.raw
  modified_base (156)..(156): a, c, t, g, unknown or other
  misc_feature (156)..(156): n is a, c, g, or t
  modified_base (476)..(476): a, c, t, g, unknown or other
  misc_feature (476)..(476): n is a, c, g, or t
  modified_base (530)..(531): a, c, t, g, unknown or other
  misc_feature (530)..(531): n is a, c, g, or t
  modified_base (533)..(533): a, c, t, g, unknown or other
  misc_feature (533)..(533): n is a, c, g, or t
  modified_base (535)..(566): a, c, t, g, unknown or other
  misc_feature (535)..(566): n is a, c, g, or t
tcagatagagtactcacgaccggtgctcgattttagtagtcgcataaaggggaaagggccacgttctcctgcagggccattcaaagtattagcagcagaaacttagcctggtaccagcaaaaacctggccaggctcccagctcctcatctttggtncatctaccagggccactggcatcccagaccggttcagtggcaggtgggtctgggacagacttcactctacaccatcagcagacgtcgggtcctagaagatgcatcgagttgttattacgtgtacatactaattagttcggtttcttacgtagtttccgacttccgtaccgtttcggaccgaaaggggtccacggtacgtagggaaacttaacgttaaaaccgacgttggtcggacttcgaccaactagttcgttcgttccttcgtaccttacccgttcccgacctaagttcgtaacggttaacttcccgttaacgttcgngttacgggaaccggtcgggtaccgttaggacggtaacgggctaacgtagtacgnngngnnnnnnnnnnnnnnnnnnnnnnnnnnnnnnnn

SEQ ID NO: 227240 - DNA, 508 bp, Homo sapiens
  misc_feature: GYAE6OF01CG7G6.29.62.F07.1.454.CMB.1.raw
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
  modified_base (468)..(468): a, c, t, g, unknown or other
  misc_feature (468)..(468): n is a, c, g, or t
  modified_base (470)..(471): a, c, t, g, unknown or other
  misc_feature (470)..(471): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (483)..(508): a, c, t, g, unknown or other
  misc_feature (483)..(508): n is a, c, g, or t
tcagatagagtactcacgaccggtgctcgatttagtagtcgcataaagggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcancagactggggcctgaagntgcatcagtgtattactgtcatcaattattggtttcttacgtagttttccgccttcctaccgttcggaccgaacgggactacgactagggataagttaaacgactggtcgcngaccactnttcctntccttcactttcctcccgctatctagtaactctcttacnccgtaggacgggtccggcttacgggaactaaccgggcgtacctaagacgtcngnngngtangacncnnnnnnnnnnnnnnnnnnnnnnnnnn

SEQ ID NO: 227241 - DNA, 487 bp, Homo sapiens
  misc_feature: GYAE6OF01EGJM9.29.62.F07.1.454.CMB.1.raw
  modified_base (379)..(379): a, c, t, g, unknown or other
  misc_feature (379)..(379): n is a, c, g, or t
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
  modified_base (467)..(487): a, c, t, g, unknown or other
  misc_feature (467)..(487): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagttgtattactgtcatactaatattggtttcttctagttttccgccttcctaccgttcggccgaaaggggaccaacgacgtgggaagtaacttaaacggaatgtcggtctcgactaacctnttctgttccttcacttccctcccgcctatcctagtaaacgttctcttactcgtgacgggcgggtntcgggacgacggcctanagtagnnnnnnnnnnnnnnnnnnnnn

SEQ ID NO: 227242 - DNA, 559 bp, Homo sapiens
  misc_feature: GYAE6OF01DTBU0.29.62.F07.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (525)..(525): a, c, t, g, unknown or other
  misc_feature (525)..(525): n is a, c, g, or t
  modified_base (527)..(559): a, c, t, g, unknown or other
  misc_feature (527)..(559): n is a, c, g, or t
tcagatagagtactcacgaccggtgctcgatttagtagtcgcataaaaggggaaagggccacgttctcctgcagggccagtcaaagtattagcagcagaaacttagcctggtaccagacaaaaacctggccaggcctcccaggctcctcattctttggtgcatctaccgagggccactggcactcccaggtacccggttcaggtggcgtaggtggggtcgtggggacaggtacttcactctcaccatcagcagacgtcgggcctagaagntgctatcgtagttnttacttacgtntctatactaattagttcggtttctttacgttaggtttccgaccttaccgtacccgttccggacggaacgggaccacggtagtaggaagtaaacgttaaacgacgtggtacggctacgacctactagttctgttccttactacgtttcccacccgtactacgttacgtagtaaccgttcctacggtagggaccgggtcgggttcgagggaccgtaacggcctagaagtcgncnnnnnnnnnnnnnnnnnnnnnnnnnnnnnnnnn

SEQ ID NO: 227243 - DNA, 456 bp, Homo sapiens
  misc_feature: GYAE6OF01EO8OX.29.62.F07.1.454.CMB.1.raw
  modified_base (286)..(286): a, c, t, g, unknown or other
  misc_feature (286)..(286): n is a, c, g, or t
  modified_base (345)..(345): a, c, t, g, unknown or other
  misc_feature (345)..(345): n is a, c, g, or t
  modified_base (423)..(423): a, c, t, g, unknown or other
  misc_feature (423)..(423): n is a, c, g, or t
  modified_base (428)..(456): a, c, t, g, unknown or other
  misc_feature (428)..(456): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcaggtgggtctgggacagacttcactctcaccatcagcagactgggcctgaagatgcatcagtgtattactgtcatcaattatggttcttnagtttcgctcaccttcggccaaggcacgactggataattaaacgaactggtgctgcacntctgtcttcatcctcccgctatctagaacgttctcttatcgtggacgtccgggcttgggacaacgggctacgatagcngactnnnnnnnnnnnnnnnnnnnnnnnnnnnnn

SEQ ID NO: 227244 - DNA, 587 bp, Homo sapiens
  misc_feature: GYAE6OF01A12EE.29.62.F07.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (550)..(550): a, c, t, g, unknown or other
  misc_feature (550)..(550): n is a, c, g, or t
  modified_base (557)..(557): a, c, t, g, unknown or other
  misc_feature (557)..(557): n is a, c, g, or t
  modified_base (561)..(580): a, c, t, g, unknown or other
  misc_feature (561)..(580): n is a, c, g, or t
  modified_base (582)..(587): a, c, t, g, unknown or other
  misc_feature (582)..(587): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtncatctacagggccactggcatcccgagaccgttnagtggcaggtgggtctgggacagtacttcactctcacatcagcagcgtgggcctagagatgctatctagttgtattctgtnaatctaaagttcgtttcggtttcttaccgttaggttttccnccttaccggtacccgtttaccggaccgaacgggtacctaacggacgtagggaacgtaaacgttaaacggtaacttgggtcggtcgtaccgactaccctagttcgtttactaccgttactaccgtttccccgtaacccgtaccttacgttaccttaacgggtaaactttccttacttacgttacgtacgggtaccggccgggttaacgcgggaaccgaacggttccagtacgttgagtcnagcttgnagtnnnnnnnnnnnnnnnnnnnncnnnnnn

SEQ ID NO: 227245 - DNA, 646 bp, Homo sapiens
  misc_feature: GYAE6OF01ETFYV.29.62.F07.1.454.CMB.1.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (559)..(559): a, c, t, g, unknown or other
  misc_feature (559)..(559): n is a, c, g, or t
  modified_base (567)..(567): a, c, t, g, unknown or other
  misc_feature (567)..(567): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (600)..(600): a, c, t, g, unknown or other
  misc_feature (600)..(600): n is a, c, g, or t
  modified_base (607)..(607): a, c, t, g, unknown or other
  misc_feature (607)..(607): n is a, c, g, or t
  modified_base (640)..(640): a, c, t, g, unknown or other
  misc_feature (640)..(640): n is a, c, g, or t
tcagatagagtactcacgaccggtgctcgatttagtagtcgcataaagggggaaagggccacgttctcctgcagggccagtcaaagtattagcagcagaaacttagcctggtaccagacaaaaacctggccaggctcccaggctcctcatctttggtgcatcctaccagggccacgtcgcatcccagaccggttcagtggcagtgggtctgggacagacttcactcgtcaccatcagcagcgtgggcctagagntgcatcagtcgtatactgtcatcaagtntgttcttcgtagtttccgctacctacccgttcggaccggtaacggtaccacgtaacgtgggaactaaacgtttaaaaccggacgttgggtacgtcctacgggacctaacgtacgttcgttaccgtacctttaccgaaccttttcccccgtaccccggttaccctaacgtttcgaacgggttaacctttaaccgtttcgttaaaccgttcggtagggtaacccgggtcgggtaacccgttacgggaaccgtaacgggtccgtaacgttaaccgggtanacgtacgngtagcgacngtaccngtcngacntacgacgacncgtacgnacgagtcgagatcgacgctacgtactatacacngtctag

SEQ ID NO: 227246 - DNA, 604 bp, Homo sapiens
  misc_feature: GYAE6OF01CMBY3.29.62.F07.1.454.CMB.1.raw
  modified_base (146)..(146): a, c, t, g, unknown or other
  misc_feature (146)..(146): n is a, c, g, or t
  modified_base (157)..(157): a, c, t, g, unknown or other
  misc_feature (157)..(157): n is a, c, g, or t
  modified_base (265)..(265): a, c, t, g, unknown or other
  misc_feature (265)..(265): n is a, c, g, or t
  modified_base (534)..(534): a, c, t, g, unknown or other
  misc_feature (534)..(534): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
  modified_base (570)..(573): a, c, t, g, unknown or other
  misc_feature (570)..(573): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
tcagatagagtactcacgaccggtgctcgatttagtagtcgcataaagggaaagggccacgttctcctgcagggccagtcaaagtattagcagcagaaacttagcctggtaccagacaaaaacctgaccaggctcccaggctcctnattctttggtncatctaccgagggccacgtggctactcccaggtaccggttcaggtggctaggtcgggtctagggactagaccttcactctcacctatcagcagcgtgggcctagaagntgacatcgagttcgttaattactcgtacaatactaattagttcggtttacttcgtacgtttcgtcttaccgtaccgttcggaaccgtaagggactaacggtacgttaggaaataacgttaaaacgtacgttaggtccggtactacgtaccgtacctagtttcgtagtaccttacctacttcccgtaccgctaatccgtagtaacgttctacgtacgtagacggacggtccggtaatacgggaaccgacggtacctaagtaacgggtcanactgacaggtccngtaaccgtnagtcgancgtgtannnnctanagtntnncagntagtnananctgngtn

SEQ ID NO: 227247 - DNA, 597 bp, Homo sapiens
  misc_feature: GYAE6OF01CDUSO.29.62.F07.1.454.CMB.1.raw
  modified_base (194)..(194): a, c, t, g, unknown or other
  misc_feature (194)..(194): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
  modified_base (534)..(534): a, c, t, g, unknown or other
  misc_feature (534)..(534): n is a, c, g, or t
  modified_base (561)..(561): a, c, t, g, unknown or other
  misc_feature (561)..(561): n is a, c, g, or t
  modified_base (590)..(590): a, c, t, g, unknown or other
  misc_feature (590)..(590): n is a, c, g, or t
tcagatagagtactcacgaccggtgctcgatttagtagtcgcataaagggggaaagggccacgttctcctgcaggggccagtcaaagtattagcagcagaaacttagcctggtaccagcaaaaacctggccaggctcccaggctcctcatctttggtgcatctaccgagggccactggcatcccagaccggttnagtggcaggtggtctgggacagacttcactctcaccatcagcagacgtgggcctagaagactgacatcagtgtattactgtacatacaatacgtggttcttctagtttcgcttactaccgttcggaccaagggacacgacgtagggaatacgttaaacgaactggtacggtctacgactactacttcgttacgttccttacctagttcccttaccccgactacgttaccgtagtaaccgttacttccgttaagtccgtaggacgggccgggtactcgggaacgacggtccgacgtacgtaacgcgatcgagactacgcggancgtagtcgngaccgttangtacgtacgtctacgagtacgtacganacgtacgtacgtacgacgtcgtactagcngtacgtg

SEQ ID NO: 227248 - DNA, 623 bp, Homo sapiens
  misc_feature: GYAE6OF01AUVLT.29.62.F07.1.454.CMB.1.raw
  modified_base (211)..(211): a, c, t, g, unknown or other
  misc_feature (211)..(211): n is a, c, g, or t
  modified_base (578)..(578): a, c, t, g, unknown or other
  misc_feature (578)..(578): n is a, c, g, or t
  modified_base (597)..(597): a, c, t, g, unknown or other
  misc_feature (597)..(597): n is a, c, g, or t
  modified_base (603)..(608): a, c, t, g, unknown or other
  misc_feature (603)..(608): n is a, c, g, or t
  modified_base (610)..(623): a, c, t, g, unknown or other
  misc_feature (610)..(623): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtgctaggtggtctggacngacttcactctcaccagtcagcagacgtggggcctaggaatatgcactcgagtgttattaccgtgtacattacaattagttcggtttactttcgaggttttccaccttcctaccgtttccggaccgtaacgggtaccaacgtacgtaggaacgtaaacgttaaacccggtaacgttcgggtacgtcgtttaccggcctaacccggttactttccggtaccggtttccttactaaccccgtttcccttaccccggtactaaccgtttacctagggttaaaccctttcccgtttacttaactttccgggtaaacggtcgggttccccggacgttaccggtacggaacggtaccgccgttaagtacgctngttcgcagcgtatcgatgntgcacnnnnnngnnnnnnnnnnnnnn

SEQ ID NO: 227249 - DNA, 731 bp, Homo sapiens
  misc_feature: GYAE6OF01CFRV6.29.62.F07.1.454.CMB.1.raw
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
  modified_base (701)..(731): a, c, t, g, unknown or other
  misc_feature (701)..(731): n is a, c, g, or t
tcagatagagtactcacgaccggtgctcgatttagtagtcgcataaagggaaagggccacgttctcctgcagggccagtcaaagtattagcagcagaaaacttagcctggtaccagcaaaaaaccctggccaggcctcccgaggcctcctctattcgtttggtcgctactacctaaccggacgggaccctacgtcggcctacctacccgaacggtacccggttcgaggtggcgtagggttcgggtcgtacgggactaagtaccttcgacctcctaccactagtccaggacgaacggtccgggtaccggggtacctaaggaacgtacgttacgaccttagttaacgtaggtttaacgtttaaactttaccgttacgtaactaacttaacgttaaagtttaccggttttcggtttacccttaggtttaccggtttaccggtccctttaacccggtaccccgggttaaccggggacccggtaaacggggtaacctaacccggggttaggtaacggggtaaaaccgtttaaaaccggtttaacggaaccggttcggttacggggtccttaaccggaccgtttactaaccgttttctaacccgtttcctaagtccccttacccttccgactacttacggttacggttactaccgttctacgtacggtacggcggtacggtagacgtacgggacgctaacgngcngnnnnnnnnnnnnnnnnnnnnnnnnnnnnnnn

SEQ ID NO: 227250 - DNA, 657 bp, Homo sapiens
  misc_feature: GYAE6OF01BS2TN.29.62.F07.1.454.CMB.1.raw
  modified_base (159)..(159): a, c, t, g, unknown or other
  misc_feature (159)..(159): n is a, c, g, or t
  modified_base (242)..(242): a, c, t, g, unknown or other
  misc_feature (242)..(242): n is a, c, g, or t
  modified_base (590)..(590): a, c, t, g, unknown or other
  misc_feature (590)..(590): n is a, c, g, or t
  modified_base (598)..(598): a, c, t, g, unknown or other
  misc_feature (598)..(598): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (625)..(627): a, c, t, g, unknown or other
  misc_feature (625)..(627): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
  modified_base (634)..(657): a, c, t, g, unknown or other
  misc_feature (634)..(657): n is a, c, g, or t
tcagatagagtactcacgaccggtgctcgatttagtagtcgcataaaggggaaagggccacgttctcctgcagggccagtcaaagtattagcagcagaaacttagcctggtaccagacaaaaacctggccaggcctcccaggctcctcattctttggtncatcctaccgagggccactggcactccccagtaccggttcaggtcggcaggtgggtctgggacagactttcacttctcaacancagcacgacgtggggcctaggaaggtatcggactattacgtaggttacgttactttaactggttcctaatttactaaattacggtttcgggttttaccctttaccgttaacggttttccgtaccctttacccgtaccccggttttacgggaaacccgtaaacgggggtaaccaacccggtaacggtacgggtaaaacgttaaacgtttaaaaccggaaacgttcgggttacggggtcctagggaaccctaacccaagtttccttacggtttactttacctaccgtttccctttcccgacccttattccgtaggtaaccttcttacttagttccgaggacggtccgggngttaccgngggtaaacgccgtataggtacnagnannncncnngnnnnnnnnnnnnnnnnnnnnnnnn

SEQ ID NO: 227251 - DNA, 544 bp, Homo sapiens
  misc_feature: GYAE6OF01AJQMC.29.62.F07.1.454.CMB.1.raw
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (491)..(492): a, c, t, g, unknown or other
  misc_feature (491)..(492): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (515)..(516): a, c, t, g, unknown or other
  misc_feature (515)..(516): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
tcagatagagtactcacgaccggtgctcgatttagtagtcgcataaaggggaaagggccacggttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactgggcctgaagatgcattcagtgtatactgtcatcaatatggttctcagttttcgactcaccgttcggctaacgggacacgacgtggacaacgttaaacgactgtggcttgaccactaatcttcgtactttacactttcccttaccccggacctattaccgtaggtaaaccgttaccgtcttaactccgttaggaacggtcggggtaccgttgggactaaacgggtccgtaaccgtaagtaacggcantananncactacgtctagacgcnanacanncngacgcncacntacnnangncncgngn

SEQ ID NO: 227252 - DNA, 627 bp, Homo sapiens
  misc_feature: GYAE6OF01BJS1X.29.62.F07.1.454.CMB.1.raw
  modified_base (157)..(157): a, c, t, g, unknown or other
  misc_feature (157)..(157): n is a, c, g, or t
  modified_base (262)..(262): a, c, t, g, unknown or other
  misc_feature (262)..(262): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (603)..(624): a, c, t, g, unknown or other
  misc_feature (603)..(624): n is a, c, g, or t
  modified_base (626)..(627): a, c, t, g, unknown or other
  misc_feature (626)..(627): n is a, c, g, or t
tcagatagagtactcacgaccggtgctcgatttagtagtcgcataaaagggaaagggccacgttctcctgcagggccagtcaaagtattagcagcagaaacttagcctggtaccagacaaaaacctggcccaggctcccaggctcctcatctttggngcatctaccgagggccacgtggcactcccagaccggttcagtggcaggtgggtctgggacagacttccactctcaccatcagcagacgtcgggggcctaggaagntcgacacttcaggttacgttattacctgtactatactaaattgttcggtttactttcgtaaggtttccctcttacccgtaccgttaccgggaaccgaacgggactaccggtacgtagggaaactaaacgtttaaaaccgaacggtcggtaggcctaggaccctaacgtaacttctacggttccctttacaccgtttccccgttacccccgccgttaactccgttaaggttaaacccgttacctttacgttactccggtaagggtaccgggtacgggtccggtagggaaacccgggtaccggtacggtaccgtaagtcgagtccagngntagcttgactgannnnnnnnnnnnnnnnnnnnnngnn

SEQ ID NO: 227253 - DNA, 787 bp, Homo sapiens
  misc_feature: GYAE6OF01BQ7VC.29.62.F07.1.454.CMB.1.raw
  modified_base (717)..(717): a, c, t, g, unknown or other
  misc_feature (717)..(717): n is a, c, g, or t
  modified_base (731)..(731): a, c, t, g, unknown or other
  misc_feature (731)..(731): n is a, c, g, or t
  modified_base (745)..(745): a, c, t, g, unknown or other
  misc_feature (745)..(745): n is a, c, g, or t
  modified_base (749)..(749): a, c, t, g, unknown or other
  misc_feature (749)..(749): n is a, c, g, or t
  modified_base (772)..(787): a, c, t, g, unknown or other
  misc_feature (772)..(787): n is a, c, g, or t
tcagatagagtactcacgaccggtgctcgatttagtagtcgcataaaggggaaagggccacgttctcctgcagggccagtcaaagtattagcagcagaaacttagcctggtaccagacaaaacctggccgaggcctcccaggcctcctctattcttttgggctcactccgtaaccgacgggaccctacgtggaccacgttaccccgaacggttaaccgggtttccagggtacgggtccgtaagggtcggggttcctaggggtacctaagtacccttttacgaacctttcccaacctaccgtaccgttacgtacggacgtaaccggtaccgggttacggggacccttaaggaacgtacggttacaccgtacgtaccgttggttagttttaacggttaccttaggttactaaaccgtacgtttaaacgtttacggttttaccgggtttaactttcgttaaccggttttaccgcccgtttacccggtacccgttaccggaccgggttaacggaccgtaaccggtacgtaaggtaacggtttaaacttaaaccgggtaacgttcggtaccggtaccgtaccgtaactacccgggtaacttccggtttctttaccggttactaccccttaccccgggtccttaaccggtacttaccggttacggtacttaccgttactagtcggaggttaccgggtcgggtacgtcgggttaaccgccgtanaaccggtgaccggntagtcgatgaatcngatnacgttgctaggcattcggaatcnnnnnnnnnnnnnnnn

SEQ ID NO: 227254 - DNA, 675 bp, Homo sapiens
  misc_feature: GYAE6OF01CFKDF.29.62.F07.1.454.CMB.1.raw
  modified_base (149)..(149): a, c, t, g, unknown or other
  misc_feature (149)..(149): n is a, c, g, or t
  modified_base (159)..(159): a, c, t, g, unknown or other
  misc_feature (159)..(159): n is a, c, g, or t
  modified_base (290)..(290): a, c, t, g, unknown or other
  misc_feature (290)..(290): n is a, c, g, or t
  modified_base (441)..(441): a, c, t, g, unknown or other
  misc_feature (441)..(441): n is a, c, g, or t
  modified_base (635)..(635): a, c, t, g, unknown or other
  misc_feature (635)..(635): n is a, c, g, or t
  modified_base (639)..(640): a, c, t, g, unknown or other
  misc_feature (639)..(640): n is a, c, g, or t
  modified_base (642)..(643): a, c, t, g, unknown or other
  misc_feature (642)..(643): n is a, c, g, or t
  modified_base (645)..(645): a, c, t, g, unknown or other
  misc_feature (645)..(645): n is a, c, g, or t
  modified_base (647)..(660): a, c, t, g, unknown or other
  misc_feature (647)..(660): n is a, c, g, or t
  modified_base (662)..(675): a, c, t, g, unknown or other
  misc_feature (662)..(675): n is a, c, g, or t
tcagatagagtactcacgaccggtgctcgatttagtagtcgcataaagggaaagggcccacgttctcctgcagggccagtcaaagtattagcagcagaaacttagcctggtaccagacaaaaacctggccaggcctcccaggcctcctnatcgtttggncatcctaccgagggccacgtggcactcccgacggtacccggttcgaggtggctacggtcggggtcgtggggacacggtaccttcactcctaccactacgtcgacgcccgactggacgtccgtaggacggtnttccgttggttaccgttttaagtttacgttcgggtcggtttacggggacgttacgtaaccgtaccggttccggtcccttacccccggttagttaccgttttacggggacccgggtaacggggtacccaaacgggcgttaagggaacgttanaccggtaaacggaccgggtaacgttgggtacggtacccgttaccgacctaacccgttagttcgtttaacggtttcccttaacgtcccggtttacccctaacccgcgttaaactcgttaagaaaccgttcttactacgtcggtacggacggtttccggggaccgttacggcgggaaacgtcgtaactagtcacgnatgnncnncngnnnnnnnnnnnnnngnnnnnnnnnnnnnn

SEQ ID NO: 227255 - DNA, 438 bp, Homo sapiens
  misc_feature: GYAE6OF02I0M93.29.62.F07.1.454.CMB.1.raw
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
  modified_base (395)..(395): a, c, t, g, unknown or other
  misc_feature (395)..(395): n is a, c, g, or t
  modified_base (411)..(438): a, c, t, g, unknown or other
  misc_feature (411)..(438): n is a, c, g, or t
tcagatagagtactcacgaccggtgctcgatttagtagtcgcataaagggaaaggggccacgttcgtcctgcagggccagtcaaagtattaggcagcagaaacttagcctggtaccagcaaaacctggcccaggctcccaggctcctcatcttggtgcatctacaggccactggcatcccagaccggttcagtggcagtcgggtctgggacagacttcactctcaccatcagcagactggggcctagaagatgcatcagtgattactgtcatcaatatggttcttcagtttcgntcaccttcggccaagggacacgactgganattaaacgaactgtaggctgcaccatctgtcttcgatcttcccgcatcctgaagtactctagtctgagcggntggcaaggcgcatagnnnnnnnnnnnnnnnnnnnnnnnnnnnn

SEQ ID NO: 227256 - DNA, 409 bp, Homo sapiens
  misc_feature: GYAE6OF02I4KDF.29.62.F07.1.454.CMB.1.raw
  modified_base (402)..(409): a, c, t, g, unknown or other
  misc_feature (402)..(409): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcacatctgtcttcatcttcccgcatctgaagtactctatctgagcggctggcaggcgcatgnnnnnnnn

SEQ ID NO: 227257 - DNA, 419 bp, Homo sapiens
  misc_feature: GYAE6OF02ISWH4.29.62.F07.1.454.CMB.1.raw
  modified_base (411)..(419): a, c, t, g, unknown or other
  misc_feature (411)..(419): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggactgaagatgcatcagtgtattactgtcatcaatatggttcttcagttttcgcttcacctttcggccaaggggacacgactggagattaaacgaactgtggctgcaccatctgtcttcatcttcccgcatctgaagtactctatctgagcgggctggcaaggcgcatagnnnnnnnnn

SEQ ID NO: 227258 - DNA, 437 bp, Homo sapiens
  misc_feature: GYAE6OF02H98GB.29.62.F07.1.454.CMB.1.raw
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
  modified_base (413)..(437): a, c, t, g, unknown or other
  misc_feature (413)..(437): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggcttcctcatctttggtgtcatctaccagggtccactggccatcccagaccggttcagtggcagtgggtctggggacagacttcactcgtcacccatcagcagactggggccctgaagatgcatcagtgtattactgtcatcaagtatggttcttcagtttcgctcgacctttgggcctaaggggcacgactggagtattaaacgactgnggctgcacatctgtcttcatctcccgcatctgatactctatctnagcggctggcaaggncatagnnnnnnnnnnnnnnnnnnnnnnnnn

SEQ ID NO: 227259 - DNA, 412 bp, Homo sapiens
  misc_feature: GYAE6OF02GU084.29.62.F07.1.454.CMB.1.raw
  modified_base (406)..(412): a, c, t, g, unknown or other
  misc_feature (406)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcaccatctgtcttcatcttcccgcatctgaagtctctatctgagcgggctggcaaggcgcatagnnnnnnn

SEQ ID NO: 227260 - DNA, 407 bp, Homo sapiens
  misc_feature: GYAE6OF02F1OIP.29.62.F07.1.454.CMB.1.raw
  modified_base (398)..(398): a, c, t, g, unknown or other
  misc_feature (398)..(398): n is a, c, g, or t
  modified_base (404)..(407): a, c, t, g, unknown or other
  misc_feature (404)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcacatctgtcttcatctcccgccatctgagtactctatctgagcggctggcaaggcncatagnnnn

SEQ ID NO: 227261 - DNA, 411 bp, Homo sapiens
  misc_feature: GYAE6OF02GBZND.29.62.F07.1.454.CMB.1.raw
  modified_base (406)..(411): a, c, t, g, unknown or other
  misc_feature (406)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcacatctgtcttcatcttcccgcatctgaagtactctatctgagcgggctggcaaggcgcatagnnnnnn

SEQ ID NO: 227262 - DNA, 410 bp, Homo sapiens
  misc_feature: GYAE6OF02G6GO8.29.62.F07.1.454.CMB.1.raw
  modified_base (402)..(402): a, c, t, g, unknown or other
  misc_feature (402)..(402): n is a, c, g, or t
  modified_base (408)..(410): a, c, t, g, unknown or other
  misc_feature (408)..(410): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcacatctgtcttcatcttcccgcatctagaacgtactctatctgagcgggctggcaaggcncatagnnn

SEQ ID NO: 227263 - DNA, 411 bp, Homo sapiens
  misc_feature: GYAE6OF02F79D1.29.62.F07.1.454.CMB.1.raw
  modified_base (405)..(411): a, c, t, g, unknown or other
  misc_feature (405)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagattaaacgaactgtggctgcaccatctgtcttcatcttcccgcatctgaagtctctatctgagcgggctggcaaggcgcatagnnnnnnn

SEQ ID NO: 227264 - DNA, 416 bp, Homo sapiens
  misc_feature: GYAE6OF02J2LZ9.29.62.F07.1.454.CMB.1.raw
  modified_base (321)..(321): a, c, t, g, unknown or other
  misc_feature (321)..(321): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (404)..(416): a, c, t, g, unknown or other
  misc_feature (404)..(416): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactgganattaaacgactgtaggctgcacatcngtctnatcttcccgcatctgaagtactctatctgagcggctggcaaggcgcatacgnnnnnnnnnnnnn

SEQ ID NO: 227265 - DNA, 412 bp, Homo sapiens
  misc_feature: GYAE6OF02GE0U1.29.62.F07.1.454.CMB.1.raw
  modified_base (403)..(403): a, c, t, g, unknown or other
  misc_feature (403)..(403): n is a, c, g, or t
  modified_base (409)..(412): a, c, t, g, unknown or other
  misc_feature (409)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcaccatctgtcttcatcttcccgccatctgaagtactctatctgagcgggctggcaagggcncatagnnnn

SEQ ID NO: 227266 - DNA, 411 bp, Homo sapiens
  misc_feature: GYAE6OF02FPWBA.29.62.F07.1.454.CMB.1.raw
  modified_base (405)..(411): a, c, t, g, unknown or other
  misc_feature (405)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatcttggtgcatctaccagggccactggcatcccagaccggttcagtggcagtgggtctgggacagacttcactctcaccatcagcagactgggcctgaagatgcatcagtgtattactgtcatcaatatggttcttcagttttcgctcaccttcggccaagggacacgactggagattaaacgaactgtggctgcaccatctgtcttcatcttcccgcatctgaatactctatctgagcgggctggcaaggcgcatagnnnnnnn

SEQ ID NO: 227267 - DNA, 411 bp, Homo sapiens
  misc_feature: GYAE6OF02IJ3KU.29.62.F07.1.454.CMB.1.raw
  modified_base (406)..(411): a, c, t, g, unknown or other
  misc_feature (406)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgcatctgagtactctatctgagcgggctggcaaggcgcatagnnnnnn

SEQ ID NO: 227268 - DNA, 414 bp, Homo sapiens
  misc_feature: GYAE6OF02IESSI.29.62.F07.1.454.CMB.1.raw
  modified_base (406)..(414): a, c, t, g, unknown or other
  misc_feature (406)..(414): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaccctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcaccatctgtcttcatcttcccgcatctgagtactctatctgagcggctggcaaggcgcatagnnnnnnnnn

SEQ ID NO: 227269 - DNA, 407 bp, Homo sapiens
  misc_feature: GYAE6OF02H3W7O.29.62.F07.1.454.CMB.1.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (402)..(407): a, c, t, g, unknown or other
  misc_feature (402)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtggtctgggacagacttcactctcaccatcagcagactggggcctgaagatgcatcagtgtattactgtcatcaatatggttcttcagtttcgcttcaccttcgccaaggcacgactggagattaaacgaactgtaggctgcacatctgtctnatcttcccgcatcngaagtctctatctgacgcggctggcaaggcgcatagnnnnnn

SEQ ID NO: 227270 - DNA, 412 bp, Homo sapiens
  misc_feature: GYAE6OF02F6BRO.29.62.F07.1.454.CMB.1.raw
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
  modified_base (405)..(412): a, c, t, g, unknown or other
  misc_feature (405)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcacatctgtcttnatcttcccgctatctgaagtactctatctgagcgggntggcaaggcgcatgnnnnnnnn

SEQ ID NO: 227271 - DNA, 407 bp, Homo sapiens
  misc_feature: GYAE6OF02GCD84.29.62.F07.1.454.CMB.1.raw
  modified_base (398)..(398): a, c, t, g, unknown or other
  misc_feature (398)..(398): n is a, c, g, or t
  modified_base (404)..(407): a, c, t, g, unknown or other
  misc_feature (404)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatgttcttcagtttcgctcaccttcggccaagggcacgactggagattaaacgaactgtggctgcacatctgtcttcatccttcccgccatctgaagtctctatctgagcggctggcaaggcncatagnnnn

SEQ ID NO: 227272 - DNA, 417 bp, Homo sapiens
  misc_feature: GYAE6OF02IFUUX.29.62.F07.1.454.CMB.1.raw
  modified_base (337)..(337): a, c, t, g, unknown or other
  misc_feature (337)..(337): n is a, c, g, or t
  modified_base (406)..(417): a, c, t, g, unknown or other
  misc_feature (406)..(417): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgcttcaccttcggccaagggacacgactggagattaaacgaactgnggctgcacatctgtcttcattctcccgcatctgaatctctatctgagcgggctgggcaaggcgcatagnnnnnnnnnnnn

SEQ ID NO: 227273 - DNA, 412 bp, Homo sapiens
  misc_feature: GYAE6OF02GYFXA.29.62.F07.1.454.CMB.1.raw
  modified_base (406)..(412): a, c, t, g, unknown or other
  misc_feature (406)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagtattaaacgactgtggctgcacatctgtcttcatccttcccgcatctagatactctatctgagcgggctggcaaggcgcatagnnnnnnn

SEQ ID NO: 227274 - DNA, 415 bp, Homo sapiens
  misc_feature: GYAE6OF02HGJUS.29.62.F07.1.454.CMB.1.raw
  modified_base (406)..(415): a, c, t, g, unknown or other
  misc_feature (406)..(415): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcacatctgtctcatcttcccgccatctgaagtactctatctgagcgggctggcaaggcgcatagnnnnnnnnnn

SEQ ID NO: 227275 - DNA, 414 bp, Homo sapiens
  misc_feature: GYAE6OF02I6RHA.29.62.F07.1.454.CMB.1.raw
  modified_base (409)..(414): a, c, t, g, unknown or other
  misc_feature (409)..(414): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggccctcccgtctacttttggccaggggaccaagcctggagatcagacgaactgtggctgcaccatctgtcttcatcttcccgccatctgaagtctctatctgagcggctggcaaggcgcatagnnnnnn

SEQ ID NO: 227276 - DNA, 406 bp, Homo sapiens
  misc_feature: GYAE6OF02G81YD.29.62.F07.1.454.CMB.1.raw
  modified_base (401)..(406): a, c, t, g, unknown or other
  misc_feature (401)..(406): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcacatctgtcttcatcttcccgcatctgaatctctatctgagcggctggcaaggcgcatgnnnnnn

SEQ ID NO: 227277 - DNA, 407 bp, Homo sapiens
  misc_feature: GYAE6OF02IW41U.29.62.F07.1.454.CMB.1.raw
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (402)..(407): a, c, t, g, unknown or other
  misc_feature (402)..(407): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcacatctgtcttcatctcccgcatctagagtctctatctgagcgggntggcaaggcnatagnnnnnn

SEQ ID NO: 227278 - DNA, 410 bp, Homo sapiens
  misc_feature: GYAE6OF02HB4DL.29.62.F07.1.454.CMB.1.raw
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (395)..(395): a, c, t, g, unknown or other
  misc_feature (395)..(395): n is a, c, g, or t
  modified_base (401)..(410): a, c, t, g, unknown or other
  misc_feature (401)..(410): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactgganataaacgatgngctgcacntctgtctcatcttcccgcatctgaactctctatctgagcgggctggcaaggcncatagnnnnnnnnnn

SEQ ID NO: 227279 - DNA, 415 bp, Homo sapiens
  misc_feature: GYAE6OF02IJHAE.29.62.F07.1.454.CMB.1.raw
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
  modified_base (406)..(415): a, c, t, g, unknown or other
  misc_feature (406)..(415): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgagntgcatcagtgtattactgtcatcaatatggttcttcagtttcgcttcaccttcggccaagggccacgactggagattaaacgatgtgctgcaccatctgtcttcatccttcccgcntctgaatactctatctgacgcggtctggcaaggcncgatagnnnnnnnnnn

SEQ ID NO: 227280 - DNA, 465 bp, Homo sapiens
  misc_feature: GYAE6OF02J3BLP.29.62.F07.1.454.CMB.1.raw
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (448)..(448): a, c, t, g, unknown or other
  misc_feature (448)..(448): n is a, c, g, or t
  modified_base (450)..(465): a, c, t, g, unknown or other
  misc_feature (450)..(465): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagactttcactctcaccatcagcagactggggcctgaagatgcatcagtgtattactgtcatcaattntggtttcttntagtttcgctcctacttcggccaagggacacgactggaatattaaacgactggtcggactgaccaccattctgtcttcgacttccctttacccgcctattctagtaacgtacttctaatcgttagacgggtcggtctgggaccaaggtccgactaatgcnannnnnnnnnnnnnnnn

SEQ ID NO: 227281 - DNA, 419 bp, Homo sapiens
  misc_feature: GYAE6OF02FG8QL.29.62.F07.1.454.CMB.1.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (407)..(419): a, c, t, g, unknown or other
  misc_feature (407)..(419): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattacngtcatcaatatggttcttcagtttcnctcaccttcggccaagggcacgactggagattaaacgaactgtggctgcaccatctgtcttcatcttcccgcatctgaagtactctatctgagcgggctggcaaggcgcatagnnnnnnnnnnnnn

SEQ ID NO: 227282 - DNA, 430 bp, Homo sapiens
  misc_feature: GYAE6OF02FH9QT.29.62.F07.1.454.CMB.1.raw
  modified_base (419)..(430): a, c, t, g, unknown or other
  misc_feature (419)..(430): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactggagtataaacgaatgtggctgcacatctgtcttcatccttcccgcatctagaagttacctctatcgtgacggcggctcgggcgtaacggcgtacagtagnnnnnnnnnnnn

SEQ ID NO: 227283 - DNA, 421 bp, Homo sapiens
  misc_feature: GYAE6OF02H59L0.29.62.F07.1.454.CMB.1.raw
  modified_base (417)..(421): a, c, t, g, unknown or other
  misc_feature (417)..(421): n is a, c, g, or t
tcagatagagtactcacgaccggtgctcgatttagtagtcgcataaaaggggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagttttcgcttcaccttcggccaagggacacgactggagattaaacgactgtggctgacacatctgtcttcactcttcccgctatctagaacgtactctatctgacgcgggctggacaggcgacatagnnnnn

SEQ ID NO: 227284 - DNA, 503 bp, Homo sapiens
  misc_feature: GYAE6OF02HAMGP.29.62.F07.1.454.CMB.1.raw
  modified_base (490)..(503): a, c, t, g, unknown or other
  misc_feature (490)..(503): n is a, c, g, or t
tcagatagagtactcacgaccggtgctcgatttagtagtcgcataaagggaaagggccacgttctcctgcagggccagtcaaagtattagcagcagaaacttagcctggtaccagacaaaaacctggccaggctcccaggctcctcatctttggtgcatctaccagggccactggcactccccgaggaccggttcagtggcaggtgggtctgggacagacttcactctcaccatcagcagacgtggggcctagaagatgacatcagtgttattactgtcattttttttttttttttttttttacaattattggttcttcttagtttcgtctcctaccgttccggaccgaacggacgacgacgtacggagtaagttaaacgtacgtagtggtcgtcgacactactctcgttcttctactcctcccgtcctactctacgtacgtactactactcgtgtacggcggtcggtcggacggacggcgacgtagagnnnnnnnnnnnnnn

SEQ ID NO: 227285 - DNA, 531 bp, Homo sapiens
  misc_feature: GYAE6OF02IY0DH.29.62.F07.1.454.CMB.1.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (494)..(494): a, c, t, g, unknown or other
  misc_feature (494)..(494): n is a, c, g, or t
  modified_base (496)..(501): a, c, t, g, unknown or other
  misc_feature (496)..(501): n is a, c, g, or t
  modified_base (503)..(513): a, c, t, g, unknown or other
  misc_feature (503)..(513): n is a, c, g, or t
  modified_base (515)..(516): a, c, t, g, unknown or other
  misc_feature (515)..(516): n is a, c, g, or t
  modified_base (518)..(531): a, c, t, g, unknown or other
  misc_feature (518)..(531): n is a, c, g, or t
tcagatagagtactcacgaccggtgctcgatttagtagtcgcataaagggaaagggccacgttctcctgcaggccagtcaaagtattagcagcagaaacttagcctggtaccagcaaaaacctggccaggcctcccaggctcctcatctttggtgtcatctacagggtccactggccatcccagaccggttcagtggcaggtgggtctgggggacaggacttcgactcgtacaccatcagccagactggggcctgaagntggcatcagtgtattacgngtacatacaagtatggttcttctagtttcggcttcgaccctttcggactaaggggactacgactggaatattaaaacgaactggtacgggacttggaccaaccgtataccgttgcttttacattaccttccccgacctattcctaacggtaactttacttacctaattaccttacgacgtcgggactacgggacctaaagggccgtacagtacganannnnnnannnnnnnnnnngnngnnnnnnnnnnnnnn

SEQ ID NO: 227286 - DNA, 411 bp, Homo sapiens
  misc_feature: GYAE6OF02F1JTS.29.62.F07.1.454.CMB.1.raw
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (400)..(400): a, c, t, g, unknown or other
  misc_feature (400)..(400): n is a, c, g, or t
  modified_base (406)..(411): a, c, t, g, unknown or other
  misc_feature (406)..(411): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactgganattaaacgactgtgctgcacntctgtcttcatcttcccgcatctgaacgtactctatctgagcgggctggcaaggcncatagnnnnnn

SEQ ID NO: 227287 - DNA, 415 bp, Homo sapiens
  misc_feature: GYAE6OF02FRS3T.29.62.F07.1.454.CMB.1.raw
  modified_base (355)..(355): a, c, t, g, unknown or other
  misc_feature (355)..(355): n is a, c, g, or t
  modified_base (401)..(401): a, c, t, g, unknown or other
  misc_feature (401)..(401): n is a, c, g, or t
  modified_base (406)..(415): a, c, t, g, unknown or other
  misc_feature (406)..(415): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcaccatctgtcttnatcttcccgcatctgaagtactctatctgagcgggctggcaaggcnatagnnnnnnnnnn

SEQ ID NO: 227288 - DNA, 411 bp, Homo sapiens
  misc_feature: GYAE6OF02GE6RA.29.62.F07.1.454.CMB.1.raw
  modified_base (402)..(402): a, c, t, g, unknown or other
  misc_feature (402)..(402): n is a, c, g, or t
  modified_base (407)..(411): a, c, t, g, unknown or other
  misc_feature (407)..(411): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgaactgtggctgcacatctgtcttcatcttcccgctatctgaacgtactctatctgagcgggctggcaaggcncatgnnnnn

SEQ ID NO: 227289 - DNA, 409 bp, Homo sapiens
  misc_feature: GYAE6OF02F1YI5.29.62.F07.1.454.CMB.1.raw
  modified_base (335)..(335): a, c, t, g, unknown or other
  misc_feature (335)..(335): n is a, c, g, or t
  modified_base (404)..(409): a, c, t, g, unknown or other
  misc_feature (404)..(409): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgnggctgcacatctgtcttcatcttcccgctatctgaagtactctatctgagcggctggcaaggcgcatgnnnnnn

SEQ ID NO: 227290 - DNA, 415 bp, Homo sapiens
  misc_feature: GYAE6OF02F04NS.29.62.F07.1.454.CMB.1.raw
  modified_base (408)..(415): a, c, t, g, unknown or other
  misc_feature (408)..(415): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactgacatcccagaccggttcagtggcagtgggtctgggacagacttcactctcaccatcagcagactgggcctgaagatgcatcagtgtattactgtcatcaatatggttctcagtttcgctcaccttcggccaagggacacgactggagattaaacgactgtggctgcacatctgtcttcattcctcccgcctatctagacgtactctatctgacgcgggctggcacggcacatagnnnnnnnn

SEQ ID NO: 227291 - DNA, 404 bp, Homo sapiens
  misc_feature: GYAE6OF02FRI62.29.62.F07.1.454.CMB.1.raw
  modified_base (396)..(396): a, c, t, g, unknown or other
  misc_feature (396)..(396): n is a, c, g, or t
  modified_base (402)..(404): a, c, t, g, unknown or other
  misc_feature (402)..(404): n is a, c, g, or t
tcagatagagtactcacgaccggtgctcgatttagtagtcgcataaagggaaagggccacgttctcctgcagggccagtcaaagtattagcagcaagaaacttagcctggtaccagacaaaaacctggccaggctcccaggctcctcatctttggtgcatctaccaggccactggcatcccagaccggttcagtggcagtggtctgggacagacttcactctcaccatcagcccgcctagacgcctgaggattctgccgtttatattgtcttgggcgtagcaactggcctcccgtcacttttggccaggggtaccaagctggagatcagacgaactgtggctgcaccatctgtcttcatcttccgcatctgagtactctgagcggctggcaaggcncatagnnn

SEQ ID NO: 227292 - DNA, 414 bp, Homo sapiens
  misc_feature: GYAE6OF02FSWXE.29.62.F07.1.454.CMB.1.raw
  modified_base (387)..(387): a, c, t, g, unknown or other
  misc_feature (387)..(387): n is a, c, g, or t
  modified_base (405)..(414): a, c, t, g, unknown or other
  misc_feature (405)..(414): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgtatctaccagggccactggcatcccagaccggttcagtggcagtgggtctgggacagacttcactctcaccatcagcagactggggcctgagatgcatcagtgtattactgtcatcaatatggttcttcagtttcgctcaccttcggccaagggacacgactggagattaaacgactgtggctgcacatctgtcttcatctcccgcatctgaagtactctatctgagcgggntcggacaggcgcagtagnnnnnnnnnn

SEQ ID NO: 227293 - DNA, 456 bp, Homo sapiens
  misc_feature: GYAE6OF02ITVX1.29.62.F07.1.454.CMB.1.raw
  modified_base (437)..(456): a, c, t, g, unknown or other
  misc_feature (437)..(456): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctagaagatgacatcagttgtattacctgtacatcaattatggttcttcagtttcgctcaccttcggaccaagggacacgtactggaatattaaacgactggtcgctgcacctatctgtcttacactccttcccgctattcctagtaacgtcttctatcgtggacggcggtctcgggcaaacgggcacaagtgannnnnnnnnnnnnnnnnnnn

SEQ ID NO: 227294 - DNA, 409 bp, Homo sapiens
  misc_feature: GYAE6OF02IHBV1.29.62.F07.1.454.CMB.1.raw
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (397)..(397): a, c, t, g, unknown or other
  misc_feature (397)..(397): n is a, c, g, or t
  modified_base (403)..(409): a, c, t, g, unknown or other
  misc_feature (403)..(409): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactgganattaaacgactgngctgcaccatctgtctcatcttcccgcatctgaatctctatctgagcggctggacaagggcncatagnnnnnnn

SEQ ID NO: 227295 - DNA, 421 bp, Homo sapiens
  misc_feature: GYAE6OF02HG6HA.29.62.F07.1.454.CMB.1.raw
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (408)..(421): a, c, t, g, unknown or other
  misc_feature (408)..(421): n is a, c, g, or t
tcagatagagtactcacgaccggtgctcgatttagtagtcgcataaagggaaagggccacgttctcctagcacgggccagtcaaagtattagcagcagaaacttagcctggtaccatcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttccttcagttttcgcttcacctttcggccaaggggcacgactgggagattaaacgaactgtggctgcacatctgtctcatctcccgcatcctgaatctctatctgagcggntggcaggcgnagtgnnnnnnnnnnnnnn

SEQ ID NO: 227296 - DNA, 567 bp, Homo sapiens
  misc_feature: GYAE6OF02ICXF5.29.62.F07.1.454.CMB.1.raw
  modified_base (501)..(501): a, c, t, g, unknown or other
  misc_feature (501)..(501): n is a, c, g, or t
  modified_base (504)..(505): a, c, t, g, unknown or other
  misc_feature (504)..(505): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (513)..(516): a, c, t, g, unknown or other
  misc_feature (513)..(516): n is a, c, g, or t
  modified_base (520)..(520): a, c, t, g, unknown or other
  misc_feature (520)..(520): n is a, c, g, or t
  modified_base (524)..(525): a, c, t, g, unknown or other
  misc_feature (524)..(525): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
tcagatagagtactcacgaccggtgctcgattttagtagtcgcataaaagggaaagggggccacgttcgtcctgcgagggccagtcaaagtattaggacagcagaaacttagcctgggtacccagcaaaaacctcggcccacggctccctaggctcctcatctttggtgcatctaccagggccactggcatcccacgacccggttcagtggcagtcgggtctgggaacagacgttcactctcaccatcgagctagactggggacctaagaagatgtctagtcagtgtaattaactgtcactcaactatggttcttctacgttttccgcttcgaccgttccggaccgtaagggaccaaccggaccgtcgggaagtaacgttaaacgaacgtagtggtctcgtcacctagtctcgttactcgacttccgttcccgcctactctagtaagttacctcgttacgtccgtaggacggcgggtctgggaccaaggcacctaattagntcnncancngannnngagncggnngcngtagcgtnagncgtcagtcncgccgtanactcgtctccg

SEQ ID NO: 227297 - DNA, 454 bp, Homo sapiens
  misc_feature: GYAE6OF02HXVO6.29.62.F07.1.454.CMB.1.raw
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
  modified_base (420)..(454): a, c, t, g, unknown or other
  misc_feature (420)..(454): n is a, c, g, or t
tcagatagagtactcacgaccggtgctcgatttagtagtcgcataaagggaaagggccacggttctcctgcagggccagtcaaagtattagcagcagaaacttagcctggtaccagcaaaaacctggccaggctcccaggctcctcatctttggtgcatctaccagggccactggccatcccagaccggttcagtggcagtgggtctgggacagacttcactctcaccatcagcagactgggcctgaagntgcatcagtgtattactgtcatcaaatatggttccttcagtttcncttctaccttcggaccaaggcacgactggatacttaaacgactgtgctgcacatctgtctanactccttcccgctatctagaactactctatcgtgacggcgggntagggctagggctctaatgnnnnnnnnnnnnnnnnnnnnnnnnnnnnnnnnnnn

SEQ ID NO: 227298 - DNA, 507 bp, Homo sapiens
  misc_feature: GYAE6OF02IVN22.29.62.F07.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (480)..(499): a, c, t, g, unknown or other
  misc_feature (480)..(499): n is a, c, g, or t
  modified_base (501)..(507): a, c, t, g, unknown or other
  misc_feature (501)..(507): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacngacttcactctcaccntcagcagactggggcctgaagatgcatcagtgtattacngtcatcaatntggttcttcagttttcgctcaacctttcggacctaaaggggccacgacttcggaagtattaaaaccgaatcgtaggcctgccgtaccatccttaggctttacgacttcgtttccccgactaatcctagtaaacgtcttactagtcctaggagtacgggccttgggaccgtaagggcctcgaagttagacgngactnacngagcnnnnnnnnnnnnnnnnnnnncnnnnnnn

SEQ ID NO: 227299 - DNA, 575 bp, Homo sapiens
  misc_feature: GYAE6OF02JXL3X.29.62.F07.1.454.CMB.1.raw
  modified_base (496)..(496): a, c, t, g, unknown or other
  misc_feature (496)..(496): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(575): a, c, t, g, unknown or other
  misc_feature (572)..(575): n is a, c, g, or t
tcagatagagtactcacgaccggtgctcgatttagtagtcgcataaaggaaagggaccgacgttctcctcgcaggccagtcaaagtattagcagcagaaacttagacctggtaccagacaaaaacctggaccaggctcccaggctcctcatcttggtgcatctacaggccactggcatccagaccggttcacgtgcagtgggtctgggacaggacttcactctcaccactcagcagactgggcctgagatgcatcagtgtacttacgtgttacattccgaattatcggttactttctagttttcgccttcaccgtttcggcctaaagggacctacgacttggaacgtacttaaaacgacgtgtaggcgtgcctaacgattacctgttacgtttacactttccttaccccgcgtaaacttccgttagaaacgtttccctgtaaccttcgtgtacgggtaccgggtctttaggggcctaaacggggtcgaccgttaanaacgggttcaagtccgngtactacgtntacacgtcgcgtgtagtcgtgagcgcgtctcgacgctncncngncnnannnn

SEQ ID NO: 227300 - DNA, 440 bp, Homo sapiens
  misc_feature: GYAE6OF02JB14J.29.62.F07.1.454.CMB.1.raw
  modified_base (350)..(350): a, c, t, g, unknown or other
  misc_feature (350)..(350): n is a, c, g, or t
  modified_base (421)..(440): a, c, t, g, unknown or other
  misc_feature (421)..(440): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattatgtcatcaatatggttcttcagtttcgctcgaccttcggacctaaggggacacgactggagtattaaacgactgtaggctgcaccntctgtcttcattcctcccgctatctgtaatactcttatctggagcggctggcgtaacggcgtacagtacgnnnnnnnnnnnnnnnnnnnn

SEQ ID NO: 227301 - DNA, 441 bp, Homo sapiens
  misc_feature: GYAE6OF02I375Z.29.62.F07.1.454.CMB.1.raw
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
  modified_base (431)..(441): a, c, t, g, unknown or other
  misc_feature (431)..(441): n is a, c, g, or t
tcagatagagtactcacgaccggtgctcgatttagtagtcgcataaagggaaagggccacgttctcctgcagggtcccacgtccaaagtattagcagcagaaacttaggcctggtaccaaggccaaaaacctggccaggctcccaggctcctcatctttggtgcatctaccagggccactggcatcccagaccggttcagtggcagtgggtctgggacagcttcactctcaccatcagcagactggggcctgagatgcatcagtgtattactgtcatcaatatggttacttcagttttcgcttcaccgttcggccaagggacacgactggagaattaaacgaacttgtggctgcaccactctgtcttcacttcttccccgactntctaggaacttacttctatctgaggcggtntaggcaaggcacatagnnnnnnnnnnn

SEQ ID NO: 227302 - DNA, 480 bp, Homo sapiens
  misc_feature: GYAE6OF02IV7TW.29.62.F07.1.454.CMB.1.raw
  modified_base (453)..(480): a, c, t, g, unknown or other
  misc_feature (453)..(480): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagacgtggggcctgaagatgcatcaagtgtattactgtcatcaattatggttcttctagtttcgcttccaccgttcggaccaaagggacacgactggaataattaaacgaatgtgctcgacaccctatctgtcttactacttccttcccgacctatctagtaactacttctaatcgtaggacgggccggtctagggacaaacgggccaactaagtagcagnnnnnnnnnnnnnnnnnnnnnnnnnnnn

SEQ ID NO: 227303 - DNA, 465 bp, Homo sapiens
  misc_feature: GYAE6OF02FMHJO.29.62.F07.1.454.CMB.1.raw
  modified_base (449)..(465): a, c, t, g, unknown or other
  misc_feature (449)..(465): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactggggcctgaagatgcatcagtgtattactgtcatcaatatggttcttcagtttcgctctaccttcggaccaaggggcctacggactggagtaattaaaaccggaacttggtcggcttaggaccaccgattcgtgttcttcattcctttccccgcctattcctagtaagtacctcgtatctggagcgggactgggacaaggcgacgatacgnnnnnnnnnnnnnnnnn

SEQ ID NO: 227304 - DNA, 483 bp, Homo sapiens
  misc_feature: GYAE6OF02GLX7H.29.62.F07.1.454.CMB.1.raw
  modified_base (447)..(447): a, c, t, g, unknown or other
  misc_feature (447)..(447): n is a, c, g, or t
  modified_base (453)..(483): a, c, t, g, unknown or other
  misc_feature (453)..(483): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatgttcttcagtttcgctcaccgttcggccaagggacacgactggagtattaaacgaactgtggctgcacatctgtcttcattccttcccgcctatcctagtaaacgttcctacttactccgttaggacggtccgggcttgggaccgtaaacgggccggtacaacgttagnacgatnnnnnnnnnnnnnnnnnnnnnnnnnnnnnnn

SEQ ID NO: 227305 - DNA, 412 bp, Homo sapiens
  misc_feature: GYAE6OF02FLM0Z.29.62.F07.1.454.CMB.1.raw
  modified_base (402)..(412): a, c, t, g, unknown or other
  misc_feature (402)..(412): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccacgggcacgactggagattaaacgactgtgctgcaccatctgtcttcatcttccgcaatctgaatactctatctgagcggctggcaaggcgcatagnnnnnnnnnnn

SEQ ID NO: 227306 - DNA, 485 bp, Homo sapiens
  misc_feature: GYAE6OF02IG6ZH.29.62.F07.1.454.CMB.1.raw
  modified_base (154)..(154): a, c, t, g, unknown or other
  misc_feature (154)..(154): n is a, c, g, or t
  modified_base (278)..(278): a, c, t, g, unknown or other
  misc_feature (278)..(278): n is a, c, g, or t
  modified_base (458)..(485): a, c, t, g, unknown or other
  misc_feature (458)..(485): n is a, c, g, or t
tcagatagagtactcacgaccggtgctcgatttagtagtcgcataaaagggaaaggccacgttctcctgcagggccagtcaaagtattagcagcagaaacttagcctggtaccagcaaaaacctggccaggctcccaggctcctcatctttggngcatctaccagggccactggcatcccagaccggttcagtggcaggtgggtctgggacagacttcactctcaccatcagcagactggggcctggaagatgcatcagtgtattactgcatcaaatnttggttcttctagttttcgcttcctaccgttcggaccaagggaccacgacgtaggaagtaacgttaaaaccgagtgtaggtcctcgactaacctatcgttagtcttacacttccttacccgctactcgtacgaacttctactatcctaggacgcgggtctgggactaagggcactaagtnnnnnnnnnnnnnnnnnnnnnnnnnnnn

SEQ ID NO: 227307 - DNA, 506 bp, Homo sapiens
  misc_feature: GYAE6OF02I15VL.29.62.F07.1.454.CMB.1.raw
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
  modified_base (475)..(506): a, c, t, g, unknown or other
  misc_feature (475)..(506): n is a, c, g, or t
tcagatagagtactcacgaccggtgctcgatttagtagtcgcataaagggaaaggggcccaacgttctccctgcagggccagtcaaagtattagcagcagaaacttagcctggtaccagcaaaaacctggccaggtctcccaggctcctcatctttggtgcatctaccagggccactggcatcccagaccggttcagtgcagtgggtctgggacagacttcacgtctcaccatcagcagactgggcctagaanatgcatcagtgtattactgtcatcaatntggtactnagttcgntctaccttcggacctaagggccacgtacgtgggaanaacttaaaacggaactggtaggtcctagacctaaccntcgtcgtcttacacttcccgtttaccccgctacttaccgtaggtaaactccttactacgtccgtaggacggccgggtcttaggggccaaagggtccaagatacggnnnnnnnnnnnnnnnnnnnnnnnnnnnnnnnn

SEQ ID NO: 227308 - DNA, 458 bp, Homo sapiens
  misc_feature: GYAE6OF02JSH7K.29.62.F07.1.454.CMB.1.raw
  modified_base (322)..(322): a, c, t, g, unknown or other
  misc_feature (322)..(322): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (428)..(458): a, c, t, g, unknown or other
  misc_feature (428)..(458): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatgttcttcagtttcgctcaccgttcggcctaagggcacgactgganattaaacgactgtagctgcacatcctgtcttcactccttcccgctagttcctagtaacgtcctactattcgtgacggtccggtnacggacaggtaccgntaatcgnnnnnnnnnnnnnnnnnnnnnnnnnnnnnnn

SEQ ID NO: 227309 - DNA, 443 bp, Homo sapiens
  misc_feature: GYAE6OF02IUWMR.29.62.F07.1.454.CMB.1.raw
  modified_base (378)..(378): a, c, t, g, unknown or other
  misc_feature (378)..(378): n is a, c, g, or t
  modified_base (432)..(443): a, c, t, g, unknown or other
  misc_feature (432)..(443): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagacgtggggcctgaagatgcatcagtgtattactgtcatcaattagtggtttcttcagtttcgctcctaccgttcggaccaagggcacgactggaagtaattaaacgactgtaggctgctaccatctgtctacactccttcccnctatctagtaataccttctactcgtgacgcgggtctcgggcaaggcgacatagnnnnnnnnnnnn

SEQ ID NO: 227310 - DNA, 416 bp, Homo sapiens
  misc_feature: GYAE6OF02FI6Y1.29.62.F07.1.454.CMB.1.raw
  modified_base (384)..(384): a, c, t, g, unknown or other
  misc_feature (384)..(384): n is a, c, g, or t
  modified_base (410)..(416): a, c, t, g, unknown or other
  misc_feature (410)..(416): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttctcagtttcgctcaccttcggccaagggcacgactggagattaaacgaactgtagctgcaccatctgtcttcattccttcccgctatctgaacgtctctatcngacgtcgggctgggcaaggcgcatgnnnnnnn

SEQ ID NO: 227311 - DNA, 461 bp, Homo sapiens
  misc_feature: GYAE6OF02F58YL.29.62.F07.1.454.CMB.1.raw
  modified_base (336)..(336): a, c, t, g, unknown or other
  misc_feature (336)..(336): n is a, c, g, or t
  modified_base (427)..(428): a, c, t, g, unknown or other
  misc_feature (427)..(428): n is a, c, g, or t
  modified_base (430)..(461): a, c, t, g, unknown or other
  misc_feature (430)..(461): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagtattaaacgactgnggctgcacatctgtcttcattccttacccgcctatcctagaacgttctctatcgtgacgccgggtctcggacgtaacggcgcgaagtacgnngnnnnnnnnnnnnnnnnnnnnnnnnnnnnnnnn

SEQ ID NO: 227312 - DNA, 438 bp, Homo sapiens
  misc_feature: GYAE6OF02FK8J4.29.62.F07.1.454.CMB.1.raw
  modified_base (322)..(322): a, c, t, g, unknown or other
  misc_feature (322)..(322): n is a, c, g, or t
  modified_base (386)..(386): a, c, t, g, unknown or other
  misc_feature (386)..(386): n is a, c, g, or t
  modified_base (428)..(438): a, c, t, g, unknown or other
  misc_feature (428)..(438): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactgganattaaacgaactgtgctgcacatctgtcttcattccttcccgctatctagaacgttactctacnctggacggtccgggtcttgggaccaaagggccacgtatacgnnnnnnnnnnn

SEQ ID NO: 227313 - DNA, 426 bp, Homo sapiens
  misc_feature: GYAE6OF02HVNDL.29.62.F07.1.454.CMB.1.raw
  modified_base (277)..(277): a, c, t, g, unknown or other
  misc_feature (277)..(277): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (417)..(426): a, c, t, g, unknown or other
  misc_feature (417)..(426): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatntggttcttctagtttcgctcaccttcggaccaagggacacgactggagaattaaacgactgtggctgcaccntctgtctcntcttcccgctatctcgatacctcgtatcttaggacgtcgggntcggacaggcgctatgnnnnnnnnnn

SEQ ID NO: 227314 - DNA, 588 bp, Homo sapiens
  misc_feature: GYAE6OF02HZ876.29.62.F07.1.454.CMB.1.raw
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (562)..(564): a, c, t, g, unknown or other
  misc_feature (562)..(564): n is a, c, g, or t
  modified_base (566)..(588): a, c, t, g, unknown or other
  misc_feature (566)..(588): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcacatcagcagactgggcctgagatgcatcagtgtattactgtcatcaatattggttcttctagttttcgcttccgaccgtttcggacccgaaagggaccaaccggtactaggggtaacgaaagtttaaaaccggaacgttcggtggacctggaccaaccgatttcgttcgttccttcgtacttcccgtttccccgaccctatttacctttacgggtaaactttaccgtttaccttacgttccggttacggaccggggttccgggggacctttacggggggaccctaaaaccgggggtccgtaacccggtaagttacgggatacgngtcngngngancnnntnnnnnnnnnnnnnnnnnnnnnnn

SEQ ID NO: 227315 - DNA, 473 bp, Homo sapiens
  misc_feature: GYAE6OF02G0T7N.29.62.F07.1.454.CMB.1.raw
  modified_base (352)..(352): a, c, t, g, unknown or other
  misc_feature (352)..(352): n is a, c, g, or t
  modified_base (460)..(473): a, c, t, g, unknown or other
  misc_feature (460)..(473): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccgttcagtggcagtgggtctgggacagacttcactctcaccatcagcagacgtggggcctgaagatgcatcagtgtattactgtcatcaattatggttcttactagtttcgctcctacccgttcggaccaacgggacacgtacgtggaataacttaaacgaactggnggctgcaccatctgttcttcacttcccttcccgcctactcttacggtaaacgttcctacgttattccgtacggtaggcccggggtctgggaccgaacggcgacatagnnnnnnnnnnnnnn

SEQ ID NO: 227316 - DNA, 446 bp, Homo sapiens
  misc_feature: GYAE6OF02FUJQN.29.62.F07.1.454.CMB.1.raw
  modified_base (430)..(432): a, c, t, g, unknown or other
  misc_feature (430)..(432): n is a, c, g, or t
  modified_base (434)..(446): a, c, t, g, unknown or other
  misc_feature (434)..(446): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttctagtttcgctctaccttcggccaagggacacgactggataataaacgactgtggctgcaccatctgtcttcactccttcccgcctatcctagtaacgtacttctatcgtgacggcggcgtcggacgaacggccgactagtagnnngnnnnnnnnnnnnn

SEQ ID NO: 227317 - DNA, 506 bp, Homo sapiens
  misc_feature: GYAE6OF02H6UH8.29.62.F07.1.454.CMB.1.raw
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (480)..(480): a, c, t, g, unknown or other
  misc_feature (480)..(480): n is a, c, g, or t
  modified_base (482)..(506): a, c, t, g, unknown or other
  misc_feature (482)..(506): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggctgaagntgcntcagtgtattactgtcattacaattattggtttcttctacgttttcgcttcctaccttcggaccctaaagggaccaacgtacgtagggaagtaacttaaaacgaactggtacggctcggtaccacctattccgtgttcttacactttccttccccgcctacttcgttacgaacgttccttgtacttcgtaggacggcgggtgtcggacgagggtccgactagtacggncnnnnnnnnnnnnnnnnnnnnnnnnn

SEQ ID NO: 227318 - DNA, 462 bp, Homo sapiens
  misc_feature: GYAE6OF02G2J3M.29.62.F07.1.454.CMB.1.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (429)..(462): a, c, t, g, unknown or other
  misc_feature (429)..(462): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattacngtcatcaatatgttcttnagtttcnctcaccttcggaccgaaggaccacgacngganattaaacgactgcgctgcacatctctcttcactccttcccgctagtctagtaacttacctcttatcgtaggaggtccgggtctgggacaagggccacgtaatgcnnnnnnnnnnnnnnnnnnnnnnnnnnnnnnnnnn

SEQ ID NO: 227319 - DNA, 431 bp, Homo sapiens
  misc_feature: GYAE6OF02H2OBP.29.62.F07.1.454.CMB.1.raw
  modified_base (368)..(368): a, c, t, g, unknown or other
  misc_feature (368)..(368): n is a, c, g, or t
  modified_base (414)..(431): a, c, t, g, unknown or other
  misc_feature (414)..(431): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggcccactggcatcccagaccggttcagtggcagtgggtctgggacagacttcactctcaccatcagcagactggggcctgaagatgcatcagtgtattactgtcatcaatatggttcttcagttttcgcttcaccttcggaccaagggacacgactggaagtattaaacgactggtggctgcacatctgtctcatcttcccnctatctagaatctctatctgagcggctgggcaaggcgacagtagcnnnnnnnnnnnnnnnnnn

SEQ ID NO: 227320 - DNA, 614 bp, Homo sapiens
  misc_feature: GYAE6OF02ICPBY.29.62.F07.1.454.CMB.1.raw
  modified_base (199)..(199): a, c, t, g, unknown or other
  misc_feature (199)..(199): n is a, c, g, or t
  modified_base (281)..(281): a, c, t, g, unknown or other
  misc_feature (281)..(281): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccacgtggcatcccgagaccggttcagtcggnaccggtgggtctgggacagacttcactctcaccatcagctagactgggcctgaagatgcatcgagtgtaatctgtacacttnaatattcgttacttactgttttcgccttcaccgttcgacgtaacggactacgacgtggtaataagttaaaccgaacgttgttcggccttaggaaccctactaacgttccgtaggttcccttaaatccgtttaacccgtttccccgacccgttaaatccgtttacgaaacgtttaccttctaacttcgttacgaacgggtcccggttacgttaacggggcgtaaaacggggtccgtccaaaaacgggtttacggacgtacgtacgtacgacgtacgtacgtacgtacgtacgtacgtacgacgtacgtcgacgtacgtatacgtcgtacgtaac

SEQ ID NO: 227321 - DNA, 470 bp, Homo sapiens
  misc_feature: GYAE6OF02I877N.29.62.F07.1.454.CMB.1.raw
  modified_base (256)..(256): a, c, t, g, unknown or other
  misc_feature (256)..(256): n is a, c, g, or t
  modified_base (448)..(448): a, c, t, g, unknown or other
  misc_feature (448)..(448): n is a, c, g, or t
  modified_base (450)..(470): a, c, t, g, unknown or other
  misc_feature (450)..(470): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaacctggccaggctcccaggctccctcatctttggtgcatctaccagggccactggcatcccagaccggttcagtggcaggtgggtctggggacagacttcactctcaccatcagcagaccgtggggcctggaagntgcatcagtgtattactgtcatcaatatggttcttctagtttcgcttcaccttcggaccaaggaccacgactggaagtattaaacgactggtgctgacacatctgttcttcactccttcccgcctattctacgtagtacctactacttctcggagcggggtctcggggaccaaggggccgacgaacgttagncnnnnnnnnnnnnnnnnnnnnn

SEQ ID NO: 227322 - DNA, 478 bp, Homo sapiens
  misc_feature: GYAE6OF02I3F4P.29.62.F07.1.454.CMB.1.raw
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (432)..(433): a, c, t, g, unknown or other
  misc_feature (432)..(433): n is a, c, g, or t
  modified_base (440)..(441): a, c, t, g, unknown or other
  misc_feature (440)..(441): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (454)..(460): a, c, t, g, unknown or other
  misc_feature (454)..(460): n is a, c, g, or t
  modified_base (462)..(466): a, c, t, g, unknown or other
  misc_feature (462)..(466): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (472)..(477): a, c, t, g, unknown or other
  misc_feature (472)..(477): n is a, c, g, or t
tcagatagagtactcacgaccggtgctcgatttagtagtcgcataaaggggaaagggccacggttctcctgcagggccattcaaagtattagcagcagaaacttagcctggtaccagcaaaaacctggccaggctcccaggctcctcatctttggtgcatctacagggccactggcatcccagaccggttcagtggcagtgggtctgggacagacttcactctcacatcagcagacgtggggcctgaagagtgactatacaggtgtattacctggtacaatcaatatggttcttctacgtttcgcttcacctttcggccaaggggacacgactcggganacgtaaagacttgngctgcacntctgtcttacatctccgctanctcgaatcnctagtccngagccggagtcggacgaacggcgactagtacgnngactgcnnagangtngtncgnnnnnnngnnnnngncncnnnnnnc

SEQ ID NO: 227323 - DNA, 576 bp, Homo sapiens
  misc_feature: GYAE6OF02HIIOW.29.62.F07.1.454.CMB.1.raw
  modified_base (253)..(253): a, c, t, g, unknown or other
  misc_feature (253)..(253): n is a, c, g, or t
  modified_base (546)..(576): a, c, t, g, unknown or other
  misc_feature (546)..(576): n is a, c, g, or t
tcagatagagtactcacgaccggtgctcgatttagtagtcgcataaaaggggaaagggccacgttctcctgcagggccattcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagacgtggggcctagaagntgcatcagtgtattactgtacatacaattagttcggtttcttacgtagttttccgccttccctacccgtttccggacccgtaaacggggactaccggtacgtaggtaacgtaaactttaaaaaccggaacgttaggtaggtctacggaccctaaccgtagttccgttgtttacctttaccgtacctttacccctttcccccgacttacttaccgtacgtaaacgttacccttcttaacttcccgtagggaccggtccgggtacgttcgggaaccgagggtccgatacgtagcnnnnnnnnnnnnnnnnnnnnnnnnnnnnnnn

SEQ ID NO: 227324 - DNA, 560 bp, Homo sapiens
  misc_feature: GYAE6OF02FZP4D.29.62.F07.1.454.CMB.1.raw
  modified_base (269)..(269): a, c, t, g, unknown or other
  misc_feature (269)..(269): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (533)..(560): a, c, t, g, unknown or other
  misc_feature (533)..(560): n is a, c, g, or t
tcagatagagtactcacgaccggtgctcgatttagtagtcgcataaaagggaaagggccacgttctcctgcagggccagtcaaagtattagcagcagaaacttagcctggtaccagacaaaaaacctggccaggctcccaggctcctcattctttggtgcatctaccagggccactggcatcccagaccggttcagtggcaggtgggtctgggacagtacttcactctccactactcagcagacggtcgggcctagaagatcgacactntagtagttacttacgtcgttacagtactaattagttcggtttacttcgtacgtttcgccgttcctaccggttaccggaaccggtaaggaacctaccggtagtaggaacgttaaaccttaaaacgtaacggtgtacggtacgtcgaccgtaacctcttcgtcgttacctttcgtaccttccctacccgacttaaccttcggtaattaaccgtcttatttacgacgttgggaccgggcgtgttacgacgaacggtcanacgtngcnnnnnnnnnnnnnnnnnnnnnnnnnnnn

SEQ ID NO: 227325 - DNA, 596 bp, Homo sapiens
  misc_feature: GYAE6OF02IT23Z.29.62.F07.1.454.CMB.1.raw
  modified_base (281)..(281): a, c, t, g, unknown or other
  misc_feature (281)..(281): n is a, c, g, or t
  modified_base (550)..(550): a, c, t, g, unknown or other
  misc_feature (550)..(550): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(573): a, c, t, g, unknown or other
  misc_feature (572)..(573): n is a, c, g, or t
  modified_base (575)..(578): a, c, t, g, unknown or other
  misc_feature (575)..(578): n is a, c, g, or t
  modified_base (580)..(582): a, c, t, g, unknown or other
  misc_feature (580)..(582): n is a, c, g, or t
  modified_base (584)..(585): a, c, t, g, unknown or other
  misc_feature (584)..(585): n is a, c, g, or t
  modified_base (587)..(592): a, c, t, g, unknown or other
  misc_feature (587)..(592): n is a, c, g, or t
  modified_base (594)..(596): a, c, t, g, unknown or other
  misc_feature (594)..(596): n is a, c, g, or t
tcagatagagtactcacgaccggtgctcgatttagtagtcgcataaagggaaagggccacgttctcctgcagggccagtcaaagtattagcagcagaaacttagcctggtaccagacaaaaacctggccaggctcccaggctcctcatctttggtgcatctaccagggccactggcatccccagaccggttcagtggcaggtgggtctggggacagacttcactctcaccatccagcagacgtggggcctggaagatgacatcagtgtattacgtgtctanacaattagttggttcttacgtagtttcgtctacgtccttaccggaccgaaacgggaccacgtaaccgtggtaacgaattaaaacgacgtagtacggcgttcgaccgtaacctacgtacgttcggttacttaccgtactttcccgttaccccggaccttaccgttcgtaacggtaaccggttttaaaccctctttaaagttccgttaaggacgggtaccggggttaccggtcgggacccggtaaacgggtaccggcgtaaacgttacggncgtatcncgncactcgncnncnnannnngnnntnntnnnnnncnnn

SEQ ID NO: 227326 - DNA, 512 bp, Homo sapiens
  misc_feature: GYAE6OF02HB0AQ.29.62.F07.1.454.CMB.1.raw
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(493): a, c, t, g, unknown or other
  misc_feature (487)..(493): n is a, c, g, or t
  modified_base (495)..(512): a, c, t, g, unknown or other
  misc_feature (495)..(512): n is a, c, g, or t
tcagatagagtactcacgaccggtgctcgatttagtagtcgcataaagggaaagggaccacgttctcctgcagggccagtcaaagtattagcagcagaaacttagcctggtaccagcaaaaactggccaggctccagctcctnatctttggncatctaccagggccactggcactcccaggaccggttcagtggcagtgggtctgggacagacttcacttcncacntcagcagactgggccagaagatgcatcgagtgtattactgtacatactaagtattcggttcttactagtttcnctcgtaccttcggaacctacgggacacggtagtggaagtaactaaacgatacggtcgctacgcaaccgtntcgtcgtacttcacttcccgtcccgtctacttcacgttaactcctactcgtacgtcggacgtcggccgtaggaccgtaggccggtactaaggtacgtcnggactgacgcgtacntngnnnnnnngnnnnnnnnnnnnnnnnnn

SEQ ID NO: 227327 - DNA, 546 bp, Homo sapiens
  misc_feature: GYAE6OF02GZURD.29.62.F07.1.454.CMB.1.raw
  modified_base (249)..(249): a, c, t, g, unknown or other
  misc_feature (249)..(249): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (527)..(528): a, c, t, g, unknown or other
  misc_feature (527)..(528): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctggggacagacttcactctcaccatcagcagactgggcctgaagntgcatcagtgtattactgtcatcaatagtggttcttctagttcgctcaccgttcgccgaaggccacgactggagtaattaaaacggactggtcgactacgcactactcgttgtactttcacttccgttcccggactaattccgtaaggaacgttaccttaccgttacgtacgttaggggaacggtcccggggtatcgggggacctaaacggggtccaccgttaaagtacggcngtacngtagncgancgngnagngngacacgnancgagtgtcncgnntngcgacgcanacacanc

SEQ ID NO: 227328 - DNA, 493 bp, Homo sapiens
  misc_feature: GYAE6OF02GFNGG.29.62.F07.1.454.CMB.1.raw
  modified_base (422)..(422): a, c, t, g, unknown or other
  misc_feature (422)..(422): n is a, c, g, or t
  modified_base (466)..(493): a, c, t, g, unknown or other
  misc_feature (466)..(493): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgccatctaccagggccactggcatcccagaccggttcagtggcagtgggtctgggacaggacttcactctcaccatcagcagactggggcctagaagatgcatcagtgtattactgtcatacaatagttggtttctctagtttcgctaccgtaccttcggaccgaagggtaccacggacgtagggaactaagttaaaacgaactggtagcctagaccaccattctgtcttctacttccttccccgctactcctagtaacgttctactntacgtggacgtcgggtctacgggacaacgggccgactagtacgnnnnnnnnnnnnnnnnnnnnnnnnnnnn

SEQ ID NO: 227329 - DNA, 613 bp, Homo sapiens
  misc_feature: GYAE6OF02ISCHB.29.62.F07.1.454.CMB.1.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (582)..(613): a, c, t, g, unknown or other
  misc_feature (582)..(613): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctnaccatcagcagactggggcctagaagntgcaagtcagtgtaatttacgtgtactatactaaatattggtttaccttactagttttccgacttacctaccgtttaccgggaccgtaaacgggactaaccggtaactaggggtaacgtaaacgtttaaaaaccggaacgttcggtacggaccttacgggactaaccccgaatttccggttacgtttaccctttaccgtaactttcccgttacccccggtacctaacgttacctttagggtaaaactttacccttacgttaatttaccgtaggggaccgggtccgggtaacttggggaaccctaaaggggccctagtaaagttcgatcgtannnnnnnnnnnnnnnnnnnnnnnnnnnnnnnn

SEQ ID NO: 227330 - DNA, 562 bp, Homo sapiens
  misc_feature: GYAE6OF02HQCD8.29.62.F07.1.454.CMB.1.raw
  modified_base (248)..(248): a, c, t, g, unknown or other
  misc_feature (248)..(248): n is a, c, g, or t
  modified_base (523)..(523): a, c, t, g, unknown or other
  misc_feature (523)..(523): n is a, c, g, or t
  modified_base (532)..(533): a, c, t, g, unknown or other
  misc_feature (532)..(533): n is a, c, g, or t
  modified_base (535)..(536): a, c, t, g, unknown or other
  misc_feature (535)..(536): n is a, c, g, or t
  modified_base (540)..(562): a, c, t, g, unknown or other
  misc_feature (540)..(562): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagcttcactctcaccatcagcagacgtgggcctgaantgcatcagtgtattactgtcatcaatagtggttcttcgtagttttccgcttcctacccgtttcggacccgtaaaggggacctaccggtaccgttagggaacgtaacgtttaaaaaccggaacttgggtaggtcctcggaccgtaacctattaccgtgttacccttctacttcccttaccccgtcctattccgtagtaacgttacttacttactccgttaggacgggtccggggtacttacggggaccgtaacgggccgtacgtaacgtacgatcngactgacgnncnngtannnnnnnnnnnnnnnnnnnnnnn

SEQ ID NO: 227331 - DNA, 479 bp, Homo sapiens
  misc_feature: GYAE6OF02G88KA.29.62.F07.1.454.CMB.1.raw
  modified_base (287)..(287): a, c, t, g, unknown or other
  misc_feature (287)..(287): n is a, c, g, or t
  modified_base (339)..(339): a, c, t, g, unknown or other
  misc_feature (339)..(339): n is a, c, g, or t
  modified_base (415)..(415): a, c, t, g, unknown or other
  misc_feature (415)..(415): n is a, c, g, or t
  modified_base (444)..(444): a, c, t, g, unknown or other
  misc_feature (444)..(444): n is a, c, g, or t
  modified_base (448)..(479): a, c, t, g, unknown or other
  misc_feature (448)..(479): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaattatggttcttntagtttcgctctaccttcggccaagggcacgactggataattaaacgaatgnggctgacacctatcttcgtcttcacttccttcccacctacttctcggtatacctctattccgtggacggtccgggngtcggacgtaacgggcgactaagtacgantacnnnnnnnnnnnnnnnnnnnnnnnnnnnnnnnn

SEQ ID NO: 227332 - DNA, 474 bp, Homo sapiens
  misc_feature: GYAE6OF02JODTB.29.62.F07.1.454.CMB.1.raw
  modified_base (250)..(250): a, c, t, g, unknown or other
  misc_feature (250)..(250): n is a, c, g, or t
  modified_base (442)..(442): a, c, t, g, unknown or other
  misc_feature (442)..(442): n is a, c, g, or t
  modified_base (444)..(446): a, c, t, g, unknown or other
  misc_feature (444)..(446): n is a, c, g, or t
  modified_base (449)..(474): a, c, t, g, unknown or other
  misc_feature (449)..(474): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctagaagntgcatcagtgtattactgtcatcaatatggttcttctagtttcgctcctaccttcggaccgtaagggaccacgacgtggaagtaactttaaaacgaacgttgtggactgactacatactgtacttctacttccttcccgctactctagaagttctctatctggacggcggctgggactaggcgactagtcgntnnntgnnnnnnnnnnnnnnnnnnnnnnnnnn

SEQ ID NO: 227333 - DNA, 515 bp, Homo sapiens
  misc_feature: GYAE6OF02GMX5J.29.62.F07.1.454.CMB.1.raw
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (491)..(515): a, c, t, g, unknown or other
  misc_feature (491)..(515): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgacatcagtgtattactgtcatcaatatggttcttcagtttcgctcaccgttcggccaagggaccacgacgtaggagtaagttaaacgaacttggtaggtctgaccaccgattcgtgttccttacacttccttccccgacctattccgttagaacgtttacctacttactacgtggacggtccggggacttagggaccgtaaaggggccagtaagtacggnctagactnggacatacgagnnnnnnnnnnnnnnnnnnnnnnnnn

SEQ ID NO: 227334 - DNA, 576 bp, Homo sapiens
  misc_feature: GYAE6OF02H9KRB.29.62.F07.1.454.CMB.1.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(552): a, c, t, g, unknown or other
  misc_feature (549)..(552): n is a, c, g, or t
  modified_base (554)..(558): a, c, t, g, unknown or other
  misc_feature (554)..(558): n is a, c, g, or t
  modified_base (560)..(563): a, c, t, g, unknown or other
  misc_feature (560)..(563): n is a, c, g, or t
  modified_base (565)..(567): a, c, t, g, unknown or other
  misc_feature (565)..(567): n is a, c, g, or t
  modified_base (569)..(573): a, c, t, g, unknown or other
  misc_feature (569)..(573): n is a, c, g, or t
  modified_base (575)..(576): a, c, t, g, unknown or other
  misc_feature (575)..(576): n is a, c, g, or t
tcagatagagtactcacgaccggtgctcgatttagtagtcgcataaagggggaaagggccacgttctcctgcagggccatttcaaagtattagcagcagaaacttagcctggtaccagcaaaaacctggccaggctcccaggctcctcatctttggtgcatctaccagggcccactggcatcccagaccggttcagtgcagtgggtctgggacagacttcactctcaccatcagcaagacgtggggcctagaagntgcntcagtgtattctagtcatcaattntggtttacttnacgttttcgctactaccgttcggaccaagggaccacggtacgtggaacttaagttaaaacgacgtaggttacggactacgtacgaactattccgttagttccttactacgtttcccttacccccgcttagttccttaacggtaaacgtttccttaccttaacttccgggttacggaacggggtccggtacggttacgggaacccggaacggggtacgtaccgtaaaaggtcgcgagtcgngagcgngtacncncnnnnannnnnannnncnnngnnnnnann

SEQ ID NO: 227335 - DNA, 512 bp, Homo sapiens
  misc_feature: GYAE6OF02GDB2R.29.62.F07.1.454.CMB.1.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (479)..(479): a, c, t, g, unknown or other
  misc_feature (479)..(479): n is a, c, g, or t
  modified_base (483)..(512): a, c, t, g, unknown or other
  misc_feature (483)..(512): n is a, c, g, or t
tcagatagagtactcacgaccggtgctcgatttagtagtcgcataaaaggggaaagggccacgttctcctgcagggccagtcaaagtattagcagcagaaacttagcctggtaccagcaaaaaacctggccaggctcccaggctcctcatctttggtgcatcctaccagggccactggcactcccaggaccggttcaggtggcaggtgggtctgggacagacttcactctccaccatcagcagacgtggggcctgaagatgcatcagttgtattactgtacatacaattagttggtttcttcgtagttttccgccttctacccgttcgggaccaagggaccacgactggaagattaaacgatggtgctgcacntctntcttnacttcctacccgcctatccgtagtaacgtttcctacttattcgtagggacgggtccgggtactcggggaccgaacggggcctaacgtaagtaggctnacgnnnnnnnnnnnnnnnnnnnnnnnnnnnnnn

SEQ ID NO: 227336 - DNA, 794 bp, Homo sapiens
  misc_feature: GYAE6OF02JERKR.29.62.F07.1.454.CMB.1.raw
  modified_base (751)..(751): a, c, t, g, unknown or other
  misc_feature (751)..(751): n is a, c, g, or t
  modified_base (755)..(755): a, c, t, g, unknown or other
  misc_feature (755)..(755): n is a, c, g, or t
  modified_base (763)..(764): a, c, t, g, unknown or other
  misc_feature (763)..(764): n is a, c, g, or t
  modified_base (766)..(773): a, c, t, g, unknown or other
  misc_feature (766)..(773): n is a, c, g, or t
  modified_base (775)..(794): a, c, t, g, unknown or other
  misc_feature (775)..(794): n is a, c, g, or t
tcagatagagtactcacgaccggtgctcgatttagtagtcgcataaaagggaaagggccacgttctcctgcagggccagtcaaagtattagcagcagaaacttagcctggtaccaagaaacctaaacgtcgacgacggtccctaccgacggtccttcctactctttcggtttgggtcgactacttaccctaaccggaccgggaccctacggtcggactaccctacccgaaccgggttacccggttagtacgggtcggacgtagggggttcgggttacgggtacgggtaacgaaacggtttacccttaccgtacccttcctacccaaccctacgtacgacgaacgaacggttaccggggtccgggtaccgtaagaagtgtacgacgtactacggttaggttagtttaaccgtttacgttcgtaactacttaaaccttaaagttcggtttacggttttccttacggttttaccggttcccgttactaccccgtttaaccgggttacccggtaaaccgggaaacggtacccggtaaccgtacggtaaggggtaacttaaaacggttaaaaccgttagttcggtccgtacgaccggtaacctaccgtacgtttcggtcttttaccgtaccttactttacccccggttcccgaaccttacgttaccggtaattaccccgtttactacttaacccgttggaagggtccgggtccggttacgggtacggaaacgggtaccgtccggtaagttaacggngtancgagtcanncnnnnnnnncnnnnnnnnnnnnnnnnnnnn

SEQ ID NO: 227337 - DNA, 433 bp, Homo sapiens
  misc_feature: GYAE6OF02HEAOD.29.62.F07.1.454.CMB.1.raw
  modified_base (288)..(288): a, c, t, g, unknown or other
  misc_feature (288)..(288): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (424)..(433): a, c, t, g, unknown or other
  misc_feature (424)..(433): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagacgtggggcctggaaagatgcatcagtgtattactgtcatcaatatggttcttnagtttcgctctaccttcggcctaagggacacgactggagtattaaacgacgtgtgctgacactatctcgtcttacatccttcccgctatctagaactactctatctgacggcggntcgggactaaggctanagtannnnnnnnnn

SEQ ID NO: 227338 - DNA, 497 bp, Homo sapiens
  misc_feature: GYAE6OF02GSVHN.29.62.F07.1.454.CMB.1.raw
  modified_base (467)..(467): a, c, t, g, unknown or other
  misc_feature (467)..(467): n is a, c, g, or t
  modified_base (476)..(497): a, c, t, g, unknown or other
  misc_feature (476)..(497): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttgctgcatctaccagggccactggcatccccagaccggttcagtggcaggtgggtctgggacagacttcactctcaccatcagcagacgtcggggcctaggaagatgccatcagtgtaattactgtcatacaattattcggttcttctagttttcgcttcctaccgtttcgggacctaaagggacacgtacgtggaagtaattaaaacgtaactggtagctggaccacctaagttctcggttcttactacttcccttcccgccatcctgaacgttacttctattcgtcggtaggccgggtctagggtccaagggtcnctaagtgcnnnnnnnnnnnnnnnnnnnnnn

SEQ ID NO: 227339 - DNA, 440 bp, Homo sapiens
  misc_feature: GYAE6OF02F4BQ0.29.62.F07.1.454.CMB.1.raw
  modified_base (321)..(321): a, c, t, g, unknown or other
  misc_feature (321)..(321): n is a, c, g, or t
  modified_base (418)..(440): a, c, t, g, unknown or other
  misc_feature (418)..(440): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggcacgactgganattaaacgaatgtggctgcacatctgtcttcattctcccgccattctagaacgttactctattctgaggtcgggctaggcaagggccgacagtacgnnnnnnnnnnnnnnnnnnnnnnn

SEQ ID NO: 227340 - DNA, 555 bp, Homo sapiens
  misc_feature: GYAE6OF02IXW2Z.29.62.F07.1.454.CMB.1.raw
  modified_base (282)..(282): a, c, t, g, unknown or other
  misc_feature (282)..(282): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (526)..(534): a, c, t, g, unknown or other
  misc_feature (526)..(534): n is a, c, g, or t
  modified_base (536)..(540): a, c, t, g, unknown or other
  misc_feature (536)..(540): n is a, c, g, or t
  modified_base (542)..(555): a, c, t, g, unknown or other
  misc_feature (542)..(555): n is a, c, g, or t
tcagatagagtactcacgaccggtgctcgatttagtagtcgcataaaagggaaagggccacgttctcctgcagggccagtcaaagtattagcagcagaaaacttagcctggtaccagcaaaaaacctggccaggctcccaggctcctcatcttttggtgcatctaccagggccactggcatcccagaccggttcagtggcagtgggtctgggacagacttcactctcaccatcagcagacgtgggcctagaagatgcatcagtgtattactgtcatctaatntgttcttctagtttcgcttcgtacccttcggacccgaagggactaccgaacgttggaagtaaacgttaaaacgacgttaggtcggacgtcgaccaacctagttcttcgttactttctacttcccttccccgacctaacttccgttaagtaacgtttacctaccgtttactaccgtagggtaccggccgggttgtacgggaaccgaacgggccgtaaccgtaaggtcgagttgaactganacngnnnnnnnnngnnnnngnnnnnnnnnnnnnn

SEQ ID NO: 227341 - DNA, 695 bp, Homo sapiens
  misc_feature: GYAE6OF02FIPCN.29.62.F07.1.454.CMB.1.raw
  modified_base (259)..(259): a, c, t, g, unknown or other
  misc_feature (259)..(259): n is a, c, g, or t
  modified_base (623)..(623): a, c, t, g, unknown or other
  misc_feature (623)..(623): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
  modified_base (661)..(661): a, c, t, g, unknown or other
  misc_feature (661)..(661): n is a, c, g, or t
  modified_base (669)..(669): a, c, t, g, unknown or other
  misc_feature (669)..(669): n is a, c, g, or t
  modified_base (673)..(676): a, c, t, g, unknown or other
  misc_feature (673)..(676): n is a, c, g, or t
  modified_base (681)..(681): a, c, t, g, unknown or other
  misc_feature (681)..(681): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagttgggtctgggacacgacttcactctccacatcagcgagcgtcggggccttggaaacgtntcggacatcgtaagtggttaacttactcgtcactcctaaagttacgttggttttaccttcgttaacggttttcccgtcctaccgttacccgttccggtacccgaaacggggtcctaaccgggtaccgtagggtaacggtaaacgttaaaaaccggacgttagggtacggtctacggtacccacgtaaacgtttcgtaacggtttcctttaccgtaaccgttcccgtttaaccccggccctaagtttcccgtaaacgtaaccggttacgttttacctaaccgtttccgttacgggaaccgggttacccggggtacgttccggggaaccggtaaaccggggccctaaacgttacggtacgtcggancgggtactgttcnctncgtagcttgcgctancgnacgntacgtacntctnnnntacgngtcgtcgntntntc

SEQ ID NO: 227342 - DNA, 231 bp, Homo sapiens
  misc_feature: GYAE6OF02HLL5Y.29.62.F07.1.454.CMB.1.raw
  modified_base (203)..(203): a, c, t, g, unknown or other
  misc_feature (203)..(203): n is a, c, g, or t
  modified_base (208)..(231): a, c, t, g, unknown or other
  misc_feature (208)..(231): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggaccaggctcccgaggcctcctcatctttggtgcatcacaggcactgcatcccagacggttcagtggcaggtggtcgnggacnnnnnnnnnnnnnnnnnnnnnnnn

SEQ ID NO: 227343 - DNA, 598 bp, Homo sapiens
  misc_feature: GYAE6OF02JF98C.29.62.F07.1.454.CMB.1.raw
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (567)..(568): a, c, t, g, unknown or other
  misc_feature (567)..(568): n is a, c, g, or t
  modified_base (571)..(574): a, c, t, g, unknown or other
  misc_feature (571)..(574): n is a, c, g, or t
  modified_base (577)..(579): a, c, t, g, unknown or other
  misc_feature (577)..(579): n is a, c, g, or t
  modified_base (582)..(582): a, c, t, g, unknown or other
  misc_feature (582)..(582): n is a, c, g, or t
  modified_base (584)..(591): a, c, t, g, unknown or other
  misc_feature (584)..(591): n is a, c, g, or t
  modified_base (593)..(598): a, c, t, g, unknown or other
  misc_feature (593)..(598): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctccaccgatcagcagacgtggggcctagaagatgctatcagttgtaacttacttggtactatactaaattagttcggtttcttcgttacgttttccgtccttcctaacccgtttccgggaccgaaacgggtaccacggtaaccgtggaacgtaagttaaaaccggtaacgtggttacgtccgtgaaccaccgtattccgttcgttaccttactacgttacctttcccccggactacgtttacgcgttaaaaccggtctacctacgttcgtacgggtaggacccggggttccgtagggtaacgaaccggggtcaaaccgttagtaacgggngctangcangtcgngnnagnnnngtnnncgngnnnnnnnngnnnnnn

SEQ ID NO: 227344 - DNA, 434 bp, Homo sapiens
  misc_feature: GYAE6OF02IS9DB.29.62.F07.1.454.CMB.1.raw
  modified_base (296)..(296): a, c, t, g, unknown or other
  misc_feature (296)..(296): n is a, c, g, or t
  modified_base (420)..(420): a, c, t, g, unknown or other
  misc_feature (420)..(420): n is a, c, g, or t
  modified_base (424)..(434): a, c, t, g, unknown or other
  misc_feature (424)..(434): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaaacctggccaggctcccaggctcctcatctttggtgcatctaccagggccactggcatcccagaccggttcagtggcaggtgggtctgggacagacttcactctcaccatcagcagactggggcctgaagatgcatcagtgtattactgtcatcaatatggttcttctagtttcncttcaccgttcggaccgtaacgggacacgacgtggagtattaaacgactgtggctgcacatctgtcttcatccttccacctactctagtaactcctctatctgaggcggcgtggacacgggcgnatgnnnnnnnnnnn

SEQ ID NO: 227345 - DNA, 635 bp, Homo sapiens
  misc_feature: GYAE6OF02F3PHJ.29.62.F07.1.454.CMB.1.raw
  modified_base (530)..(530): a, c, t, g, unknown or other
  misc_feature (530)..(530): n is a, c, g, or t
  modified_base (555)..(555): a, c, t, g, unknown or other
  misc_feature (555)..(555): n is a, c, g, or t
  modified_base (562)..(562): a, c, t, g, unknown or other
  misc_feature (562)..(562): n is a, c, g, or t
  modified_base (573)..(573): a, c, t, g, unknown or other
  misc_feature (573)..(573): n is a, c, g, or t
  modified_base (581)..(581): a, c, t, g, unknown or other
  misc_feature (581)..(581): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (596)..(596): a, c, t, g, unknown or other
  misc_feature (596)..(596): n is a, c, g, or t
  modified_base (628)..(628): a, c, t, g, unknown or other
  misc_feature (628)..(628): n is a, c, g, or t
  modified_base (632)..(632): a, c, t, g, unknown or other
  misc_feature (632)..(632): n is a, c, g, or t
tcagatagagtactcacgaccggtgctcgatttagtagtcgcataaagggaaagggccacgttctcctgcaggccagtcaaagtattagcagcagaaacttagcctggtaccagcaaaaacctggccaggctcccaggctcctcatctttggtgcatctaccgagggccactggcatcccagaccggttcagtggcaggtgggtctgggacagacttcgactctccacctatcagcagacgtcgggcctagaacgatgctagtcagttcgtacttacgtgtactatactaattacgttcggtttccttacgtacgtttccgccttaccgtacccgtttaccggaccaacgggtaccacggtacgtaggataaacgttaaacggtacgtggtacgctacgacctactacgttcgttgttaccttaccgtacgtttcccgtacccgtaccgtacgttaccgtaggtaacctttccctaacgttactacccgggttagggaaaccggggtcccggtacgttaggggtaaaccnccgggtaccgattaacggtacggcngccgtancttaaccgcgngcgtctancgtanctacncngcnctatctctatcgtcgtacgtacgtctcacacnctcngcg

SEQ ID NO: 227346 - DNA, 537 bp, Homo sapiens
  misc_feature: GYAE6OF02G62RY.29.62.F07.1.454.CMB.1.raw
  modified_base (467)..(467): a, c, t, g, unknown or other
  misc_feature (467)..(467): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (504)..(505): a, c, t, g, unknown or other
  misc_feature (504)..(505): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (529)..(530): a, c, t, g, unknown or other
  misc_feature (529)..(530): n is a, c, g, or t
  modified_base (536)..(537): a, c, t, g, unknown or other
  misc_feature (536)..(537): n is a, c, g, or t
tcagatagagtactcacgaccggtgctcgatttagtagtcgcataaagggaaaggggccacgttctcctgcagggccagtcaaagtattagcagcagaaacttagcctggtaccgagcaaaaacctggccaggctcccaggctcctcatctttggtgcatctaccagggccactggcatcccagaccggttcagtggcaggtgggtctggggacagcttcactctcaccatcagcagacgtgggggcctgagatgcatcagtgtattctgtcatcaatatggttcttctaggtttcgcttcgaccgtttcggccaagggtcacggtactagggataacttaaacgaacgttggtacggctggacaccatactgtccttcacttccttcccgccattctagaacgttacttacgtactcgttggacgtcggggtctcggggacgaacgggccgacgtacgttaaggcncgttcactcgctacgagtcgctggcagngtcgngtcnnagnganacncncncgtgngtacgnngtctgnn

SEQ ID NO: 227347 - DNA, 531 bp, Homo sapiens
  misc_feature: GYAE6OF02I955M.29.62.F07.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (507)..(531): a, c, t, g, unknown or other
  misc_feature (507)..(531): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaacctggccaggctcccaggctcctcatctttggtgcatctaccgagggccactggcactcccagaccggttnagtggcagtgggtctgggacagacttcactcctcaccntccancgagccgtggggccctagaagatcgcatacagttacgttacttaactagttaaatactaattacgttcggttactttcgtagtttccgtccttacctcccgttccggaccgaaacggactacgacgtacggaataacgttaaacgacgtgtcggacctgaccactactctagttctctactttccctcccgactatctaggttaacgttaccttactacgttacgtcggacgggtcggtcggtcggaacggtacggcctacgtagtacgcnnnnnnnnnnnnnnnnnnnnnnnnn

SEQ ID NO: 227348 - DNA, 600 bp, Homo sapiens
  misc_feature: GYAE6OF02IAVK3.29.62.F07.1.454.CMB.1.raw
  modified_base (154)..(154): a, c, t, g, unknown or other
  misc_feature (154)..(154): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (538)..(538): a, c, t, g, unknown or other
  misc_feature (538)..(538): n is a, c, g, or t
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (582)..(584): a, c, t, g, unknown or other
  misc_feature (582)..(584): n is a, c, g, or t
  modified_base (586)..(588): a, c, t, g, unknown or other
  misc_feature (586)..(588): n is a, c, g, or t
  modified_base (592)..(594): a, c, t, g, unknown or other
  misc_feature (592)..(594): n is a, c, g, or t
  modified_base (598)..(599): a, c, t, g, unknown or other
  misc_feature (598)..(599): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctccacggctcctcatctttggngtcgatctaccagggccactggcactcccagaccggttnagtggcnggtggtcngggacagctcatcncacatcagcagccgtgggacctagaagactgaccatacagttcgtattacgtgtacatacgaattgttacggtttcttctacggtttcgtaccttccgtaaccggttcggaacccggtaacggtaaccgtaacgtaaccggtacggtaacgtaaaacgttaaacccggagttacggtcggtacgtacgtaccggaccttaagtcctacgtcttactcttaccctcccgtaactcttacgacggtaacttataccgtagtaccgttggacccggcggtccgggtacacgggtaacggtcgacgtacgtagtagaccnggaacttgntacgcncngngtcgcngngngacgacgctactcgnnngnnnatcnnnctcnnc

SEQ ID NO: 227349 - DNA, 513 bp, Homo sapiens
  misc_feature: GYAE6OF02JVUIT.29.62.F07.1.454.CMB.1.raw
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (432)..(432): a, c, t, g, unknown or other
  misc_feature (432)..(432): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (478)..(479): a, c, t, g, unknown or other
  misc_feature (478)..(479): n is a, c, g, or t
  modified_base (481)..(482): a, c, t, g, unknown or other
  misc_feature (481)..(482): n is a, c, g, or t
  modified_base (484)..(484): a, c, t, g, unknown or other
  misc_feature (484)..(484): n is a, c, g, or t
  modified_base (486)..(488): a, c, t, g, unknown or other
  misc_feature (486)..(488): n is a, c, g, or t
  modified_base (490)..(491): a, c, t, g, unknown or other
  misc_feature (490)..(491): n is a, c, g, or t
  modified_base (493)..(494): a, c, t, g, unknown or other
  misc_feature (493)..(494): n is a, c, g, or t
  modified_base (496)..(513): a, c, t, g, unknown or other
  misc_feature (496)..(513): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcaggtgcaggtgggtctgggacagacttcactctcaccatcagcagacgtggggcctaggaacgatgacattcagttgttattactgtctatcaattgtggttccttctagtttcgcctcctaccgttccggacgaacgggtcacgacgtggaactaacgttaacgacgtggtggctagacactntacttgtctactctccgttacccnctacgtctacgacgttcttacgtattcgtaaggngtcggtctcgggaccgtaacgggcttacggatttacggngtcngtnntnnanannngnncnngnnnnnnnnnnnnnnnnnn

SEQ ID NO: 227350 - DNA, 490 bp, Homo sapiens
  misc_feature: GYAE6OF02JKTDA.29.62.F07.1.454.CMB.1.raw
  modified_base (276)..(276): a, c, t, g, unknown or other
  misc_feature (276)..(276): n is a, c, g, or t
  modified_base (398)..(398): a, c, t, g, unknown or other
  misc_feature (398)..(398): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (469)..(474): a, c, t, g, unknown or other
  misc_feature (469)..(474): n is a, c, g, or t
  modified_base (477)..(477): a, c, t, g, unknown or other
  misc_feature (477)..(477): n is a, c, g, or t
  modified_base (479)..(482): a, c, t, g, unknown or other
  misc_feature (479)..(482): n is a, c, g, or t
  modified_base (484)..(490): a, c, t, g, unknown or other
  misc_feature (484)..(490): n is a, c, g, or t
tcagatagagtactcacgaccggtgctcgatttagtagtcgcataaaggggaaagggaccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggctgggacagactcactctcaccatcagcagactggggcctgaagatgcatcagtgtattactgtcatcaatntggttcttcagtttcgctcaccttcggaccaagggccacgactaggagaacttaaacgactggtacgctagcacactctgtctacacttcttcccgacctattcagtaacgtacttacctancttcggaggtccgggtcttgggacaacgggccataagtcgagctagcntcgacncngacntcgngtacngnnnnnngcntnnnncnnnnnnn

SEQ ID NO: 227351 - DNA, 519 bp, Homo sapiens
  misc_feature: GYAE6OF02FVBBE.29.62.F07.1.454.CMB.1.raw
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (495)..(498): a, c, t, g, unknown or other
  misc_feature (495)..(498): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (505)..(509): a, c, t, g, unknown or other
  misc_feature (505)..(509): n is a, c, g, or t
  modified_base (511)..(516): a, c, t, g, unknown or other
  misc_feature (511)..(516): n is a, c, g, or t
  modified_base (518)..(519): a, c, t, g, unknown or other
  misc_feature (518)..(519): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcaggtgggtctgggacagacttcactctcaccatcagcagacgtggggcctggaagatgcatcagtgtattactgtacatcaatntggttcttctagttcnctcaccgttcggaccgaagggacacggactgggagtaacttaaacgaatggtggtctgacacntctggtcttacntccttcccgcctatctagtaaacgttccttactacttccgtagggaaccgtcgggggtccttaacgggcgaaacgggtacccgtaccgaagttaacggtnactanactgnctanacgantncgnnnntngangnnnnngnnnnnnann

SEQ ID NO: 227352 - DNA, 620 bp, Homo sapiens
  misc_feature: GYAE6OF02IYC0V.29.62.F07.1.454.CMB.1.raw
  modified_base (157)..(157): a, c, t, g, unknown or other
  misc_feature (157)..(157): n is a, c, g, or t
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (589)..(589): a, c, t, g, unknown or other
  misc_feature (589)..(589): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagatagagtactcacgaccggtgctcgatttagtagtcgcataaaggggaaagggccacgttctcctgcagggccagtcaaagtattagcagcagaaacttagcctggtaccagcaaaaacctggccaggctcccaggctccctcatctttgggncatctaccagggcctactggcatcccagaccggttnagtgcagtgggtcngggacagacttcactctccaccntcagcacgactggggacctgaagatcgcattcagttgtacttacgtgtacatacaatagtgtttacttctaacgtttccacttcgaccgtttccggaccaaaggggtacctacggacgttacgggaacgtaacttaaaaccggaacgttcggaccggtaacttacggaacctaaacctacgtttccgtacgtttacctttactaaaccgttcccttaaccccgtacctaacgttccgtaacgttaaaccgttaccttacgttaacgttcgttaggaccggtcgggtccgtacggacgtaaacggcaacgttaacgngacgtnccgtatcncntacntacgntactnagcagnananacngactagacgacactgacncgananatananc

SEQ ID NO: 227353 - DNA, 638 bp, Homo sapiens
  misc_feature: GYAE6OF02FZD5J.29.62.F07.1.454.CMB.1.raw
  modified_base (209)..(209): a, c, t, g, unknown or other
  misc_feature (209)..(209): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (610)..(616): a, c, t, g, unknown or other
  misc_feature (610)..(616): n is a, c, g, or t
  modified_base (618)..(621): a, c, t, g, unknown or other
  misc_feature (618)..(621): n is a, c, g, or t
  modified_base (623)..(623): a, c, t, g, unknown or other
  misc_feature (623)..(623): n is a, c, g, or t
  modified_base (625)..(627): a, c, t, g, unknown or other
  misc_feature (625)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (635)..(638): a, c, t, g, unknown or other
  misc_feature (635)..(638): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccgaggccactggcatcccagaccggttcagtgcagtggtctgggacngacttcactctcacatcagcagacgtggggcctgaacgatcggacacgtcaggttgtaatttactacgttactactaccgaaattacgttcgggttttaccttttacgtaacggtttttccgccgtttaccgtaccccggtttccgggttaacccgaaacggggtaacctaaccggtaaccggttaagggaacgtaaacgttttaaaaccggaacgttagggtacggtacgtacggaccctacctaagttaccgtttgttcctttactacttaccccgtttcccgaacccttattccgttaacggtaactttacccgtttacgtactttccggtaagtacggggaccggtgtccgggtaacgacggggtacctagttacgaccgancgntgatcngangcnnnnnnngnnnncncnnngncngcannnn

SEQ ID NO: 227354 - DNA, 471 bp, Homo sapiens
  misc_feature: GYAE6OF02F4PDL.29.62.F07.1.454.CMB.1.raw
  modified_base (433)..(433): a, c, t, g, unknown or other
  misc_feature (433)..(433): n is a, c, g, or t
  modified_base (438)..(439): a, c, t, g, unknown or other
  misc_feature (438)..(439): n is a, c, g, or t
  modified_base (441)..(442): a, c, t, g, unknown or other
  misc_feature (441)..(442): n is a, c, g, or t
  modified_base (444)..(471): a, c, t, g, unknown or other
  misc_feature (444)..(471): n is a, c, g, or t
tcagatagagtactcacgaccggtgctcgatttagtagtcgcataaaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagacgtggggcctgaagatcgcatcagtgtattactgtcatcaatatggttcttcagtttcgctcaccttcgccaagggcacgatggagattaaacgactgtgctgcacatctgtcttcatccttcccgactatctagtacttactactactctggacggccgggtacgtcgggacgaaacggggctacgtaaacgtagntacgnnanncnnnnnnnnnnnnnnnnnnnnnnnnnnnn

SEQ ID NO: 227355 - DNA, 578 bp, Homo sapiens
  misc_feature: GYAE6OF02JV4OP.29.62.F07.1.454.CMB.1.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (546)..(546): a, c, t, g, unknown or other
  misc_feature (546)..(546): n is a, c, g, or t
  modified_base (554)..(556): a, c, t, g, unknown or other
  misc_feature (554)..(556): n is a, c, g, or t
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(576): a, c, t, g, unknown or other
  misc_feature (572)..(576): n is a, c, g, or t
  modified_base (578)..(578): a, c, t, g, unknown or other
  misc_feature (578)..(578): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccgagggccactggcatcccagaccggttcagtggcaggtgggtctgggacaggacttcactctcaccatcagcagacgtgggcctagaagntgacatcagtgttattactntccatactaattgttcggttacttcgtacgtttccactaccgtaccgttcggaccggaaggtaccgacgtactagggaacgtaattaaaccggtaatcggttacgacttcgaccgtactacgttcgttacttcgttactccgttcccttacccgaccttaacgtcgtttaacgtaaccgttctttactacgtttacgtacggacgggttccggacggttcggaccgtaacggccttaacgagtttacgcttagntgnancncntcgacgtacntgagtacnnnctgnncntangnancnnnnntn

SEQ ID NO: 227356 - DNA, 473 bp, Homo sapiens
  misc_feature: GYAE6OF02FP43P.29.62.F07.1.454.CMB.1.raw
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
  modified_base (443)..(473): a, c, t, g, unknown or other
  misc_feature (443)..(473): n is a, c, g, or t
tcagatagagtactcacgaccggtgctcgatttagtagtcgcataaaagggaaaggggccacgttctcctgcaggggccagtcaaagtattagcagcagaaacttagcctggtaccagcaaaaacctggccaggctcccaggctcctcatctttggtgcatctaccagggccactggcatcccagaccggttcagtggcagtgggtctggggacagactttcactctcaccatcagcagacgtggggcctgaagatgcatcagtgtattactgtcatcaattatggtttcttctagtttcgctctaccttcggccaagggacacgactgganaacttaaacgactgtggctgcacatntgtcttcatctttcccgccatcctagaagtacctcgtatcgtgacggtcgggaccgtgggccaacgggccgacgacgtaacgggnnnnnnnnnnnnnnnnnnnnnnnnnnnnnnn

SEQ ID NO: 227357 - DNA, 487 bp, Homo sapiens
  misc_feature: GYAE6OF02F06KJ.29.62.F07.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (461)..(487): a, c, t, g, unknown or other
  misc_feature (461)..(487): n is a, c, g, or t
tcagatagagtactcacgaccggtgctcgatttagtagtcgcataaagggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagacgtggggcctggaagatgcatcagtgtattactgtcatcaatatgttctntagttcnctcacctcgccaaggacacgctggactaagttaaaccgacgtgtacggtntaggccaccatcgtagttctttacacttccgttccccgacctagttacctagtaacgttacttctatcgtaggcgtccgggctacgggagacggtccgtatagtacggntngntgangnnnnnnnnnnnnnnnnnnnnnnnnnnn

SEQ ID NO: 227358 - DNA, 527 bp, Homo sapiens
  misc_feature: GYAE6OF02JI8HW.29.62.F07.1.454.CMB.1.raw
  modified_base (418)..(418): a, c, t, g, unknown or other
  misc_feature (418)..(418): n is a, c, g, or t
  modified_base (488)..(488): a, c, t, g, unknown or other
  misc_feature (488)..(488): n is a, c, g, or t
  modified_base (493)..(494): a, c, t, g, unknown or other
  misc_feature (493)..(494): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (502)..(508): a, c, t, g, unknown or other
  misc_feature (502)..(508): n is a, c, g, or t
  modified_base (510)..(527): a, c, t, g, unknown or other
  misc_feature (510)..(527): n is a, c, g, or t
tcagatagagtactcacgaccggtgctcgatttagtagtcgcataaaaggggaaagggccacgttctcctgcagggccagtcaaagtattagcagcagaaacttagcctggtaccagcaaaaacctggccaggctcccaggctcctcatctttggtgcatctaccagggccactggcatcccagaccggttcagtggcaggtgggtctggggacagtacttcacctctcaccatccagcagacgtgggggcctaggaagatgacagtcagtgtattactgtcatcaattgttgttacttctaggtttccgcttaccacccgttccggaccgaacgggacacggacgtgggaataacgttaaacggactggtaggcttacgacctaacctgtacgtcgttaccttctacttccttcccncacttctagaacttacctctaatcgttggacggtccgggtcgacggacgtaaccggcggtactaatacgntgatnntncgntgnnnnnnnannnnnnnnnnnnnnnnnn

SEQ ID NO: 227359 - DNA, 168 bp, Homo sapiens
  misc_feature: GYAE6OF01ATZ5L.47.53.E09.1.454.CMB.1.raw
  modified_base (167)..(168): a, c, t, g, unknown or other
  misc_feature (167)..(168): n is a, c, g, or t
tcagagctcacgtacacgaccggtgctcgatttagagagagtgtgttggttgggaagaggaagactgacggtcccaggagttcaggtgctgggcacagcggccctgggctgcctggtcaaggactacttcctacgtgagctctgagcgggctggcaaggcgcatagnn

SEQ ID NO: 227360 - DNA, 188 bp, Homo sapiens
  misc_feature: GYAE6OF01AOAOD.47.53.E09.1.454.CMB.1.raw
  modified_base (188)..(188): a, c, t, g, unknown or other
  misc_feature (188)..(188): n is a, c, g, or t
tcagagctcacgtacacgaccggtgctcgatttagagagagtgtgttgggttggagactaatttggtcatatgttgttcggcggagggaccaagctgaccgtcctcggtcagcccaaggctgcccctcggtcactctgttcccaccctcctctacgtgagctctgagcgggctggcaaggcgcatagn

SEQ ID NO: 227361 - DNA, 201 bp, Homo sapiens
  misc_feature: GYAE6OF01B6STM.47.53.E09.1.454.CMB.1.raw
  modified_base (190)..(201): a, c, t, g, unknown or other
  misc_feature (190)..(201): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgccccctcggtcactctgttcccacctcctctacgtgagctctgagcgggctggcaaggcgcatagnnnnnnnnnnnn

SEQ ID NO: 227362 - DNA, 174 bp, Homo sapiens
  misc_feature: GYAE6OF01BRJN2.47.53.E09.1.454.CMB.1.raw
  modified_base (173)..(174): a, c, t, g, unknown or other
  misc_feature (173)..(174): n is a, c, g, or t
tcagagctcacgtacacgaccggtgctcgatttagagagagtgtgttgggtttgggggaagaggaagactgacggtcccccaggagttcaggtgctgggcacagcggccctgggctgcctggtcaaggactacttcctacgtgagctctgagcgggctggcaaggcgcatagnn

SEQ ID NO: 227363 - DNA, 518 bp, Homo sapiens
  misc_feature: GYAE6OF01B2LUT.47.53.E09.1.454.CMB.1.raw
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgacccgtcagcagggtcgacgtcggggatgaggccgtatattttgtcaggtgtgggagactaatttggtctatatgttgttcggcggagggacaagctgaccgtcctcggtcagcccaaggctgcccctcgtcactctgttcccgcctcctcg

SEQ ID NO: 227364 - DNA, 192 bp, Homo sapiens
  misc_feature: GYAE6OF01C9LGH.47.53.E09.1.454.CMB.1.raw
  modified_base (190)..(192): a, c, t, g, unknown or other
  misc_feature (190)..(192): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgccccctcggtcactctgttcccgcctcctctacgtgagctctgagcgggctggcaaggcgcatagnnn

SEQ ID NO: 227365 - DNA, 192 bp, Homo sapiens
  misc_feature: GYAE6OF01CP20L.47.53.E09.1.454.CMB.1.raw
  modified_base (191)..(192): a, c, t, g, unknown or other
  misc_feature (191)..(192): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccgcctcctctacgtgagctctgagcgggctggcaaggcgcatagnn

SEQ ID NO: 227366 - DNA, 527 bp, Homo sapiens
  misc_feature: GYAE6OF01BH0RX.47.53.E09.1.454.CMB.1.raw
  modified_base (519)..(519): a, c, t, g, unknown or other
  misc_feature (519)..(519): n is a, c, g, or t
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgacccgtcagcagggtcgacggtcggggatgaggccgtatattttgcaggtgtgggatactaattttggtctattaatggttgttcgggtcgggaggacaagctgaccgtcctcggtcacgcccaaggcctcgcccctggtcacctctgtcccncctcctcg

SEQ ID NO: 227367 - DNA, 197 bp, Homo sapiens
  misc_feature: GYAE6OF01D3ZM0.47.53.E09.1.454.CMB.1.raw
  modified_base (189)..(197): a, c, t, g, unknown or other
  misc_feature (189)..(197): n is a, c, g, or t
tcagagctcacgtacacgaccggtgctcgatttagagagagtgtgttgggtgtgggagactaatttggtcatatgttgttcggcggagggaccaagctgaccgtcctcggtcagcccaaggctgccccctggtcactctgttcccacctcctctacgtgagctctgagcgggctggcaaggcgcatagnnnnnnnnn

SEQ ID NO: 227368 - DNA, 193 bp, Homo sapiens
  misc_feature: GYAE6OF01DQAPG.47.53.E09.1.454.CMB.1.raw
  modified_base (192)..(193): a, c, t, g, unknown or other
  misc_feature (192)..(193): n is a, c, g, or t
tcagagctcacgtacacgaccggtgctcgatttagagagagtgtgttgggtgtgggagactaattttggtcatatgttgttcggcggagggaccaagctgaccgtcctcggtcagcccaaggctgccccctcggtcactctgttcccaccctcctctacgtgagctctgagcgggctggcaaggcgcatagnn

SEQ ID NO: 227369 - DNA, 227 bp, Homo sapiens
  misc_feature: GYAE6OF01E4VGO.47.53.E09.1.454.CMB.1.raw
  modified_base (175)..(178): a, c, t, g, unknown or other
  misc_feature (175)..(178): n is a, c, g, or t
  modified_base (180)..(227): a, c, t, g, unknown or other
  misc_feature (180)..(227): n is a, c, g, or t
tcagagctcacgtacacgaccggtgctcgatttagagagagtgtggttaggggttgggggaagaggaagactgacggtcccccaggagttcaggtgctgggcacacgcggccctgggctgcctggtcaaggctactcctacgtgagctctgacgcgggctggcaaggcgcatagnnnncnnnnnnnnnnnnnnnnnnnnnnnnnnnnnnnnnnnnnnnnnnnnnnnn

SEQ ID NO: 227370 - DNA, 535 bp, Homo sapiens
  misc_feature: GYAE6OF01A9ZQ2.47.53.E09.1.454.CMB.1.raw
  modified_base (525)..(525): a, c, t, g, unknown or other
  misc_feature (525)..(525): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagtacttaagttttggtctattatggtttgttcgggcggtagggaccaaggctgaccgtcctcggtcagcccaaggctcgccccctcggtccactctgttccccnccctcctccg

SEQ ID NO: 227371 - DNA, 197 bp, Homo sapiens
  misc_feature: GYAE6OF01C3QRB.47.53.E09.1.454.CMB.1.raw
  modified_base (189)..(197): a, c, t, g, unknown or other
  misc_feature (189)..(197): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgccccctggtcactctgttcccacctcctctacgtgagctctgagcgggctggcaaggcgcatagnnnnnnnnn

SEQ ID NO: 227372 - DNA, 192 bp, Homo sapiens
  misc_feature: GYAE6OF01BDIRN.47.53.E09.1.454.CMB.1.raw
  modified_base (192)..(192): a, c, t, g, unknown or other
  misc_feature (192)..(192): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccaccctcctctacgtgagctctgagcgggctggcaaggcgcatagn

SEQ ID NO: 227373 - DNA, 605 bp, Homo sapiens
  misc_feature: GYAE6OF01CGFQG.47.53.E09.1.454.CMB.1.raw
  modified_base (260)..(260): a, c, t, g, unknown or other
  misc_feature (260)..(260): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaanagatgccaggccaggcccctgtgctggtcgtctatgatgatagtgaccggcctcgtgggactcccgagcgattctctggctccaagtcgtgggaacacggccacctgacccgtcagcagggtcgacgtcgggatgaggccgtatagttttgtcgtaggtgtgggagtacgttaagttttggtactagttagttggttgttcgggtcggtagggaccgaaggtcgtacgtaccgttccgtccgggttacgacggtaccccgaagggtcccgtccggacccccccgttcgggtaccgtacccgttcccgttccggtttccccccgtcccccgttccccgttacccgg

SEQ ID NO: 227374 - DNA, 192 bp, Homo sapiens
  misc_feature: GYAE6OF01CCH9V.47.53.E09.1.454.CMB.1.raw
  modified_base (191)..(192): a, c, t, g, unknown or other
  misc_feature (191)..(192): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgccccctcggtcactctgttcccgccctcctctacgtgagctctgagcgggctggcaaggcgcatagnn

SEQ ID NO: 227375 - DNA, 522 bp, Homo sapiens
  misc_feature: GYAE6OF01B1MDA.47.53.E09.1.454.CMB.1.raw
  modified_base (426)..(426): a, c, t, g, unknown or other
  misc_feature (426)..(426): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctggggtccgtcagcccccaggaaaggccctggagtggcttgcactcatttatgggatgatgtgaagtactacagtccatatttcaagaggctcactatcaccaaggacacttaccaaaacagtgtcctgacaatgaccaacgtgaagcctgcggacacggccacatattattgtgcacaccganctataccgccagctagggaaatcgacaactggtcgacccctggggcccagggacccttgccaccgtctcctcacgccctccaccaagggccctacg

SEQ ID NO: 227376 - DNA, 531 bp, Homo sapiens
  misc_feature: GYAE6OF01DLB1C.47.53.E09.1.454.CMB.1.raw
  modified_base (526)..(526): a, c, t, g, unknown or other
  misc_feature (526)..(526): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggagccagtgttggagaaagaagtgtacactggtaccaacagatgccaggccaggcccctgtgctggtcgtctatgatgatagtcgaccggccctgtcgggactccccgagcgattctctggctccaagtcgtaggaacacggccaccgtgaccgtcagcgagggtcgacggtcgggatggaggccgttattacgttttgcgtaggtgtgggagtacttaattttggactattagtgttgtcggcggaggaccaagcgtgaccgtcgcgtcacgccaaggctcgcccctgcactcctctccccncctcc

SEQ ID NO: 227377 - DNA, 175 bp, Homo sapiens
  misc_feature: GYAE6OF01AVR6X.47.53.E09.1.454.CMB.1.raw
  modified_base (173)..(175): a, c, t, g, unknown or other
  misc_feature (173)..(175): n is a, c, g, or t
tcagagctcacgtacacgaccggtgctcgatttagagagagtgtgttgggtttgggggaagaggaagactgacggtcccccaggagttcaggtgctgggcacagcggccctgggctgcctggtcaaggactacttcctacgtgagctctgagcgggctggcaaggcgcatagnnn

SEQ ID NO: 227378 - DNA, 529 bp, Homo sapiens
  misc_feature: GYAE6OF01E4U2X.47.53.E09.1.454.CMB.1.raw
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacggtcggggatgaggccgtatattttgtcaggtgtgggagtactaattttggtctatatgttgttcgggcggagggaccaagctgaccgtctcggtcacgcccaaggctcgccccctcggtccactctnttcccnccctcctccg

SEQ ID NO: 227379 - DNA, 199 bp, Homo sapiens
  misc_feature: GYAE6OF01AB3PM.47.53.E09.1.454.CMB.1.raw
  modified_base (191)..(199): a, c, t, g, unknown or other
  misc_feature (191)..(199): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgccccctcggtcactctgttcccaccctcctctacgtgagctctgagcgggctggcaaggcgcatagnnnnnnnnn

SEQ ID NO: 227380 - DNA, 137 bp, Homo sapiens
  misc_feature: GYAE6OF01B5TE6.47.53.E09.1.454.CMB.1.raw
  modified_base (137)..(137): a, c, t, g, unknown or other
  misc_feature (137)..(137): n is a, c, g, or t
tcagagctcacgtacacgaccggtgctcgatttagagagagtgtgttgggtttgggtgctgggcacagcggccctgggctgcctggtcaaggactacttcctacgtgagctctgagcgggctggcaaggcgcatagn

SEQ ID NO: 227381 - DNA, 193 bp, Homo sapiens
  misc_feature: GYAE6OF01A52A0.47.53.E09.1.454.CMB.1.raw
  modified_base (192)..(193): a, c, t, g, unknown or other
  misc_feature (192)..(193): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccgccctcctctacgtgagctctgagcgggctggcaaggcgcatagnn

SEQ ID NO: 227382 - DNA, 584 bp, Homo sapiens
  misc_feature: GYAE6OF01DE4TA.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgggagccagtgttggagaaagaagtgtacactggtaccaaacagatgccaggccaggcccctgtgctggtcgtctatgatgatagtgaccggccctcgtgggactccccgagcgattctctggctcaagtcgtgggaacacggccaccctgaccgtcagcgagggtcgacggtcggggatggaggtccgtattagtttttgcgtagggttggtagggagtacgtttaagttttggtactaagttattggtttggttacgggtcgggtaagggaccaaggctacggacccgtcgtccggtcacggcccaagggcctccggcccccgttcggtacctaccttctccgttccccacccgttccgtaccg

SEQ ID NO: 227383 - DNA, 623 bp, Homo sapiens
  misc_feature: GYAE6OF01DG7IZ.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtagaaacccacacagaccctcacgctgacctgcagcttctctggattttcactcagtagtactggagaggctggtgggctggggtccgtcacgcccccgaaggaaacggccctgggagtggcttgcactctatttagttgggatgatgtgaagtactacagtccatatttcaagagctcactatcacaagacactacaaaacagtgtactagacaatgaccaacgtgaagcctaggcggaacgaaccggccaactaacttattattgtacgacaaccgtacccgacgacctaactacccgaccaggccgttagggaaactccgaacctaacgttcgggttacccggacccccgttgggggaccctaacgggggtaaacccctttggtacccgacccggttcctaccccgtccgtaaccggtcccctaccccgaacccgaaacggggccccctaacggg

SEQ ID NO: 227384 - DNA, 179 bp, Homo sapiens
  misc_feature: GYAE6OF01DRQEQ.47.53.E09.1.454.CMB.1.raw
  modified_base (173)..(179): a, c, t, g, unknown or other
  misc_feature (173)..(179): n is a, c, g, or t
tcagagctcacgtacacgaccggtgctcgatttagagagagtgtgttgggtttgggggaagaggaagactgacggtcccccaggagttcaggtgctgggcacagcggccctgggctgcctggtcaaggactacttcctacgtgagctctgagcgggctggcaaggcgcatagnnnnnnn

SEQ ID NO: 227385 - DNA, 253 bp, Homo sapiens
  misc_feature: GYAE6OF01ECVCB.47.53.E09.1.454.CMB.1.raw
  modified_base (201)..(203): a, c, t, g, unknown or other
  misc_feature (201)..(203): n is a, c, g, or t
  modified_base (205)..(253): a, c, t, g, unknown or other
  misc_feature (205)..(253): n is a, c, g, or t
tcagagctcacgtacacgaccggtgctcgatttagagagagtgtgttggggtttgggagactaattttggtcatactgttgttcggcggagggaccaacgctgaccgtcctcggtcagccccaaggctgccccctcggtcactcctgttccccgccctcctcgtacgtgagtctctgagcgggctggccaaggcgcatagnnngnnnnnnnnnnnnnnnnnnnnnnnnnnnnnnnnnnnnnnnnnnnnnnnnn

SEQ ID NO: 227386 - DNA, 194 bp, Homo sapiens
  misc_feature: GYAE6OF01BDB8H.47.53.E09.1.454.CMB.1.raw
  modified_base (192)..(194): a, c, t, g, unknown or other
  misc_feature (192)..(194): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccgccctcctctacgtgagctctgagcgggctggcaaggcgcatagnnn

SEQ ID NO: 227387 - DNA, 545 bp, Homo sapiens
  misc_feature: GYAE6OF01C7KP9.47.53.E09.1.454.CMB.1.raw
  modified_base (330)..(330): a, c, t, g, unknown or other
  misc_feature (330)..(330): n is a, c, g, or t
tcagagctcacgtacacgaccggtgctcgatttagagagagtgtgttgggtttggggggtcttgtcccagatcaccttgaaggagtctggtccgacgctggtgaaacccacacagaccctcacgctgacctccagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttaccaaaaaccaagtggtacctgacaatgaccaacgtgaancctgcggacacggccacatattattgtgcacaccgacgctataccgccagctgggaaatcgacactgtcgaccctgggccaggaacctgcacgtctctcacgcctccacaaggcccatcggtcttccccctggccaccctcctccacgacgccacctccgtggggccacgagccggccctgggcctcgccctggtaccaacggccttccgtacgg

SEQ ID NO: 227388 - DNA, 205 bp, Homo sapiens
  misc_feature: GYAE6OF01BOM4K.47.53.E09.1.454.CMB.1.raw
  modified_base (175)..(175): a, c, t, g, unknown or other
  misc_feature (175)..(175): n is a, c, g, or t
  modified_base (177)..(205): a, c, t, g, unknown or other
  misc_feature (177)..(205): n is a, c, g, or t
tcagagctcacgtacacgaccggtgctcgatttagagagagtgtgttgggtttgggggaagaggaagactgacggtcccccaggagttcaggtgctcgggcacagcggccctgggctgcctggtcaaggctacttcctacgtgagctctggagcgggcttggcaaggcgcatagncnnnnnnnnnnnnnnnnnnnnnnnnnnnnn

SEQ ID NO: 227389 - DNA, 595 bp, Homo sapiens
  misc_feature: GYAE6OF01DVN6P.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttaccaaaaaccagtggtcctagacaatgaccaacgtgaagcctgcggacacggccacatattattgtgcacaccgacgctactaccgccagctagggaaatcgaacaactcggttaccgaccccgtggggccacgggaacccttgtccaccgtcctccctcacgccctccacccaacgggcccaagtccggtccttcccccgtcggccctacccctccctacccaacgacgccacccgtcgtcgggggccacgacggccgggcccgtggggccgtcggcccgttgggtaccaagggtccttaaccg

SEQ ID NO: 227390 - DNA, 562 bp, Homo sapiens
  misc_feature: GYAE6OF01CTPCG.47.53.E09.1.454.CMB.1.raw
  modified_base (343)..(343): a, c, t, g, unknown or other
  misc_feature (343)..(343): n is a, c, g, or t
tcagagctcacgtacacgaccggtgctcgatttagagagagtgtgttgggtttgggggtcttgtcccagatcaccttgaaggagtctggtccgacgctggtgaaacccacacagaccctcacgctgacctgcagcttctctggatttttcactcagtagtactggagaggctggtgggctgggtccgtcacgcccccaggaaaggccctggagtggcttgcactcatttattgggatgatgtgaagtactacagtccatatttcaagagctcactatcacaagacacttaccaaaaacagtggtcctgacaatgaccaacgtgaagcctgcggacacggccanatattatgtgcacaccgacgctataccgcagctagggaaatcgacaactggtccgacccgtggggaccacgggtaacccttgtccaccgtctcctcacgcctccaccaacggcccactccgtccttccccgtcggcccaccctcctccaacgacgccaccgtcgtcgggggccacgacggccggcccgtgggctcggcgtcggtcaacggtccttaccg

SEQ ID NO: 227391 - DNA, 714 bp, Homo sapiens
  misc_feature: GYAE6OF01C8JB3.47.53.E09.1.454.CMB.1.raw
  modified_base (224)..(224): a, c, t, g, unknown or other
  misc_feature (224)..(224): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaggattactgtgcgganccagtgttggagaaagagtgtacactaggtaccaaacagatgaccaggccacggcccctgtgcgttggtcgtctatgatgataggtcgacccggcctcgtggactccccggagccgtatttctcgtggcctccgaagtcgtacgggaaccacggcccacccgtgacccgtcacggccgagggtccgacggtcggggagtgggacggtaccgttagtttaacgtttttggaccgtagggttggtagggtagtaacgtttaagtttttcggtacttagtttagtttggtttcgggtttaccggggtacgggaacggggtaacctaaacgggtccgttaccggtaccccgggttcccgtacccggggttaccgaaccgggtacccccgtaagggtcccccgttcccgggtaccccccccgttacgggttaccccaacccggtttccccttacccggttttaccccccctacccccgttccccgtttaccccgg

SEQ ID NO: 227392 - DNA, 617 bp, Homo sapiens
  misc_feature: GYAE6OF01EIM6R.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccgcctcgtgggactcccgagcgattctctggctcaagtctggaacacggccacccgtgaccgtcagcgagggtcgacgtcggggatggacggcgtattattttgcgtagggttggtgggtagtacgtttaagttttgggtactaattagttggtttggtttcggggacgggtaacgggacctaaggtccttacggacccgtttcccgtcgggtacccacggtaccccgaaagggtcccgttacccggcccccccgttcgggttacccacccgttcccgtcccggtttccccccgtccctttcccccg

SEQ ID NO: 227393 - DNA, 541 bp, Homo sapiens
  misc_feature: GYAE6OF01BF18I.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacggtcggggatggaggccgtatattttggtcagggttgtgggtagacttaagttttggtctatattgttgttcgggcggagggaccaagctgaccgtcgtcggtcacgcccaaggctcgcccccgtcggtccacttctcgttcccctcccgtcctccg

SEQ ID NO: 227394 - DNA, 696 bp, Homo sapiens
  misc_feature: GYAE6OF01CD8BD.47.53.E09.1.454.CMB.1.raw
tcagagctcacgtacacgaccggtgctcgatttagagagagtgtgttgggtttggggctgggccgtaaggaagcagcactggtggtgcctcagccatggcctggaccgttctcctcctcggcctcctctctcactgcacaggcgtctgtgacgtccgtacgagctgatttcaggcaccctcgatgtcagtgcccaggacagacggccaggattactgtgcggagccagtgttggagaaagagtgtacactggtaccaacagatgccaggccaggcccctgtgcgtggtcgtctatgagttcgataggtcgacccggccctcgtcggggactccccggaggcggtacttctcgtggcctaccgaagtccgtaggggaacacggtaccaacccgtgacccgtacgagccgtacgggacgacgggtccggggatcggacggtaccgttaagttacgtttttaggaccgtaagggttggtagggaacgtaacttaagttttgggacctagttacgttggtttacggttacgggacgggtaacgggtaacccgtaaggaccgttacggtaacccggttaccgtaccgggttaccgaccggtaccccgtaaacgggtcccttacccgggtccccccgttccgggtaccctaacccgttcccttaccccggtttaccccccaccccgttccccgttaccccgg

SEQ ID NO: 227395 - DNA, 653 bp, Homo sapiens
  misc_feature: GYAE6OF01BSVH5.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggccccctgtgctggtcgtctatgatgatagtgaccggccctcgtgggactccccgagcgattctctggctccgaagtcgtagggaaccacggccaccctgacccgtcagcgaggggtcgacggtcggggatggacggtccgttattagtttttgtcgtagggttcggtaggggtagtaacgttaagtttttggctagttagttggtttaggttccggggtacgggtacggggacctaaggtccgtacggtaccccggttccgttccgggtaccgaaccgggcccccgtaaagggtcccgttcccgggccccccccgttacgggtcccctacccgttcccgttacccggtttcccccctacccccgttcccgttaccccgg

SEQ ID NO: 227396 - DNA, 555 bp, Homo sapiens
  misc_feature: GYAE6OF01D5RCE.47.53.E09.1.454.CMB.1.raw
  modified_base (547)..(547): a, c, t, g, unknown or other
  misc_feature (547)..(547): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggagaaagaagtgtacactggtaccaacagatgccaggccaggcccctgtgctggtcgtctatgatgatagtgaccggccctcgtgggactccccgagcgattctctggctccaagtcgtagggaacacggcccaccctgaccgtcagcgagggtcgacggtcggggatggaggccgtattagtttttcgcgtaggttggtgggagtacgttaattttgggtctattagttgttggttcgggtcgggtacgggaccagcgtcgaccgtccgtcggtcacgcccaggctccgcccctcgtcctctctcgtccccncctcctcg

SEQ ID NO: 227397 - DNA, 556 bp, Homo sapiens
  misc_feature: GYAE6OF01BB8WV.47.53.E09.1.454.CMB.1.raw
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctggggtccgtcagcccccaggaaaggccctggagtggcttgcactcatttatgggatgatgtgaagtactacagtccatatttcaagagctcactatcacaagacactaccaaaacagtgtcctagacaatgaccaacgtgaacgctgcggacacggcanatattatgtncacacgacgctactaccgcagctagggaaactcgaactaacgtcggttaccgaccccgtggggacccacggggtaaccccttggacccgtacccgtccttccctacgacgtcccctacccaacccgaacgggcccctaaccgg

SEQ ID NO: 227398 - DNA, 538 bp, Homo sapiens
  misc_feature: GYAE6OF01ARP6A.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggagaaagagtgtacactggtaccaacagatgccaggccaggcccctgtgctggtcgtctatgatgatagcgaccggccctcgagggatccctgagcgcttctctggctccaattcgtggaacacggccacctgaccatcagcgcggtcgaacgcggagatggaggccgactattactgtcaggtgtggactagtaatagtgactcccgagcgtagggtttcggcggtgggaccgtaagcgtaggaccgtcccgtcggtccacgtacccgaacggtcctcgacccccgtcggtccgccgttcccg

SEQ ID NO: 227399 - DNA, 579 bp, Homo sapiens
  misc_feature: GYAE6OF01AUZTP.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggcccccaggacagacggccaggattacttgtgcgggagccagtgttggagaaagaagtgtacactggtaccaacagatgccaggccaggcccctgtgctggtcgtctatgatgatagtgaccggccctcgtgggactccccgagcgattctctggctccaagtctgggaacacggcccaccgtgacccgtcagcgagggtcgacggtcgggatggaggccgtattagtttttgcgtaggtgtgggagtacttaagttttggtctagttagttgttggttcgggtcggagggaccaaggctacgaccgtccgtcggtcgacgcccgaaggccgtcggccccccgtcggttcctaccgttcgttccgttccccctaccccgttcccgttacccg

SEQ ID NO: 227400 - DNA, 194 bp, Homo sapiens
  misc_feature: GYAE6OF01B63DS.47.53.E09.1.454.CMB.1.raw
  modified_base (192)..(193): a, c, t, g, unknown or other
  misc_feature (192)..(193): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccgccctcctctacgtgagctctgagcgggctggcaaggcgcatagnng

SEQ ID NO: 227401 - DNA, 542 bp, Homo sapiens
  misc_feature: GYAE6OF01E3O2T.47.53.E09.1.454.CMB.1.raw
  modified_base (533)..(533): a, c, t, g, unknown or other
  misc_feature (533)..(533): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcacctccccgatgtcagtggccccaggacagacggccaggattacttgtgcgggagccagtgttggagaaagagtgtacactggtaccaacagatgccaggccaggcccctgtgctggtcgtctatgatgatagtgaccggccctcgtgggactccccgagcgattctctggctccagtctgggaacacggccaccctgaccgtcagcgagggtcgacggtcgggatgaggcgtatattttgcgtaggtgtgggagtacgttaattttggtactatagttgttgttcgggcggtagggaccaaggtctggacccgtccgtcggtcaggcccaaggcctcgcccctggtccactctcgtccccncctcctccg

SEQ ID NO: 227402 - DNA, 586 bp, Homo sapiens
  misc_feature: GYAE6OF01BX3QF.47.53.E09.1.454.CMB.1.raw
  modified_base (225)..(225): a, c, t, g, unknown or other
  misc_feature (225)..(225): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgganccagtgttggagaaagagtgacactggtaccaacagatgccaggccaggcccctgtgctggtcgtctatgatgatagtcgaccggccctcgtcgggactcccggagccgtattctcgtggctccaagtctgggaaccacggccacctgaccgtcagcgacgggtcgacggtcggggatggacggtccgtatttagtttttgtacgtacgggttggtggggaatacgtttaagttttggtactagttagttggttgttcgggacggtagggacctaaggctcggtaccgtccgtcggtcgacgtacccgaaggtcctccgtcccccgtcgtccacttccgtccgttccccgccccttacccg

SEQ ID NO: 227403 - DNA, 570 bp, Homo sapiens
  misc_feature: GYAE6OF01BUMY3.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggccccctgtgctggtcgtctatgatgatagtgaccggccctctgggatccccgagcgattctctggctccaagtctgggaacacggcccaccctgaccgtcagcagggtcgacggtcggggatggaggccgtatagttttgtcaggtgtgggagtacttaattttggtctagttatgttggttcgggcgggtagggaccaaggctcggaccggttcctcggtccacggccccgaagggcctccggccccccttcggtccctaccttcctccgtttcccccaccccgttccctacccg

SEQ ID NO: 227404 - DNA, 528 bp, Homo sapiens
  misc_feature: GYAE6OF01BOD6U.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttatgggatgatgtgaagtactacagtccatatttcaagaggctcactatcacaagacacttacaaaacagtgtctgacaatgaccaacgtgaagcctgcgacacggccacatattattgtgcacaccgacgctaactaccgccagcgtagggaaatcgaacaacgtggtccgacccgtggggacccagggaacccttgccaccgtcctccctcacgccctaccaccaagggccctacg

SEQ ID NO: 227405 - DNA, 677 bp, Homo sapiens
  misc_feature: GYAE6OF01BN4U4.47.53.E09.1.454.CMB.1.raw
  modified_base (361)..(361): a, c, t, g, unknown or other
  misc_feature (361)..(361): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggccctcgtgggactccccggagccgtattctctggctccgaagtctgggaacncggccaccctgaccgtcagcgagggtcgacggtcggggatggaggccgttattatttttgtcgtagggttggtgggagtacttaagttttgggtctaagttagttggtttacggtttcggggtaccggggtaaggggtaaccccgtaaagggtcccgttacgggtaaccccggttcccgttccggggttacccgaaccgggtacccccggtaaaggggtcccgttcccggtccccccccgtttccggggttacccgtaacccgttcccgtttacccggttttcccccccggtcccccgttcccccgtttaccccgg

SEQ ID NO: 227406 - DNA, 621 bp, Homo sapiens
  misc_feature: GYAE6OF01CV9AF.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctgggtccgtcagccccaggaaggccctggagtggcttgcactcatttattgggatgatgtgaagtactacagtccatattcaagagctcactatcacaagacaactaccaaaactagtcgtactagacaatcgaccaacgtgaacgccgtagaccgggacaccgggaccaacgtaattacttaagttcggtacgacctaacgaacccgaacgcctaactacccgacctagaccgttaggggaaaactccggaacaaccgttcgggttacccgaacccccgttcgggggacccgtacggggtaaacccccgttgggtacccgaggtcccgtcctcccgtaccgaccgtcccctaccgaaccccgtaacggggtcccccg

SEQ ID NO: 227407 - DNA, 573 bp, Homo sapiens
  misc_feature: GYAE6OF01EGZQN.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggatttttcactcagtagtactggagaggctgtgggctgggtccgtcagcccccaggaaaggccctggagtggcttgcactcatttatgggatgatgtgaagtactacagtccatatttcaagaggctcactatcaccaaggacacttaccaaaaaccaagtgtcctgacaatgacaaacgtgaagcctgcggacacggccacatattattgtgcacaccgacgctatacccgcagctaggaatcgacaactggtccgacccgtggggccacgggacccttgccaccgtctcctcacgccctccaccgacgggcccagtccggtcccttcccccgtcggcccacccctcctacccaacgcgccacctcgtcggggccacgacggcccggaccccgtgggcctcggcccgtgggtaccaaggtccttacccg

SEQ ID NO: 227408 - DNA, 585 bp, Homo sapiens
  misc_feature: GYAE6OF01EN6L3.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggcctcgtgggactccccgagcgattctctggctccagtctgggaacacggccaccctgaccgtcacgcgagggtcgacggtcggggatggaggccgtattagttttgtcgtagggttggtgggagtacgttaagttttggtctagttagttggtttggtttgggtcgggtagggaccgaagcgtcggacccgttccgtccggtcacggtcccgaaggccgtcggccccccgtcggtcctaccgtccttacggttcccccgtcccttcccgttaccgg

SEQ ID NO: 227409 - DNA, 528 bp, Homo sapiens
  misc_feature: GYAE6OF01EGHCN.47.53.E09.1.454.CMB.1.raw
  modified_base (359)..(359): a, c, t, g, unknown or other
  misc_feature (359)..(359): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacncggccaccctgaccgtcagcagggtcgacgtcgggatgagccgtatattttgtcaggtgtgggagacttaatttggtacattatgttgttcggtcggagggaccagctgaccgtccgtcggtcgacgcccaaggctacgcccctcggtcactctcgttcccgccctccc

SEQ ID NO: 227410 - DNA, 666 bp, Homo sapiens
  misc_feature: GYAE6OF01EN118.47.53.E09.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
  modified_base (369)..(369): a, c, t, g, unknown or other
  misc_feature (369)..(369): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgngcgggagcagtgttgagaaagagtgtacactggtaccaacagatgccaggccaggcccctggngcgtggtcgtctatgatgatagtcgaccggcctgtagggactcccgagccgtattctcgtggcctacgtaaaggtccgtaggggaaccnccgggtacccaaccccgtggaacccgttcaggccgtaacgggtcggacgggtcggggagttgggacggtccgttaagtttagtttttaggcgtagggtggtgggtaagtacgtttaagttttggtctagttagttggtttcggtacgggtacgggaacgggtacctaacggcgtaccggtacccggttcccgttacgggtaccgtacggaccccggtaaggtcccgtcccggtccccccgtacgggtccctacccgttccgttacccgttccccctaccccgttccccgttacccgg

SEQ ID NO: 227411 - DNA, 180 bp, Homo sapiens
  misc_feature: GYAE6OF01AX43A.47.53.E09.1.454.CMB.1.raw
  modified_base (173)..(180): a, c, t, g, unknown or other
  misc_feature (173)..(180): n is a, c, g, or t
tcagagctcacgtacacgaccggtgctcgatttagagagagtgtgttgggtttgggggaagaggaagactgacggtcccccaggagttcaggtgctgggcacagcggccctgggctgcctggtcaaggactacttcctacgtgagctctgagcgggctggcaaggcgcatagnnnnnnnn

SEQ ID NO: 227412 - DNA, 618 bp, Homo sapiens
  misc_feature: GYAE6OF01CVW38.47.53.E09.1.454.CMB.1.raw
  modified_base (348)..(348): a, c, t, g, unknown or other
  misc_feature (348)..(348): n is a, c, g, or t
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctgtgggctggggtccgtcagcccccaggaaaggccctggagtggcttgcactcatttattgggatgatgtgaagtactacagtccatatttcaagagctcactatcacaagacacttaccaaaaaccagtggtcctagacaatcgaaccaacgtgaacgcctgacggacacggccanatattatgtgcacaccgacgctatacccgcagctagggaaatcgaacaacgtcggttaccgaccccgtggggacccacgggtaacccttgtccaccgtcctccctcacgtccctccaaccgaacgggcccacgtccggttcccttcccccgtggaccctacccctcctaccaacggaccgcctacccgtcggtccgggggccaccggacgggcccggtccccgtggggccttcgggacccgttcgggtaccaaacgggtcctttaaccgg

SEQ ID NO: 227413 - DNA, 577 bp, Homo sapiens
  misc_feature: GYAE6OF01D3R8F.47.53.E09.1.454.CMB.1.raw
  modified_base (316)..(316): a, c, t, g, unknown or other
  misc_feature (316)..(316): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtcgaccggccctntgggactccccgagcgattctctggctccaagtctgggaacacggcccaccctgaccgtcagcgagggtcgacggtcggggatgggaggtccgtaattattttggtcgtagggttggtgggagtacttaagttttggtactagttagtggtttggttcgggcgggtagggaccgaaggcgtacgacccgttccgtcggtcacggcccgaaggcctcgcccccgtcggtcctacttccgtacgttccccgccctccgtcccg

SEQ ID NO: 227414 - DNA, 636 bp, Homo sapiens
  misc_feature: GYAE6OF01DGYGT.47.53.E09.1.454.CMB.1.raw
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctntgggactccccgagcgattcnctggctccaagtctgggaacncggccacccgtgaccgtcagcagggtcgacggtcggggatggaggtccgtatagttttgctagggtgtgggtagtacgttaagttttggtactaagttagtggtttcggttcgggtacgggtaacgggtaaccgaaggtccgtacggtaacccgttcccgtaccgggttaccgaaccggtccccgaaagggtcccgttcccgggcccccccgttacggggttccctaacccgtttcccgttacccggtttcccccccgtccccgttccccgtttacccgg

SEQ ID NO: 227415 - DNA, 657 bp, Homo sapiens
  misc_feature: GYAE6OF01D2KS3.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggaagaaagagtgtacactggtaccaacagatgccaggccaggcccctgtgctggtcgtctatgatgatagtcgaccggccctcgtgggactccccgagccgattctcgtggcctaccaagtcgtagggaacaccggcccacccgtcgacccgtcacgcgacgggtcggacggtcggggagtcggaggtccgttagttagtttttgtcgtagggttggtagggtagtaacgttaagttttgggtactaagttagttggtttgggtttaccgggtacgggtacggggtaaccgtaacggtaccgtacggtacccggttcccggttccggttacccggaccggtacccgaacgggtcccgttcccggtcccccgttcccggtccctacccgttcccttcccgttcccccgtaaccccttccccg

SEQ ID NO: 227416 - DNA, 538 bp, Homo sapiens
  misc_feature: GYAE6OF01E1JD1.47.53.E09.1.454.CMB.1.raw
  modified_base (428)..(428): a, c, t, g, unknown or other
  misc_feature (428)..(428): n is a, c, g, or t
  modified_base (490)..(490): a, c, t, g, unknown or other
  misc_feature (490)..(490): n is a, c, g, or t
  modified_base (531)..(531): a, c, t, g, unknown or other
  misc_feature (531)..(531): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggagccagtgtggagaaagaagtgtacactggtaccaacagatgccaggccaggcccctgtgctggtcgtctatgatgatagtgaccggccctgtggactccccgagcgattctctggctccaagtctggaacacggccaccctgacccgtcagcgagggtcgacgtcggggatggacggccgtattattttgctaggtgtggganacttaagtttggtctattatgtttgttcggcgggagggaccaagctgaccgtccgtcggtcncgcccaaggcctcgccccctcggtccacctctcgttccccnccctccc

SEQ ID NO: 227417 - DNA, 522 bp, Homo sapiens
  misc_feature: GYAE6OF01ETPTB.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctggggtccgtcagcccccaggaaaggccctggagtggcttgcactcatttatgggatgatgtgaagtactacagtccatatttcaagaggctcactatcaccaaggacacttaccaaaaaccaagtggtcctgacaaatgaaccaacgtgaagcctgcggacacggccacatattattgtgcacaccgacgctataccgccagctagggaatcgacacgtggtcgaccctgggccagggacccttgcaccgtctcctcacgcctaccaccaggccctacg

SEQ ID NO: 227418 - DNA, 609 bp, Homo sapiens
  misc_feature: GYAE6OF01AK5AX.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggcctctgggactccccgagcgattctctggctccaagtctggaacacggccaccctgaccgtcagcagggtcgacgtcgggatggaggcgtattattttgctaggtgtgggagtacgttaattttgggtactagttagttggtttcggtttcgggcgggtacgggaccgaaggccgttacggacccgtttcccgtaccgggttccgacggtacccccgaaagggtcccgttaccggtccccccccgttacgggtccctacccgttcccgttccggtttccccccgccccgtttccccg

SEQ ID NO: 227419 - DNA, 655 bp, Homo sapiens
  misc_feature: GYAE6OF01DQNU0.47.53.E09.1.454.CMB.1.raw
  modified_base (224)..(224): a, c, t, g, unknown or other
  misc_feature (224)..(224): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggganccagtgttggagaaagaagtgtacatggtaccaacagatgccaggccaggccccctgtgctggtcgtctatgatgatagtgaccggccctcgtgggactccccgagcgattctcgtggctccaagtcgtagggaacaccggcccacccgtgaccgtcacgcgacgggtcgacggtcggggatggaggtccgtagttattttgcgtagggttggtgggagtacgtttaagttttggtactattaagttggtttagggttcgggcgggtaacgggtacccaaggtcgttacgggaacccgttcccgtaccgggtaccgaccggtaccccgtaaacgggtcccgttcccgggtaccccccccgttcgggttaccccttaaccgttcccgtttcccggtttacccccctaacccccgtttccccgtttaccccgg

SEQ ID NO: 227420 - DNA, 622 bp, Homo sapiens
  misc_feature: GYAE6OF01DMJCQ.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagaatgccaggccaggcccctgtgcgtggtcgtctatgatgatagtggaccggccctcgtgggactccccggagcgattcctcgtcggtctaccgtaagtcgtagggaaccaccggcccaccctcgacccgtcacgcgagggtccgacgggtcggggatggacggtccgtaattattttgtcgtagggttggtagggagtacgtttaagttttggtactagttagttggttggttcggggtacgggtacgggaccgaaggccgtaggtaccccgtcgtccggtccgacggtcccgaagggccgtccgtccccccgttcggtccctaccttccgttccgttcccccgcccgttcccgttcccg

SEQ ID NO: 227421 - DNA, 639 bp, Homo sapiens
  misc_feature: GYAE6OF01A3DYM.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtcgacccggtccctcgtgggactccccggagcgtattccgtcgtcggcctccgaagtcgtagggaaccaccggcccacccgtcggacccgtcacggccgaggggtcgacggtcggggatgggacggtccgtattagtttttgcgtagggttggtagggtagtaacgtttaagttttggtacctagttagttggtttcggttcggggtacgggtagggtaccaaggcgttacggacccgttcgtccggtaccgacggccccgtaagggccctcccggccccccgttgggtaccctaccgttcccgttccggtttccccccgtcccgttcccgttcccg

SEQ ID NO: 227422 - DNA, 706 bp, Homo sapiens
  misc_feature: GYAE6OF01CIP6F.47.53.E09.1.454.CMB.1.raw
  modified_base (320)..(320): a, c, t, g, unknown or other
  misc_feature (320)..(320): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgaccgtccgacgagctgattcaggcaccctcgatgtcagtcggccccaggacagacggccaggattacttgtgcgggagccagtgtggagaaagagtgtacatggtaaccaacagatgccaggccacggcccctgtgcgtggtcgtctatgatgatagtgacccggtccctgnggactccccgagcgacttctcgtggcctccgtaagtccgtacggggaactacccgggcccaaccccgttcggacccgttcgacggtaccgacggggtaccggacgggtcgggggtacgtggacgggtaccgttaagttacgtttttggtacgtagggtggttcgggtaagtaaccgtttaaagttttcgggttactaagttagtttaggtttcgggtttaccggggtacgggtacggggtaaccgtaacggtacgtacggtacccgttcccgtccgggtacgtaaccggtcccgtaaacgggtccgttcccggtaccccccgttcgggttacccctaccgttacccgttccggttaccccccgtccccgtttcccgttaaccccgg

SEQ ID NO: 227423 - DNA, 631 bp, Homo sapiens
  misc_feature: GYAE6OF01CC4Y4.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggagaaagagtgtacactggtaccaacagatgccaggccaggcccctgtgctggtcgtctatgatgatagtcgaccggccctcgtgggactccccgagcgattctctggctccaagtcgtagggaacacggccacccgtgaccgtcagcgacgggtcgacggtcggggatggaggccgtattagttttgtcgtaggttggtagggagtacgttaagttttggtactaagttagttgtttggttcgggtcgggtacgggtaaccgaaggtctacgggtacccgttccgtaccgggttcgacggaccccgtaacgggcccgttccggcccccccgttaccggttcccgtaacccgttcccgttacggtttcccccccgtccccgttccccgttaccccgg

SEQ ID NO: 227424 - DNA, 678 bp, Homo sapiens
  misc_feature: GYAE6OF01EH54H.47.53.E09.1.454.CMB.1.raw
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacatggtaccaacagatgccaggccaggcccctgtgcgtggtcgtctatgatgatagtcgaccggcctcgtggactcccgagacgcgtattcctcgtacggcctaccgaaaggttccgtacggggaacctaccgggaccctaaccccgtcgacccgtcgacggcgacgggtacgacgggtacggggataggacggtaccgttagtttacgtttttgtcgtagggttggtagggtagtaacgtttaagttttaggtactagttaacgttggtttacgggttcgggacgggtaacgggaacccgtaaggtccgtacggtaccccggttcccgttaccgggtaccgtaccggacccgtaaacgggcccttacccggtcccccccgttcggtcccgtaccgttcccgttccgtttccccccgaccccgtttacccccg

SEQ ID NO: 227425 - DNA, 713 bp, Homo sapiens
  misc_feature: GYAE6OF01C4EXG.47.53.E09.1.454.CMB.1.raw
tcagagctcacgtacacgaccggtgctcgatttagagagagtgtgttgggtttggggagtctgggcctaaggaagcagcactggtggtgcctcagccatggcccttggaccgttctcctcctcggcctcctctctcactgcacaggctctgtgacgtccgacgagctgattcaggcaccctcgatgtcagtcggccccaggacaggacggccgaggattacttggtagcgggagccagtgttaggaagaaagagtgtacacgtggtaccaacagatcgaccaggccacggtcccctgtcgcgtggtcgtctagtgagtaggatggtcggacccggtccctcgtcgggactccccggagacgtacttcgtcgtcggcctaccgtaacggtcgtacgggaaccaccggtcccgacccgtacgacccgtcacggcgtacgggtccggacgggtacggggatagggacggtaccgttagtttagttttcgtacggtagggttaggtagggtagtaactttaaggttttacggacttagttagtttggttacgggttaccgggacgggtacggtaaccgtaggttccgtacggtaccccggtccggttaccggaccgtaaccgggaccccctaagggtccccgttcccgggtccccccgttcggtacccgtttacccgttacccgtttcccttacccccccgtacccgtttacccccg

SEQ ID NO: 227426 - DNA, 818 bp, Homo sapiens
  misc_feature: GYAE6OF01C6ISV.47.53.E09.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgggancagtgtggagaaagagtgtacactggtaccaanagatgccaggccaggccctgtgcgtggtcgtctatgatgataggtcgacccggccctgtcgggactccccggagcgtacttccgtcgtcgggaccctaccgaaaggtccgtaaggggaaaccaccggggacccctaaccccgtggaaccccgttcgaacggtccggtaacgggggttccggaaccggggttaccggggggaacgttacggggtaaccggggtacccgtttaagttttaacggtttttttacgggtaccgttaggggtttagggttaggggtaacgttaaccgttttaaaggtttttcgggtaacctttaagtttacggtttacgggtttttcgggttaccggggtacgggggtaacggggaacccgttaaagggtcccgttaccgggtaaccccgtttcccggttacccgggttaccgaacccgggtaacccccggtaaacgggttccccggttaccccggtcccccccccggttacgggttaccccgtaaccccgtttccccgttacccggttttaccccccccgtaacccccgttccccgtttaacccgg

SEQ ID NO: 227427 - DNA, 549 bp, Homo sapiens
  misc_feature: GYAE6OF01BAI1I.47.53.E09.1.454.CMB.1.raw
  modified_base (539)..(539): a, c, t, g, unknown or other
  misc_feature (539)..(539): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggccctcgtgggactccccgagcgattctctgctccaagtcgtgggaacacggccaccctgacccgtcagcgagggtcgacggtcggggatggaacggccgttattatttttggtctagggtggtgggagtacgtttagttttggtctattagtggtttgtcgggtggacgggacagctgaccgtcctcggtcacgcccgaaggcctcgccccgtggtccactctgtccccnccgtccctcg

SEQ ID NO: 227428 - DNA, 704 bp, Homo sapiens
  misc_feature: GYAE6OF01DZD42.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacaggacggccaggtattacttgtggcgggagccgagtgttggagaaagagtgtacactggtaccaacagatgccgacggccacggcccctggtcgcgttggtcgtctatgtatgataggtcgacccggtcctcgtcgggacctccccggagccgtattccgtcgtcggtcctacccgaaggttccgtacgggaaccaccgggcccacccgtcggacccgtcgacggccgacgggtccggtacgggtacggggtagtcgggacggtaccgttagtttacgttttgtacgtgggttggtagggtagttaacgtttagtttacggtacttagttacgttggtttcgggttccgggtacgggtaacgggaccgtaacggtccgttacggtacccggttcccgtccgggtacccgaccggtacccggtaacggcccgtccccggtcccccgttcccggtaccctacccgtttcccgttacccgttcccccctccccgttccccgttacccgg

SEQ ID NO: 227429 - DNA, 596 bp, Homo sapiens
  misc_feature: GYAE6OF01DLKD7.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggccctcgtgggactccccgagcgattctctggctccgaagtcgtgggaacacggcccaccctgaccgtcagcgagggtcgacggtcggggatggaggtccgtaagttatttttgcgtaggttggtgggagtacgttaagttttggtactagttagttgtttggttcgggtcgggacgggacaaggtctcggacccggttcccgtcgggtccacggaccccgaaggccttcccgccccccgttcggtccctaccttcgtcccgtttcccccgccccgttccgttacccg

SEQ ID NO: 227430 - DNA, 604 bp, Homo sapiens
  misc_feature: GYAE6OF01C1798.47.53.E09.1.454.CMB.1.raw
  modified_base (326)..(326): a, c, t, g, unknown or other
  misc_feature (326)..(326): n is a, c, g, or t
  modified_base (349)..(349): a, c, t, g, unknown or other
  misc_feature (349)..(349): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtcgaaacccacacagaccctcacgctgacctgcagcttctctggtattttcactcagtagtactggagaggctggtgggcgtggggtccgtcgacgcccccgaaggaaacggccctgggagtggcttgcactctatttagtgggatgatgtgaagtactanagtcatattcaagagctcactanacaccaagacaacgttaccaaaacagtcgtactgaactaatacgaaccaacgtagaacgccgtaggaccggacaccggaccaactaattagttattcgtcgaccacaacccgagacctacgtacccgacagtcgtagggaaactccgaactacgtcggtaccgacccggtcgggacccgacggggtaaacccttggtacccacccggttctcccgtcgaccgtcccctacccgaaccgaacgggtcccctaacgg

SEQ ID NO: 227431 - DNA, 674 bp, Homo sapiens
  misc_feature: GYAE6OF01A5CFF.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctggggtccgtcagcccccaggaacggccctggagtggcttgcactcatttagttgggatgatgtgaagtactacagtccattatttacaagaggtctcactatcacaagacaacttaccaaaaccagtcgtactagacaatagaaccaacgtacgaacgtccgtaggcggaacacggaccaacgtaattaagtttacttggacgtaccaaccgaacccgacgtaccttaacgtaccccggaccaggtaccgtacggggaaacttaccggaacgtaaccgttcgggttacccgtaccccgggttacgggggacccggtaaaccgggggtaacccctttgggtaccccgtaccccggttacccgttacccgtacccgtaaccggtacccccgttacccgaaaccccggtaaaccgggggcccccttaaccggg

SEQ ID NO: 227432 - DNA, 672 bp, Homo sapiens
  misc_feature: GYAE6OF01A4FZ4.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgataggtcgacccggccctcgtcgggactcccccgaggccgtattctcgtggcctaccgaagtccgtacgggaaccaccgggccctacccgtacgacccgtcgacgaccgacgggtcggacgggtcggggatgggacggtccgttaattagtttttgacgtagggttggtagggtagttaacgttaagttttggtactagttacgttggttggttcgggtacgggtacgggaaccgtaaggtccgtaacggcccggttccgtacgggtaccgtacggaccccgtaagggtcccgtcccggtccccccggttacggtaccccgtaccgtttcccgttacccgggtttccccccgtcccccttccgtttaccccggg

SEQ ID NO: 227433 - DNA, 655 bp, Homo sapiens
  misc_feature: GYAE6OF01EIZI6.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggtattacttgtggcgggagccagtgtaggagaaagagtgtacacgtggtaccaacagatcgccaggccacggcccctggtgcgtggtcgtctatgatgatagtcgaccggccctgtgggactcccgagcgtacttctcgtcggcctaccaaggtcgtacggggaaccacccggccctacccgtcgacccgtcacggacgagggtccgacgggtcggggatcggacggtccgttattacgttttgtcgtagggtggtagggtagtacgtttaagttttggtactaagttagttggtttacgggttcgggacggggtaaggaccgaacggtcgtcgggtaacccgttccgtacgggtaccgaccggtaccccgaacgggtcccgtcccggtccccccggttcggtccctacccgttcccttcccggttcccccaccccgttccccg

SEQ ID NO: 227434 - DNA, 668 bp, Homo sapiens
  misc_feature: GYAE6OF01CPHQO.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctggtgggcgtggggtccgtcacggcccccaaggaaacggccctggagtggcttgcactcatttatgggatgatgtgaagtactacagtccatattcaagagctcactatcacaagacaacttaccaaaaacagtcggtacctagaacaatacgaccaacgtgaacgcccgtagacggaaccacggaccaacgtaattatttagttagtacggaccaaccgaacccggacgtaccttaacgtaaccccgaccgaacggtaccgtaaggggtaaaacttaccggaaccgtaaaccgttcggggttaccccggaaacccccggttgggggaccccgtaacggggtaaaccccctttggtaccccgtacccggttccctcccgttacctaccgtacccctaccccgaacccgaaaccggggtccccctaaaccggg

SEQ ID NO: 227435 - DNA, 191 bp, Homo sapiens
  misc_feature: GYAE6OF01CN3F7.47.53.E09.1.454.CMB.1.raw
  modified_base (191)..(191): a, c, t, g, unknown or other
  misc_feature (191)..(191): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgccccctcggtcactctgttcccgccctcctctacgtgagctctgagcgggctggcaaggcgcatagn

SEQ ID NO: 227436 - DNA, 634 bp, Homo sapiens
  misc_feature: GYAE6OF01A6VT2.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctggtgggctgggtccgtcacgcccccaggaacggccctggagtggcttgcactctatttagtgggatgatgtagaagtactacagtccattatttacaagagctcactatcaacaagacacttaccaaaacagtcgtcctagaacaatcgaaccaacgtgaacgccgtgaccggaacacggaccaactattaattattcgtgaccacaccgacgtctactaccgcagcgtagggaatcgaactacgtcggtccgacccgtggggacccaacggtaccctgaccaccgtctccgtacacgccctaccgacgaccggcccacgtcccgttccctccccgtcggtaccctacccctacctaccgaacgtccgtaccctacccggtcgggtacggggaccaccggacggcccggtacccgtcgggccctccggaccgttacggaccgtaaacggtcccgttaacccg

SEQ ID NO: 227437 - DNA, 680 bp, Homo sapiens
  misc_feature: GYAE6OF01BH2AH.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggagaaagagtgtacactggtaaccaacagaggccaggccacggcccctgtgcgtggtcgtccatgatgatagcgaccggccctcgacgggactccctgacgcgtcttcgtcgtggcctcctaaacgttcgtacgggaaccaccgggccctacccgtacgaccactccgaacggccggaccgggtacgaacggtccgggaagacgtacggacgggtacccgtaacttacgttacgtcggtacgtagggtcggttacgggaacgtaagttaagtaagtacggtaacgtacccggtagtcgttaacggggtttccgggaccggggttacgggtaaccgtaacggaccgttaccgggtaacccgttaccgtaaaggtcccgaaccggtaccccgaaacgggtcccgttcccggaccccccgttacgggtcccttacccgttccccgg

SEQ ID NO: 227438 - DNA, 774 bp, Homo sapiens
  misc_feature: GYAE6OF01EFRRP.47.53.E09.1.454.CMB.1.raw
tcagagctcacgtacacgaccggtgctcgatttagagagagtgtgttggggtttgggggactcctgtgccccaccatggacacactttgctccacgctcctgctgctgaccatcccttcatgggtcttgtcccagatcaccttgaaggagtctggtccgacgctggtcgaaacccacacacgaccctcacgctgacctgcagcttctctggtattttcactcagtagtactggagaggctggtgggctcggggtccgtcacgcccccgaagggaacggcccgtggagtggcttgcactctatttagtgggatgatgtagaagtactacagtcctaattatttacgaaggtacggtctacactaactaccgaaccgaacggacctaaccttaaacccgaaaaaaccgtaacggttacgggtacctaggaaacctaaactacgaacccgtaaacggtacggaaaccggtccgtacgggacccggaacccgaaccggaccctaaactaacgtttaactttaagtttacggactacccaacccgtaacccggtaacccgtaccgttaacgtaccccggacctaaccgggtacggtaacgggtaaaccttaccggaaccgtaccggttaccgggttaccccggacccccgggtacggggggaccccgtaaaccggggttaacccctttcgggtacccgtaccccgttacccgtacccctaccggtaacccgacccccttaacccggaaccccggtaaaccgggcccccgttaacccggg

SEQ ID NO: 227439 - DNA, 691 bp, Homo sapiens
  misc_feature: GYAE6OF01COR9B.47.53.E09.1.454.CMB.1.raw
  modified_base (407)..(407): a, c, t, g, unknown or other
  misc_feature (407)..(407): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacaggacggccaggacttcccgtgtgggaaggaaacaacattagggaagtaaagagtagtacagttaggtaaccaaacgagacggccaaggccaacgggcccctggtcgcgttcggtccgtccaagtcggatgaagtacggtcgacccggccctcggtgggacctccccgagccgtattcgtctggtcctacgaagtcgtagggaaaccnccggcccaacctcggaccgtacgaggtccgacggggtccggacgggttaccggggagtcgggtaacgggtccgtttaagtttacgtttttcggacggtagggttggtaaggggtacgttaacgtttaagttttggacttaagttagtttgggtttgggttccggacgggtaacggacgtaaggtccgtagtacccgtcgtcggtaccacgacccgtaggtcccgtcgacccccgttcggtacctctcccgttccgttacccccaccctttcctccgtcgtaccg

SEQ ID NO: 227440 - DNA, 754 bp, Homo sapiens
  misc_feature: GYAE6OF01C3NC5.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggaagaaagaagtcgtacactggtaccaacagatgccaggccaggcccctgtgctggtcgtctatgatgatagtgaccggcctcgtgggactccccgagcgacttctcgtggctccgaagtcgtacgggaacctaccgggccctaacccgtcggaacccgtcgaacggccgaacggggttccggaccgggttacgggggactgggacggtccggttaatttacgtttttcggtacgtaaggggttcggttaggggaagtaaccgttttaaagtttttcgggtaccttaagtttaacgtttgggttttacggtttaccggggtaccggggtaacggggtaacccgtaaagggtccgttacgggtaccccggttacccggttcccggggttaccaaccgggtacccccggtaaacggggtccccgtttacccgggtcccccccccgtttacgggtccccgttaacccgtttcccgttacccggttttacccccccggtcccccgtttcccccgtttacccggg

SEQ ID NO: 227441 - DNA, 698 bp, Homo sapiens
  misc_feature: GYAE6OF01DV58F.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctggtgggcgtgggtccgtcacgcccccgaggaaacggccctggagtggcttgcacgtctatttagttgggatgatggtagaagtactacagtactaattatttacgaagtaggtctccactaactacgaaccaaggaacaacttaacccaaaaacctaagtcggtacctagaactaaagtacgaaccaaacgttacgaacgtcctacggaccgggaaccacgggaccctaacgaacttaatttaacgttcgttacgaccgtaaccaacccggtaacgtaccttaacgtaacccggaccaacggtaccgtaagggaaacttacggaacctaaccgttacgggttacccgaaccccggtcggggacccgtaaccggggtaaccctttcgggtaccccgtacccgttaccctacccgtacccgtacgtacccctacccgaaccccggaacggtccccctacccgg

SEQ ID NO: 227442 - DNA, 229 bp, Homo sapiens
  misc_feature: GYAE6OF01BQ3C3.47.53.E09.1.454.CMB.1.raw
  modified_base (184)..(184): a, c, t, g, unknown or other
  misc_feature (184)..(184): n is a, c, g, or t
  modified_base (190)..(229): a, c, t, g, unknown or other
  misc_feature (190)..(229): n is a, c, g, or t
tcagagctcacgtacacgaccggtgctcgatttagagagagtgtgttgggttggagactaattttggtcatatgttgttcggcggagggaccaagctgaccgtcctcggtcagcccaaggcctgccccctggtcactctgttcccaccctcctctacgtgagctctgagcgggctggcaaggcncatagnnnnnnnnnnnnnnnnnnnnnnnnnnnnnnnnnnnnnnnn

SEQ ID NO: 227443 - DNA, 637 bp, Homo sapiens
  misc_feature: GYAE6OF01DBX96.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtagaaacccacacacgaccctcacgctgacctgcagcttctctggtattttcactcagtagtactggagaggctggtgggctggggtcctcacgccccgaaggaacggccctggagtcggcttgcactctatttagtgggatgtagtgtagaagtactacagtcattatttcaagagctcactatacacaagacactaacaaaactagtgtacctagaactaatacgaacctaacgtacgaacgtccgtagaccggtaacgaccggacctaacgtattaacttagttcgcgacaaccaccggaactccgtaacgaccccgacgtacggccgttaagggaaactaccgaaccgtacgttcggttacccgaccccggtacggggacccaacggggttaaccccttggtacccctacccggttcctcccgtaccgaccgtacccctacccgaacccggaaccggtcccctaccgg

SEQ ID NO: 227444 - DNA, 603 bp, Homo sapiens
  misc_feature: GYAE6OF01EGS4C.47.53.E09.1.454.CMB.1.raw
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctggggtccgtcacgcccccaggaaacggccctggagtggcttgcactcatttatgggatgatgtgaagtactacagtccatatttcaagngctcactancacaagacactaccaaaacagtcgtactagacaatcgaaccaacgtgaacgccgtagacggacacggaccacatatttattgtagaccacaccgacgactaacgtaccgccacggtcgtagggaaactcgaacgtaaccgttcgggttaccgaccccggtgggggacccgtaacggggtaacccctttgggtaccctaccccggttcctacccgttacgaccgtacccctacccgaacccgtaaccgggcccctacccggg

SEQ ID NO: 227445 - DNA, 763 bp, Homo sapiens
  misc_feature: GYAE6OF01AMCC3.47.53.E09.1.454.CMB.1.raw
tcagagctcacgtacacgaccggtgctcgatttagagagagtgtgttgggtttggggctgggcctaaggaagcagcactggtggtgcctcagccatgcctggaccgttctcctcctcggcctcctctctcactgcacaggctctgtgacgtccgtacgagtctgatttcgaggcacctcgatgtcagtcggccccaggacaggaccgggccaggtattacgttggtcgggcgggacgccgtaggtcggttaggaacggaaaggaaggtacgtaactacgttcggtaaccaacgagtaactcgaccgacggacccgaacggtcccccttaggtcgtccgtcgggttcctactagtggagtggtaagtggtcggacccggtcctcggtacgggacttccccggagtaccgtagttcctacgtaggtcctacgtaacgtcgtacgggaactacccggcctacccgtcggaccgtacgacggcggtacgggtccggtacgggtacgggacgtacggtaggtacccgtttagttacgttttaggcgtagggttaggtacgggtacgtaacggtttaacgttttcgggtaacctaaggttacgtttacgggttacgggttaccggggtaaccggggtaacggtaaccggaacggtccgtaccggtacccggtccgttaccggtccgacgtacccggtacggtccgtcccggtaccccgttcggtcccttaacgttcccgttaccgttcccctcccgttcccgttaccgg

SEQ ID NO: 227446 - DNA, 536 bp, Homo sapiens
  misc_feature: GYAE6OF01CNRCQ.47.53.E09.1.454.CMB.1.raw
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctggggtccgtcagcccccaggaaacggccctggagtggcttgcactcatttattgggatgntgtgaagtactacagtcatattcaagaggctcactatcacaagacacttaccaaaacagtggtctgacaatgacaacgtnaagcctgcggacacggccacatattatgtgcacgaccgacnctataccgcagctagggaaactcgaacactcggtaccgacccgtggggccgaacgggtacccttggtccgaccgtcctccncgacgtcccacccaacccgagggcccctacg

SEQ ID NO: 227447 - DNA, 680 bp, Homo sapiens
  misc_feature: GYAE6OF01A85IT.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtcgaaacccacacagaccctcacgctcgacctgcagtcttctcgtgtattttcactcagtagtactggagaggcgtggtgggcgtgggtccgtcgacgccccgaaggaacggccgtggagtcggtcttcgacactctatttacgtggatgtagtgtagaagtactacgagtacctattattacgaagtacgctactaactactacaaaccgaacggtacctaaaccgttaaaccgaaaaaccgtacggttaccgtactacggaaactaacgtacgaaccgtaacgtacgaacgtccgtacggaacggtacgaaccggtcaacgtaacttagttacgttgtaccgaacgtaaccaccggaactaccgtacgtaacccgactagaccgtaaggaacctcgaactaacgtcggttacccgacccgtgggtaccgtaaccgggtaccttggtacccgtacccgttcctaccgtaccgtaccgtccccgtaaccgaacccggaaccggtcccgtaacccg

SEQ ID NO: 227448 - DNA, 669 bp, Homo sapiens
  misc_feature: GYAE6OF01CKNLR.47.53.E09.1.454.CMB.1.raw
  modified_base (224)..(224): a, c, t, g, unknown or other
  misc_feature (224)..(224): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattactgtgcgggancagtgttggaagaaagagtgtacacgtggaccaacagatcgaccaggccacggcccctggtgctggtcgtctagtgatgataggtcgaccggccctcgtcgggactccccggagacgtacttctcgtcgctaccgtaagtcgtacgggaacaccggcctaccgtcgaccgtcgacgcgacgggtcgacgggtcggggatcgggacgtaccgttagtttacgttttggcgtagggttcggtagggtaagtaactttaaggttttcggtagtaacgtttaagttcggtttacggtaccgggacgggtaacggtaccgtaaggtccgttaccggtaacccgtccggttacggtaccgaccggacccgtaagggtcccgtcccggtaccccccgttcggttaccgtaacccgttcccttaccgttcccccctacccgttccgttacccg

SEQ ID NO: 227449 - DNA, 653 bp, Homo sapiens
  misc_feature: GYAE6OF01BTOS5.47.53.E09.1.454.CMB.1.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcacctcgatgtcagtcggcccaggacagacggcaggattactgngcggancagtgtgaagaaagagtgacactggtaaccaanagatgacaggccaggccctgtcgcgtggtcgtacatggatagtatacggtcgaccggtcccttggcgggtacctaccccgagacgtacttactcgtcggtactacccgtaaggtttccgacggggaaacacccgggtaccctaacccgttcgaaccggtacacgggacgtacgggggtacggtaaccgggtggggaatgggaacggttccgttaagtttaattttcggacgaagggttggacgggtataacgtttaagttttcgacttagtacgttaggttcggtacgggacggaacggtacaagtcgtacgtacgtccggtacgtagaccggaccgtaaggcctcccggaccccgttcggactaccgttccgttacccgtcccgaccccgtcgttaccg

SEQ ID NO: 227450 - DNA, 752 bp, Homo sapiens
  misc_feature: GYAE6OF01B4XMI.47.53.E09.1.454.CMB.1.raw
  modified_base (226)..(226): a, c, t, g, unknown or other
  misc_feature (226)..(226): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattactgtgcggancagtgtgagaaagagtgtacactggtaccaacagatgccaggccacggccctgtgctggtcgtactatgatgatagcgaccgcctcgtcggactcccgagcgtacgttctcgtcggcctaccgaagtccgtacgggaactacccggaccctaacccgtacggacccgttacgaacggtccggtaacggggtaccggtaccggggtacgggggtattacggggaaccgggtaccggtttaagttttaacggtttttcggtaccggtaggggttacgggttaggggtaacgtttaaacgtttaaaggtttttcgggtacttaaacgtttaggtttgggttttacggttaccgggggacggggtaacgggtaacccgaacggtcggttaccggtacccggttccggttacccgggtaccgaaccggtaccccggaaacgggtccccctaacccgggtcccccccgttacggggttaccccttaccccggttaccgtttccccggtttcccccgttcccccgttaccccg

SEQ ID NO: 227451 - DNA, 727 bp, Homo sapiens
  misc_feature: GYAE6OF01C6K2M.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtagaaacccacacagaccctcacgctgacctgcagcttctctggattttcactcagtagtactggagaggctggtgggctggggtccgtcacgcccccgaaggaacggccgtggagtggtcttgcactctatttagttgggatgtatgtagtaagtactacagtacctattatttacgaaggacggtactctaactactaccaaccgaaaggaacctaaccttaaaccaaaaaaccgtaaggttacggtacctaggaactaaagtcgaaacccgtaacggtacgaaacgccgtacggaccggaaccgaccggaccaaactaatttaacgtttagttaggtacaccaaccgacccggacgtaccttaacgacccgaccgaagtaccgtaagggtaaaactcgaaaccgtacggttaccgggtacccggtaacccccgggtcggggtaacccgtaaccggggttaacccctttcggtaccccgtacccggttacccttacccgttacccgaccggtacccccttaacccggaaacccggaaacccggggtccccgttaaccggg

SEQ ID NO: 227452 - DNA, 527 bp, Homo sapiens
  misc_feature: GYAE6OF01BBXOR.47.53.E09.1.454.CMB.1.raw
  modified_base (438)..(438): a, c, t, g, unknown or other
  misc_feature (438)..(438): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctggggtccgtcagcccccaggaaaggccctggagtggcttgcactcatttattgggatgatgtgaagtactacagtccatatttcaagaggctcactatcacaaggacacttaccaaaaacaagtggtacctgaacaaatgaaccaagtgaagcctgacggacacggccaacatattattgtgcacacgacgctanaccgcagctagggaaatcgacaactggtcgacccgtgggccagggacccttgccaccgtcnccncacncctccaccaacgggccctacg

SEQ ID NO: 227453 - DNA, 666 bp, Homo sapiens
  misc_feature: GYAE6OF01DA36T.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattactgtgcgggagccagtgttggagaaagaagtgtacactggtaccaacagatgccaggccaggcccctgtgcgtggtcgtctatcgatgatagtcggacccggtcctcgtagggctccccggagcgacttcgtcgtggcctccgaacgtcgtacgggaaccaccggccctaccgtcgaccgtcgacgccggaacggggtccgacgggtcggggatacgggacggtccgttagtttagttttcggcgtagggttcggtagggagttactttaagttttcggtactagttagttaggtttgggttaccgggtgggacgggtaaccaacggtccgtacggtaccccgttccgtccgggttacgaccggtaccccgtaagggtcccgtccggaccccccggttcggtacccgtaccgttccgttcccggtccccccgtccccttcccgttaaccccgg

SEQ ID NO: 227454 - DNA, 670 bp, Homo sapiens
  misc_feature: GYAE6OF01CRVLL.47.53.E09.1.454.CMB.1.raw
  modified_base (223)..(223): a, c, t, g, unknown or other
  misc_feature (223)..(223): n is a, c, g, or t
  modified_base (370)..(370): a, c, t, g, unknown or other
  misc_feature (370)..(370): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcggganccagtgttggaagaaagaagtgtacactaggtaccaacagatgccaggccacggcccctgtgctggtcgtctatgatgataggtcgacccggtcctcgtcggactccccgagcgtattctcgtcggctaccaagtcgtagggaaccnccggcccaccctggacccgtcgacggcgtacggggtccgacgggtaccggggatgggacggtccgttagtttagttttggcgtagggttggtagggtacgtaacgtttaagttttggtactaagttagttggttgggttaccggggcgggtaacgggtaaccgtaacggtcgtaccggtaaccccggttccgtccgggtaccaccggtaccccgaaggtcccgttcccgaccccccggttcggtacccttacccgttacccgttcccggttaccccccctcccgtttccccgttacccgg

SEQ ID NO: 227455 - DNA, 549 bp, Homo sapiens
  misc_feature: GYAE6OF01AF71K.47.53.E09.1.454.CMB.1.raw
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (506)..(506): a, c, t, g, unknown or other
  misc_feature (506)..(506): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctggggtccgtcagcccccaggaaaggccctgggagtggcttgcactctatttattgggatgatgtgaagtactacagtccatatttcaagaggctcactatcacaaggacacttaccaaaacagtcgtcctgacaatcgaaccaacgtgaagcctagcggacacggccactatattattgncacaccgacnctacaccgcagcgtagggaactcgacacgtcggtaccgacccgtggggacccacgggtaacccttggtaccnccgttcctccctcacgccctacccaccgtaacgggccctaccg

SEQ ID NO: 227456 - DNA, 547 bp, Homo sapiens
  misc_feature: GYAE6OF01EEQAJ.47.53.E09.1.454.CMB.1.raw
  modified_base (259)..(259): a, c, t, g, unknown or other
  misc_feature (259)..(259): n is a, c, g, or t
  modified_base (319)..(319): a, c, t, g, unknown or other
  misc_feature (319)..(319): n is a, c, g, or t
  modified_base (503)..(503): a, c, t, g, unknown or other
  misc_feature (503)..(503): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaanagatgccagggccaggcccctgtcgctggtcgtctatggatgataggtcgaccggcctgngggactccccgagcgtattctcgtggcctccgaagtcgtagggaacaccggccaccctcgaccgtcacgcgaggtcgacggtcgggatggaggtcgtatttattttcgcgtgggtgtgggagtacttaagttttggctagtattggttgttcgggacggtaggaccaggctgccgtcgtcggcncgaccgagcctcgcccctggctacttctactccccgcctcctcg

SEQ ID NO: 227457 - DNA, 799 bp, Homo sapiens
  misc_feature: GYAE6OF01DT0ZO.47.53.E09.1.454.CMB.1.raw
  modified_base (229)..(229): a, c, t, g, unknown or other
  misc_feature (229)..(229): n is a, c, g, or t
  modified_base (427)..(427): a, c, t, g, unknown or other
  misc_feature (427)..(427): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacaggacggccaggtattacgttggtgcggganccgaggtggttaggaagaaaggagtgtaacgacgtcggtaaccaactagatcgacccgacggccgacggtcccccgtgtcggcgttcggtccgtactagtagacgtagtagtacggtccggaccccggtccttcggtcgggtacctacccccggagtcgtacttcgtcgtcggtcctaacgaacgtcgtacgggaacncccggaccacccgtgacccgtcgacgacggtacgggtcggacgggtcggggtagtacgggacggttaccgttaagttttacgttttacggacggtaggggttacggttaacggggtaaatttaaccggtttttaaaggtttttcgggtaaacttagggttttaaggtttcgggtttccggggttacggggtaccggggaaacgggttaccgtaaacggtcccgggttaaccggtacccggttcccgggttaccggtacccgaacccgggacccggttaaccgggtccccgttcccccgggtaccccccgttcgggtaaccctcccgtttccccggttcccgttcccccccgttcccgttcccgttaccccgg

SEQ ID NO: 227458 - DNA, 775 bp, Homo sapiens
  misc_feature: GYAE6OF01DTIJS.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggtattttcactcagtagtactggagaggctggtgggcgtgggtccgtcacgcccccgaggaaacggcccgtggagtggcttgcactctatttagttgggatgatgtagaagtactacagtaccattattacaagagctacactatacaaccaaggactactaaccaaaacgagtacggtacctagacaatacgaaccaacgtagaacgcctgacggacaccggaccaactattaatttagttgtacgacaaccgaccgacgtacctaactacccgccgaagtacgtaagggaactaccgaacgtaacgttcggttacccggaccccggtacggggacccgtaaccggggtacccttcgtacccgtacccgttccttcccgtaccgaccgtacccctacccgaaccggaaccgggtacccctaacgttcccggttaccccgttacccccggttaccggtacccctacccccgtcccgtacccgaacggtacccgtacccgtaccccggttccgggtaccggggggacccctaaccgggacccgggtccccgggtccccggtacgggggtccccgttacccgggtaccccggttacgggttaacccggtaaaccgggttaccctttaaccccgg

SEQ ID NO: 227459 - DNA, 192 bp, Homo sapiens
  misc_feature: GYAE6OF01E1MTW.47.53.E09.1.454.CMB.1.raw
  modified_base (192)..(192): a, c, t, g, unknown or other
  misc_feature (192)..(192): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgccccctcggtcactctgttcccaccctcctctacgtgagctctgagcgggctgggcaaggcgcatagn

SEQ ID NO: 227460 - DNA, 667 bp, Homo sapiens
  misc_feature: GYAE6OF01DNZ0H.47.53.E09.1.454.CMB.1.raw
  modified_base (264)..(264): a, c, t, g, unknown or other
  misc_feature (264)..(264): n is a, c, g, or t
  modified_base (324)..(324): a, c, t, g, unknown or other
  misc_feature (324)..(324): n is a, c, g, or t
  modified_base (377)..(377): a, c, t, g, unknown or other
  misc_feature (377)..(377): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaggattactgtgcgggagccagtggttggaagaaagaagtgtacactggtaaccaanagatgccaggccacggcccctgtgcgtggtcgtctagtgatgatagtcgaccggcctcgngggactcccgagcgtattctcgtcggcctaccgtaagtccggtagggaaaccnccgggacccacccgtcggacccgtacgaggtccgacggggttccgaccgggttacgggggatcggggaacggtccgttaagtttagtttttggacgtagggttggtagggacttaacgtttaagttttggtactagttacgttggtttggttcgggacgggtacgggtaaccacggtcgtacgacccggttccgtccgggtacaccggcccgtaagggtcccgtcccggtccccccgttaggtccctaccttccgttcccttaccccctaccccgttcccgttaacccgg

SEQ ID NO: 227461 - DNA, 700 bp, Homo sapiens
  misc_feature: GYAE6OF01DXKOH.47.53.E09.1.454.CMB.1.raw
  modified_base (222)..(222): a, c, t, g, unknown or other
  misc_feature (222)..(222): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacgccaggattactgtgcggganccagtgttggagaaagagtgtacactggtaccaacagatcgccaggccaggcccctgtcgctggtcgtctatgatgatagtcgaccggtcctctgggactccccggagcattcctcgtcggcctaccgaaggttcgtaggggaaccaccgggcccctacccgtacggacccgttacaacggccggtaacgggtccggacgggtaccggggagtacgggacgggtaccgttaagtttacgtttttggacgtagggttggtagggtacgtacgtttaaggttttggtcttaagttagtttgggtttcggtttccggggacgggtaacgggacccgtaaggtccgttacgggtaccccgttccgtaccgggtacgaaccggtaccccgtaacgggtccgttccccgggcccccccgttacgggtaccccttaccgttccccgttacccggtttccccctacccccgttcccttaaccccgg

SEQ ID NO: 227462 - DNA, 670 bp, Homo sapiens
  misc_feature: GYAE6OF01D8AI2.47.53.E09.1.454.CMB.1.raw
  modified_base (225)..(225): a, c, t, g, unknown or other
  misc_feature (225)..(225): n is a, c, g, or t
  modified_base (363)..(363): a, c, t, g, unknown or other
  misc_feature (363)..(363): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcggganccagtgtggagaaagagtgtacactggtaccaacagatgccaggccacggcccctgtgctggtcgtctatgatgatagtcgaccgcctgcgggactccccgagcgtattctcgtggctccgaagtcgtacgggaaccnccggcccacccgtcgaccgtcacggcgacgggtcgacgggtcggggagtggacggtccgttatttacgttttggtcgtagggttggtgggtacgtacgtttaagttttggtactagttagttggtttggtccggggtacgggaacgggtaccgtaacggtccgttacggtaccccggttccggttacccgggtacgtaaccggccccggtaagggtcccgttccccggtcccccccgttacgggtccccgttaacccgttccccgtttcccggtttcccccccggtccccgttccccgttaccccgg

SEQ ID NO: 227463 - DNA, 804 bp, Homo sapiens
  misc_feature: GYAE6OF01DL75P.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcaggtcggccccaggacaggacggccaggtattacgttggtggcgggagccaggtgttaggaagaaagagtgtacacgtggtaaccaagagatcggaccgacggccgacggccccgtgtcgcgttcgggtcgtctagttgattgagtaggtcgacccgggtcccttcgtacgggtaccctccccgggagtacgtactttccgtcgtcgggtacccttaccgtaacggttcgtacggggaacctaccgggaccctacccgtggaacccgtcgaacggcgtacgggtcgtaacgggtcggggatacgggtacggtaccgtttaagtttacgttttttacggacgggttaagggtttcgggtaacgggggttaacggttaactttttaacgggtttttacgggtaacgtttaagtttaggtttcgggttttacggggtttaccgggggtaacggggtaaccgggtaccgtaaacggtccggttaccggttaaccccggttcccggtaccggtaccgaaccggtaccccgtaacgggtcccttcccgggttaccccccgttcgggtacccttacccggtttccggttaccccggttccccccgttcccgttccccgttacccggg

SEQ ID NO: 227464 - DNA, 877 bp, Homo sapiens
  misc_feature: GYAE6OF01B3PDH.47.53.E09.1.454.CMB.1.raw
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgtggagaaagagtgtacactggtaccaacagatgccgaggccacggcccctgtcgcgtggtcgtctatgatgataggtcgaccggcctgtcgggactccccggagtcgtattcctcgtcggtactaccgtaacggtcgtaacgggaaccgaccgggtaccctaaccccggtacgaacccggttccgacggtaccggtaacgggggttaccggtaaccgggttcggggggaacttcggggaaccgggtaccgtttaagttttaacgttttttcgggtaccgtaggggtttgggtacggggttaacgttaaaccgtttttaaggtttttcgggtaacctttaagtttacggtttttacgggttttacgggggtttaacccgggggtaccgggggttaaaccggggtaaaccctaaacggggtcccccggtttacgggaaaccccccggttttcccgggttacccggggttaacccggaaccccggggttacccccgttaaaacgggggtccccgtttaccccccggggtacccccccccggtttaaccgggggtttaacccccttaacccccggggttttccccgtttaaccccccggtttttaacccccccctaaaccccccgttttcccccgggttttaaacccccgg

SEQ ID NO: 227465 - DNA, 790 bp, Homo sapiens
  misc_feature: GYAE6OF01B6R33.47.53.E09.1.454.CMB.1.raw
tcagagctcacgtacacgaccggtgctcgatttagagagagtgtgttgggtttgggctgggcctaaggaagcagcactggtggtgcctcagccatggcctggaccgttctcctcctcggcctcctctctcactgcacagactctgtggcctcctatgtactgactcagccatccgtcggtggcagtcggccccaggacagacggccaggacttcccgtggtaggaacggaaaacaacgtagttaggaaagtaagagtagtaacagtttacggtaaccaacgagacggccaaggccacggcccctggtcgcgtcggtcgtaccagtgatgatacgcgacccggcctacgagggactcccgtgacgcgtcttcgtcgtcggctaccgtaagttcgacgggaaccaccggaccaccctcgaaccatcgacgtcggcggtacgaaacggccgggaagtagtcggaacggtcccgtaacgttaacgttacgtacggtacggtacggttacgggacgggtaaccgtaaggttaaacggttaacggtccgttaaaccgggttacccccggaaagggttacccggttaaacgggggttttttcccggggaccggggttaacggggtaacccgtaaaacgggtcccgttaaccgggttaaccccggttaacccgtttaaacgggtacccgaaacccgggttacccccggaaacgggttccccgttaccccgggtaccccccccgtttacgggtaccccgtttaacccgttcccggtttacccccgtttaaccccccccg

SEQ ID NO: 227466 - DNA, 868 bp, Homo sapiens
  misc_feature: GYAE6OF01DJ63I.47.53.E09.1.454.CMB.1.raw
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggccaccctcgatgtcagtcggcccaggacagacgcaggattactgngcggancagtgtaggagaagagtgtacacgtacggtaaccaacgagacgtcgaccgacggaccgaccggcccgtggtcgtcggttcgggtctacgttagtgtagtagtagttacggaccggtaccccgtcccgtacggttaccgggacccgtacccggaggtaccgttacgtttccgtaccggttaccggtacccgttaaccgtaacgggtccggtaaccggggaacccgtaccccgggacccctaacccggtaccggtaacccggttacggaaccgggtacgggtaccgggggttaaccgggtaccgggggttacggggtaacgttacggggtaaccgggtttaaccggtttaaggttttttacggttttacgggtaacggggttaggggtttcggggaagggtttaacgtttacgtttttaaagggttttcgtaacgttagttttaacggttcgggtttaccggggtaacgggaccggggaacggttaacccgtacggttaccggtaccgggttacccggttacccggttacgggacccgtaacccgggtaacccggtaacgttccccggtaccccgggttacccccgtcggttcccgtaaccccggttccgtttccccccggttcccccgtacccggtttaccccgg

SEQ ID NO: 227467 - DNA, 780 bp, Homo sapiens
  misc_feature: GYAE6OF01DDVFW.47.53.E09.1.454.CMB.1.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
tcagagctcacgtacacgaccggtgctcgatttagagagagtgtgttgggtttgggctgggcctaaggaagcagcactggtggtgcctcagccatggcctggaccgttctcctcctcggccctcctctctcactgcacaggctctgtgacgtccgacgagctgattcaggccaccctgatgtcagtcgcccaggacagcgcagtatatgngcggncgagtgtaggaagaaagagtgtacactggaccaacagatcgcacggccacggccctgcgcgtcgggtctactagtgtatcgtaagtaggtccgacccggtccccttacggttacgggggacccctacccccgggaaggccgttacgtttcctccgtacgggtaccctaccggtaaaggtttcccggtaacgggggaaaccacccgggtacccctaacccggttcggaaaccccgtcgacgggttacgggaccgggttccgggaaccgggtagggggtacgtcggggtacggtaccgtttaattttcggtttttacgacgggtaggggtttggaacggggttaagtttaaccgtttaaaggtttttcggaacgttaaggtttacgttttaggggttacgggtttaccggggaacggggtaaccggtaaaccggtaggtaccgttacggtaccccgggttccgtacccgggtaacgaacccggtccgtaacccggcccgttccccgtacccccgttcggtaccctaccgttccgttacccgttaccccctaccgttcccgtaacccg

SEQ ID NO: 227468 - DNA, 802 bp, Homo sapiens
  misc_feature: GYAE6OF01BWU5K.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacaggacggccaggtattacttggtcggcgggagccgtaggttggtaggaagaaagagtgtaacacgtcggtaaccaacgagaactggaccgacggccacggtccccgtgtcgcggttcggtccgtcgttaagtgtagtagtaggtacgtcggaacccggtcccgttacggtacgggtacccaccccggacgtcgtacttccgtcgtccggtacctaccgtaagtccggtaacgggaaccgacccggtcccctaacccgtacggtaacccgttaccgaacggtccggtacgggtacccgggtacgggttacgggggtagtacggggtacggtaccgtttaatttacggtttttcggtacggtagggttgggtagggtaacgttaagttttaaggttttaggtaaccttaggtttacgtttgggttttaccgggttacgggtacgggttaaaccggggtacctaagggtaccgtccggtaacccggttacgttacccggtaccggtaaccgtacccggtaacggtcccggttaccccgtccccccgttacggaccccttacccgttcccgtttccccggtacccccgtcccctcccgttaacccgg

SEQ ID NO: 227469 - DNA, 722 bp, Homo sapiens
  misc_feature: GYAE6OF01DSRTW.47.53.E09.1.454.CMB.1.raw
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagcttctctggtattttcactcagtagtactggagaggctggtgggtcgtggggtccgtcgaccgcccccgaaggaaacggcccgtggagtggcttgcctactctagtttagttgggtatgatggtagaagtactacngtactatattcaagngctcactacacaacaagactaaccttaaccaaaaaccagtcgtacctagaacaagtacgaacctaacggtagaacgaccgtagaccgggaaccgaccggaacctaacgtacttaagtttaatttcggtacgacctaaccgaacccggttaaccggaaccttaacgtaaccccgacctaacggtacggtaacgggtaaactcccggaaacgtaccgtttaccgggttacccccggaccccggtaccggggaccccgtaaccggggtaacccctttcccgggtacccgttaccccgttacccgttccccgacccgtacccgtacccccgtaccccgaaaccccggtaacccggggtccccctaccccgggg

SEQ ID NO: 227470 - DNA, 722 bp, Homo sapiens
  misc_feature: GYAE6OF01DU68Q.47.53.E09.1.454.CMB.1.raw
  modified_base (238)..(238): a, c, t, g, unknown or other
  misc_feature (238)..(238): n is a, c, g, or t
tcagagctcacgtacacgaccggtgctcgatttagagagagtgtgttgggttgggggctgggccctaaggaagcagtcactggtggtgcctcgagccacgtggcctggaccgtttctcctccgtcggcctacctctctcgacgtgcaccgaggctctagtgacgtccgacgagctgattcaggccaccctcgatgtcagtcggccccaggacagacggccaggattactgtgcgggancctagtgttggagaaagagtgtacagtggtaaccaacagatcgccgacggccacggccccctgtgcgtggtcgtctatgatgatagcggacccgtcctcgtgggtacctccccggagcgtacttccgtacgtcgtcctaccgtaacgtcggtacgggaaccgaccggtccccaacccgttcggacccgttcgacggcggtacgggtcggtacggtcggggagtcgggacgtcgttagtttagttttcgacgtaggtggtacgggtagttaactttagtttacggtactagttagttggtttcggttaccggggtacgggaacggtaccgaacggtccgtaccggtaccccgtacccggtcggtaacccgtaccggacccggtaacgggtccccggttcccggcccccccggttacggtccccgttaacccgtttcccggtttcccccggttccccccgttcccccgtttccccgttaccccggg

SEQ ID NO: 227471 - DNA, 705 bp, Homo sapiens
  misc_feature: GYAE6OF01ENWE3.47.53.E09.1.454.CMB.1.raw
  modified_base (224)..(224): a, c, t, g, unknown or other
  misc_feature (224)..(224): n is a, c, g, or t
  modified_base (371)..(371): a, c, t, g, unknown or other
  misc_feature (371)..(371): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggganccagtgttggagaaagaagtgtacactggtaccaacagatgcaggccacggcccctgtgctggtcgtctatgatgataggtcgaccggtcctcgtgggactccccggagccgtattctcgtcggctaccgaagtcgtacgggaaccnccggcccacccgtcggaccgtcacgcgaggggtccgaccggtcggggatggacggtccgttagtttagtttttggacgtagggttcggtagggtagtacgtttaagttttggtctaagttacgttggtttacggttcgggtacgggtaacgggacctaacgggtccgttacggtaacccggttccgttaccgggtaccgtaacccgggtaccccggtaaagggttccccgttccccggggtaccccccccgttccgggttaaccccgtacccgtttccccggtttaccccgggttttacccccccccggtcccccgtttccccgtttaccccgg

SEQ ID NO: 227472 - DNA, 725 bp, Homo sapiens
  misc_feature: GYAE6OF01A6CR4.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtagaaacccacacacgaccctcacgctgacctgcagcttctctggtattttcactcagtagtactggagaggcgtggtgggcgtggggtccgtcgacggcccccgaagggaaacggcccgtggaggtggcttgctactctatttagttgggatgatgtagtaacgtactactagtcctattagtttcaaagtaggtcctacgtaacttactacgaaccgaaacggtaacctaacccttaaacctaaaaaaccgaacggttacggtaccctaacgaaacctaaagtacgaacccgtaaacggttacggaaaccgtcgtacggtaccggaaccgaacccgggacaactaacttagtttaacgttgtacgaccaccgtaacccgacgtaccttaacgtacccggaccacgggtacgtaacggggtaaactacgaaccgtaaccggttcggttacccggacccgtcgggggacccggtaaccgggtacccgtttcgacccgtaccgttccgtaccctcgtaccgtaccccgtaacccgaccgtaaccgggccccttaacccggg

SEQ ID NO: 227473 - DNA, 855 bp, Homo sapiens
  misc_feature: GYAE6OF01EG4T5.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtagaaacccacacagaccctcacgctgacctgcagcttctctggtattttcactcagtagtactggagaggctggtgggcgtcgggtccgtcacgccccgaaggaacggccctgggagtggcttgctactctatttgtgggatgatgtagaatactactacgtacaattactttaccgaaaggtcggtacctactaaccgtaactacccgaaacccgaaacggtaacctaaaccgtttaaacccaaaaaaaccggtacggttacgggtaccctaaggaaacctaaagtaccggaaacccgtaaacgggttacgaaacccggtaccgttacgggaacccggggtaaacccgaacccgggtacccctaaacgttaaactttaacgttttaagttttaccggacgtaacccgaacccgtaaccccgggtaacccgtaccttaaacccggtaaccccggtaaccgaaacgggtaccgggttaaacggggtaaaacctacccgggtaaaccttaaccgggtttaccgggttacccccgggaacccccgggtaccggggggtaccccgtaaaccgggggttaacccccttttacgggacccccttaacccgggtcccctttacccggtaacccgacccggttacccccgttaaccccggaaaccccgggtaccggggcccccctttaaacccgggg

SEQ ID NO: 227474 - DNA, 943 bp, Homo sapiens
  misc_feature: GYAE6OF01ETRWP.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtcgacgagctgattcaggcaccctcgatgtcagtcggaccccagggacacgaccggccaagggtatttacgttggtcggacgggacgccgtaaggttggtttagggaaacgaaaagggtaagttacggtaaccgtaccggttacggtaaacccaaaaccgaaggtacgtacggacccgaagggccccgaaccgggtcccccgttggtacggtccggtttacggggttacgttccttaagtacgggtaacgtaggtaacgttaacggtcgggtaccccggcccttacggtacgggtaccctaccccgggaagtccggtacgtttcctcgtacgggtacctaaccgaacggttccggtaacgggaaaccctaaccggggcccctaaacccgttccggaaccgtccgtaacggtccgggtaacggggtacccgggtaaccggggtcgggggtaacgtaggggtaaccgggtaccggtttaattttaacggtttttacgggtacgttaacggggtttagggttacgggtaaacggtttaacgtttaaaggttttttacggtaccgtttaaaggtttacggtttacgggtttttccgggttaccgggggtacccggggtaacgggtacccggtaaggttaccgggttaaccgaccgggttacccggtacgggtacccggaaaccggtaccccggtaaaggcccccggtttcccggtacccccggttaccggtttacccttaacccggttccctttaccccgggtttacccccttacccccgtcccgtttaaccccgg

SEQ ID NO: 227475 - DNA, 630 bp, Homo sapiens
  misc_feature: GYAE6OF01D1AKQ.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacagaccctcacgctgacctgcagcttctctggattttcactcagtagtactggagaggctggtgggcgtgggtccgtcacgcccccgaaggaaacggccctggagtggcttgcactctatttatgggatgatgtgaagtactacagtcatattcaagagctcactatacaacaagacacttaaccaaaaacctaagtcggtacctagaacaagtacgaccgtaacgtagaacgaccgtcggaccggacgaccggaccaactaattatttagttcgtacgacctaacgacccgaccgtacctaactaacccgaccaaggtccgtagggaaactaccgaacgtaacgttcgggtacccggaccccggtcggggacccgtaacgggtaacccgtttcgtaccacccggttcctcccgtacaccgtaccctacccgaacccgaccgggccctaccg

SEQ ID NO: 227476 - DNA, 636 bp, Homo sapiens
  misc_feature: GYAE6OF01EMEMH.47.53.E09.1.454.CMB.1.raw
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggcaccctgatgtcagtcggccccaggacaggacggccaggtattacttgtgcgggagccagtgttggaagaaagaagtgtaacacgtggtaaccaaacagaatcgaccaggccgacggcccctggtcgcgtggtctctatgatgagtagcgaccgcctcgtgggactcccggagtcgtattcctcgtacggcctaccgaaggtcgtacgggaaccaccgggaccccacccgtcggaacccgtcgacggtcggacgggtcgacggtacggggataggacggtacgttattagttttgcgtaggttggtggtagtacgttagtttggtatagttagttggttggttcgggacggtaggacgtaagtcgtacgtaccgttccgtccggtacgaccgtcccgtaaggtccgtcccggtccccgtcggtaccctacctccgttacccgttcccctacccgtcccgttacccgg

SEQ ID NO: 227477 - DNA, 663 bp, Homo sapiens
  misc_feature: GYAE6OF01BNQF9.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggcccaggacagaccggcaggtattacgttgtggcgggagccgagtggttggaagaaaggaagtgtaacacgtaggtaaccaacgagatgaccgacggccacggcccctgtcgcgtggtcgtctatgatgatgcgaccgtccgtgtcggactcccgagcgtacttctcgtcgctacgagtcgacggacaccgtccaccgtacgacgtcgacgcgtacgggtcgacggtcgggataggacgtcgttattagtttcgacgtagggtgtagggtagtacgtttagttcggtatagttagttggtttcggtacgggtacgggtaacggtacgtaacggtcgttaccgggtacccgtacgttacccggtacgacccggtacccgtaacgggtcccgttccccgggccccccgttacgggttacccgtacccgttccctttaccccgggtttccccccttaccccgttccccggttacccgg

SEQ ID NO: 227478 - DNA, 641 bp, Homo sapiens
  misc_feature: GYAE6OF01ACYPU.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggcccccaggacagacggccaggattacttgtgcgggagccagtgttggagaaagagtgtacactggtaccaacagatgccaggccaggcccctgtgctggtcatctataaggatacgaaaccggccctcgtgggactcccgtaggaaccgtacttccgtctacggcctcccgtaaagtttccggaacaaccgacggcccacccgtcgacccgtcgacgcgagggtcgacggtcgggatcggaggtcccgtattagttttgcgtaggtggtagggtagtacttaagttttcggtactagttagttggtttcgttacgggtcgggtaagggtaccgtaaggccgttacggacccgtccgttcggtccacggtccccgaaggtcccgtcggcccccgttcggtccgtacccgttccgttaccgttcccccgaccctttcccgtccgttccggtacgg

SEQ ID NO: 227479 - DNA, 549 bp, Homo sapiens
  misc_feature: GYAE6OF01DUOPR.47.53.E09.1.454.CMB.1.raw
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctgggtccgtcacgcccccaggaaaggccctggacgtggcttgcactctatttattgggatgatggtgaagtactacagtccatatttcaagagctcactatcaccaaggacactaccaaaacagtggtcctagaacaatgaaccaacgtgaacgcctgaccggacacggccaacatattattgtncacaccgagctanaccgccagctagggaatcgaactacgtggttccgacccgtggggcctaacgggtaccccttgcctacccgtcgtccctactacgccctaccaaccgacgggccctacg

SEQ ID NO: 227480 - DNA, 657 bp, Homo sapiens
  misc_feature: GYAE6OF01AXHPR.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacaggacggccaggattactgtggcgggagcctagtgtggaagaaagagtgtacacgtcggtaaccaacagatgaccacggccacggcccctgtcgtcgtggtcgtctagtgagtgagtaggtcgacccggtcctcgtcggactccccggagtcgtacttcgtcgtcggtacctaccgtaaggtcgtaacgggaaccctaccggccctaaccccgtcgaccggtcacggcgtacggggtcgtaccgggtacgggaggtacggacgggtacgttagtttagtttttcggacggttaagggttcgggtagggtagtaacgtttaagtttcggtaactagttacgttggtttcgggttcgggacgggtacggaccgtaggccgtcggtaccgtccggtcggtacgaccggccgacggtcctcccggcccttcggtcctcgtacctcctcccgtcccgtccg

SEQ ID NO: 227481 - DNA, 643 bp, Homo sapiens
  misc_feature: GYAE6OF01A5U3X.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctctgggatccccgagcgattctctggctccaagtctgggaacacggccaccctgaccgtcagcgagggtcgacggtcggggatggaggccgttattatttttgtcgtagggttggtgggagtacgttaagtttttgggtactagttagttggtttggtttaccggggtcgggtaacggggtaacccgaagggtccgtcggtacccggttcccgttaccgggttaccgacggtccccgaaacgggtcccgttccggtaccccccccgttcgggttacccctaccgttccccgttaccggtttccccccctaaccccgttccccgttacccgg

SEQ ID NO: 227482 - DNA, 605 bp, Homo sapiens
  misc_feature: GYAE6OF01D83QD.47.53.E09.1.454.CMB.1.raw
  modified_base (379)..(379): a, c, t, g, unknown or other
  misc_feature (379)..(379): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggagaaagagtgtacactggtaccaacagatcgcaggccaggcccctgtgctggtctctatgatgatagtcggaccggtccctcgtgggacctcccgagcgtattctcgtgctaccagtcgagggaccacggcccacctgaccgtnacgcgagggcgacggtcgggatggaggtccgtattacgttttgcgtagggttggtagggtagtaacgttaagttttcggtatagttagttgttcggttacgggtacgggaacgggtacctaacggtctacggtacccgttccgtccggtaccgacggcccgtaacggccgttccgccccccgtaggtccctcccgttcttcccgttcccctcccgttccgtacccg

SEQ ID NO: 227483 - DNA, 757 bp, Homo sapiens
  misc_feature: GYAE6OF01EAVRU.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtcgaaacccacacacgaccctcacgctgacctgcagtcttctcgtggtattttcactctagtagtacgtggagaggcgtggtgggcgtcgggtccgtcgacgcccccgaaggaacggcccgtggacgtgcttgcactctatttagtggatgtatgtagtaatactactacgtacctattactttacgaaggtacggtcttacctaacttactaccgaaacccgtaaaggaaccctaaaccttaaaccctaaaaaaccgtaagtaccggtaccgtaagaacctaacgtacggaacccgtaacgttaggaacgtccgtacggaccggaacccgaaccgggtaacctaacgtaactttagttaacgtttggtaccgtaccgaacccgtaacccgaccgtacctaaccgtacccgaacccgtaacggacggttaacgggaaaacttccgaaaccgtaccggttaccggtacccgggtaccccgggtacgggacccgtaaaccggggttaccccttcggtacccgtacccgttccgtaccccgtaccgtacccgacccgttaaccccgaaccggtaaacccgccccggttaacccgg

SEQ ID NO: 227484 - DNA, 692 bp, Homo sapiens
  misc_feature: GYAE6OF01DESWN.47.53.E09.1.454.CMB.1.raw
  modified_base (348)..(348): a, c, t, g, unknown or other
  misc_feature (348)..(348): n is a, c, g, or t
tcagagctcacgtacacgaccggtgctcgatttagagagagtgtgttgggtttgggggggtcttgtcccagatcaccttgaaggagtctggtccgacgctggtgaaacccacacagaccctcacgctgacctgcagcttctctggattttcactcagtagtactggagaggctgtgggctggggtccgtcagcccccaggaaacggcccgtggagtggcttgcactcatttattgggatgatgtgaagtactacagtccatatttacaagaggctcactatcaccaaggacacttaccaaaaccagtggtcctgacaatgaccaacgtgagcctgcggacacggccanatattattgtcgcacaccgacgctactaccgcacgctacgggaatcgaactaacgtcggttaccgaccccgtcggggaccctacgggaaccctttacgcccgtaccgttcctcccgtacgcgtacccttacccaacccgtaaccgggacccctacgttacccggttcccctttccccccgtcgggtcccctacccccgttccctacccgtaacggacccgtaccgaccccgttaccggtccggggggcctaacccggaccgggccccgggtaccccggttaccggggcccgttcccgggtccccggttagggtcccggtaaacgggtacccttttaacccccgg

SEQ ID NO: 227485 - DNA, 614 bp, Homo sapiens
  misc_feature: GYAE6OF01D1MBW.47.53.E09.1.454.CMB.1.raw
  modified_base (397)..(397): a, c, t, g, unknown or other
  misc_feature (397)..(397): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaaccacacagaccctcacgctgacctgcagcttctctggattttcactcagtagtactggagaggctggtgggcgtggggtccgtcacgcccccagggaaacggccctggagtggcttgcactcatttattgggatgatggtgaagtactacagtccatatttcaagtaggctcactatcaacaaggacaacttaccaaaacagtgtctgacatcgaccaacgtagacnccgtgaccggacacgggaccacgatattatttcgagtaccaccgaaccgtacgtcctaactacccgccagaccggtagggaaaactcggtaacacgttcgggttacccgaccccggtagggggccccaaggggtaccccttaggtacccgtaccccggtcccttacccgcctaccggtacccctacccgtaacccggaaccgggtcccctaacccgg

SEQ ID NO: 227486 - DNA, 683 bp, Homo sapiens
  misc_feature: GYAE6OF01BOEBE.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggagccagtgttggagaaagagtgtacactggtaaccaacagatcgaccgaggccacggcccctgtcgctggtcgtctatgatgatagtcgaccggcctgcggactccccgagcgtattctcgtggctaccaagtcgtaggaacaccggtcccaccgtcgacccgtcgacggcgacgggtcgacgggtcggggagtaggacggtaccgtttaattagttttcgacgtagggttggtacgggtaacgttaacgttttaaggttttcggtactaagtttcgttaggtttcggttaccggggacggggtacgggtaaaccgtaaggccgttacggtacccggttcccggttacggtaccggtaccggtacccgtaacgggtcccttccccgggtccccccgttacgggtacccttaaccgtttcccgttacccgtttaccccccgtaccccgttcccgttaacccgg

SEQ ID NO: 227487 - DNA, 751 bp, Homo sapiens
  misc_feature: GYAE6OF01BUOXA.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgtggaagaaagagtgtacactaggtaaccaacagatcgccaggccacggcccctgtcgcgtggtcgtctagtgatgataggtcgaccgcctgtcggactcccgagcgtattctctggcctaccgaagttcgtaggggaacctaccgggaccccacccgtacggacccgttcgacgcgacggggtccgacggtcggggatcggaaggtccgttaattagtttttgtcgtagggttggtagggtacgtaacgtttaagttttggtacgtaagtttacgttgggtttcgggttacggggtacgggtaacgggtaacccgtaaaggtcccgttaacgggtaaccccggtttccccggttacccggggttacccgtaaaccgggtacccccggtaaacggggtccccgttaccccgggttaccccccccccggtttaccggggttacccccttaaaccccggttttcccccggtttaccccgggttttccccccccgtaaacccccccgtttttaccccccgg

SEQ ID NO: 227488 - DNA, 707 bp, Homo sapiens
  misc_feature: GYAE6OF01APAER.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggagccagtgttggagaaagagtgtacactggtaaccaacagatgccaggccaggcccctgtgctggtcgtctatgatgatagtgaccggccctctcggggactccccggagccgtatttcctcgtcgggcctccgtaaaggttcgtaggggaaaccaccgggccccaaccccgttcggaccccgtcacggaccgaggggtccggaccggtcgggggacgtggacgggtccgtttaagttacgttttttcggtacgtagggttggttagggtagtacgtttaagttttggtcgttaagttaagttggttttcgggttcggggtacgggtaacggggaacccgtaaggtaccgttacggtacccgttccgttcccgggtaccaaccggaccccgtaacgggtcccgtcccggtcccccccggttccgggttacccgtacccgtttcccggttacccggtttccccccgtccccgttcccgttaccccgg

SEQ ID NO: 227489 - DNA, 682 bp, Homo sapiens
  misc_feature: GYAE6OF01CURN8.47.53.E09.1.454.CMB.1.raw
tcagagctcacgtacacgaccggtgctcgatttagagagagtgtgttggggtttggggggtcttgtcccagatcaccttgaaggagtctggtccgacgctggtgaaacccacacagaccctcacgctgacctgcagcttctctggtattttcactcagtagtactggagaggctggtgggctgggtccgtcacgccccaggaacggcccgtggagtggcttgcactctatttagttgggatgatgtagagtactacagtccatatttcaagagctcactatacaccaagacacttaccaaaacagtcgtacctagacatcgaaccaacgtgaacgcctaggaccggaacaccggaccactaattaatttattggtcgacaaccgtaaccgacgaccttaacgtacccgccaaggccgtaaggggaaactcgaaccgtaacgttcggtttaccccgaccccggtcggggacccgaacgggtaaccccttcggtccctacccggtcctccctacgacgccctacccaccgaacgggccctacgtcccggttcccttcccccgtggacccctacccttcccgtaccgaacgtaccgtcccgtacccgttcgggccggggaccacgaccggcccgggcccgtcgggccctcgggacccgttcgggacccaacgggtccttacccgg

SEQ ID NO: 227490 - DNA, 644 bp, Homo sapiens
  misc_feature: GYAE6OF01EGJUS.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattactgtgcgggagccagtgtggagaaagagtgtacactggtaaccaacagatgccaggccaggcccctgtgctggtcgtctatgatgataggtcgaccggccctgtcgggactccccggagccgtacttctcgtcggcctaccgaagttcgtacgggaaccaccgggccctacccgtcggacccgtacgacggcgacggggtcgacgggtcggggatggacggtccgtagtttacgttttgtcgtagggttggtagggagtaacgtttaagttttggtactagttagttggtttggttaccgggagggtacgggaaccgtaaggtcgtacggtacccggttccgtcgggtaccgacgtaccccgaaggtccgtacccggtcccccgtccggttccaccgttccgttcccgttcccccgtccccgttcccg

SEQ ID NO: 227491 - DNA, 567 bp, Homo sapiens
  misc_feature: GYAE6OF01BIBY3.47.53.E09.1.454.CMB.1.raw
  modified_base (224)..(224): a, c, t, g, unknown or other
  misc_feature (224)..(224): n is a, c, g, or t
  modified_base (554)..(554): a, c, t, g, unknown or other
  misc_feature (554)..(554): n is a, c, g, or t
tcagagctcacgtacacgaccggtgctcgatttagagagagtgtgttgggtttggggctgggcctaaggaagcagcactggtggtgcctcgagccatggcctggaccgttctcctcctcggcctcctctctcactgcacaggctctgtgacgtccgacgagctgattcaggcacctcgatgtcagtggccccaggacagacggccaggattacttgtgcggganccagtgttggagaaagagtgtacactggtaccaacagatgccaggccaggcccctggtgctggtcgtctatgatgatagtgaccggccctgtggacttccccgagccgattctcgtcgctccgaagtctgggaaccacggccaccctgacccgtcagtcgaggtcgacggtcggggatggacggtccgtattattttgctagggtgtggagtacttaagtttggtaccagttagtgttcggttcgggcggtacgggaccaaggcgtgacccgtcctcggtcacggcccgaaggctccggaccccttcggctacgttctaccggttccccncccgttcctaccg

SEQ ID NO: 227492 - DNA, 761 bp, Homo sapiens
  misc_feature: GYAE6OF01A4UQA.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctgggtccgtcacgccccaggaaaggccctggagtggcttgcactcatttatgggatgatgtagagtactacacgtccaattatttacaaaggaggctacaactactacctaaccaaaggtaccaactttaacccaaaaaacctaaggtacggtaccctagaacctaagtacgaacccgtaacgtcgaaacgtccgtaggaccgggaacgaccggaccaactaacgttaactttacgttaggtcgtacccgaccgtaaacccggtacgaccgttaacgtaaccccgacccgtaacggtaccggttaacggggaaaaccgttccgaaacccggtaaaccgtttcgggtaccccggtaaccccccggttaggggggacccccgtaaaccggggggttaaaccccctttacgggttaaccccgtaaccccgggtttaccccttaccccggttaccctaacccgggtaccccccttaaccccgggtaaccccggtaaaccccgggggtccccttaacccgggg

SEQ ID NO: 227493 - DNA, 615 bp, Homo sapiens
  misc_feature: GYAE6OF01A0BS2.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggtattactggtgcgggagccagtgttaggaagaaagaagtgtacacgtggtaaccaacgagatgccaggccaggcccctgtcgctggtcgtctatgatgatagtcgaccggcctgtcggactcccgagcgtattctacgtcgctaccgaagtcgtagggaaccaccggcccacccgtacaccctactcgacgacgaaggaccgacccgaaggtcggaagagtcggacgtctagtacttatttcgtagtacttaaggttcggaactatccgtacgtctcggtacggttcgtcggcgaccgtacgggaaccaacgtcgtaccggacccgtaccgtaagtcccgaacggaccccgaacggtcccgttccccggacccccgttagtacccgtacccttccggttcccccgg

SEQ ID NO: 227494 - DNA, 681 bp, Homo sapiens
  misc_feature: GYAE6OF01AUUQZ.47.53.E09.1.454.CMB.1.raw
  modified_base (226)..(226): a, c, t, g, unknown or other
  misc_feature (226)..(226): n is a, c, g, or t
tcagagctcacgtacacgaccggtgctcgatttagagagagtgtgttgggtttggggctgggcctaaggaagcagcactggtggtgcctcagccacctggcctggaccgttctcctcctcggcctcctctctcactgcacaggctctgtgacgtccgacgagctgattcaggccaccctcgatgtcagtcggccccaggacagacggccaggattactgtgcgganccagtgttggagaaagaagtgtacactggtaaccaacgagatcgccaggccgacggcccctgtgcgtggtcgtctatgatgatacgtgacccggcctcgtgggactccccgagcgtattcctctcggcctaccgaagtccgtagggaaccaccggccctacccgtggacccgtcgacggcgaacgggtcgacgggtcgggtactggacggtacgttatttacgtttttgacgtagggttggtgggtaagtactttaaggttttgtacttaagttcgttgggttcggtttaccggggacgggtaacggggtaaccgaagggtccgttacggtcccggttaccggttaccgggtaccgaccggtcccgaacggtcccggttcccggtccccccgttcgggttacccttacccggtttcccttccccggttacccccttccccgttcccgttacccgg

SEQ ID NO: 227495 - DNA, 966 bp, Homo sapiens
  misc_feature: GYAE6OF01D4GI1.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgaccgtccgacgagctgtattcgacggacctacccgttcgagttcggttaccgacgggttcccgggaccccccgaagggaaccgaacgggaacccgggaccgtaaggggttaacttttaaccgtttggggtacggggaccgggggtaacgtcccgtagggtttaggttagggaaaaggtaaaaggtaaggttacgtaaccgtaaccgttacgggtaaacccaaacgaaggtaacgtccggacccgaacgggtacccgaacccgggtcccccgttggtccggtccggtttcggggttaccgttaccgttagttaggtaacgttaggtaacgttacgggttacccgggtaacccccgggttcccgttaccgggtacgggtacccgttaccccccgggagtacccgttacgttttccgtcggttacgggtcccttaacccggtaaggttccggtaaacgggaacccgacccggtaccccgtacccgttacggacccgttacgaacggtccgggtaacggggtaccggtaccggggtacggggtacgtacggggtacggtttaccgttaagtttttacggttttcggacggtagggttgggtaacgggttacgttaaccgttttaagttttcggactttaggttagtttgggtttacgggtacggggtacgggtacggaaccgtacggtccgttaccggtacccggttccggtaccggtaccgtaaccggacccggtacggtccccgtccccggttaccccgtcccggttaaccttccgtttacccgtttcccccgggttcccctccccgttccggttaccgg

SEQ ID NO: 227496 - DNA, 686 bp, Homo sapiens
  misc_feature: GYAE6OF01DDNH5.47.53.E09.1.454.CMB.1.raw
  modified_base (640)..(640): a, c, t, g, unknown or other
  misc_feature (640)..(640): n is a, c, g, or t
  modified_base (663)..(663): a, c, t, g, unknown or other
  misc_feature (663)..(663): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagcttctctggtattttcactcagtagtactgggagaggctgggtcgggcgttcggggtccgtcgaaccggcccccgaagggaaacggccccgtagggtacggtgggtcttcgctactactagttttagttggggatgtatggtagtaaagtactacgacgtcctaattacttacgaagacggtctctactactaccaaccgaacggtaacctaaccttaacccaaaaaaccgtaggtcggttacctaacgaactaaactacgaaacccgaagtacgaacgccgtagaccggacgaccgacccaactagttactttagtcggtacaccaaccgtaccctaacggaccttaccgaaccgcgaacgtacgtaagggaaactaccggaacgtaccgtcgggttaccgccccggtacggggcccgaacggttaccctgtacccnccgttcctccgtcaccgtacccnccgacccgacggtccctacccgg

SEQ ID NO: 227497 - DNA, 645 bp, Homo sapiens
  misc_feature: GYAE6OF01BDVD1.47.53.E09.1.454.CMB.1.raw
  modified_base (227)..(227): a, c, t, g, unknown or other
  misc_feature (227)..(227): n is a, c, g, or t
  modified_base (374)..(374): a, c, t, g, unknown or other
  misc_feature (374)..(374): n is a, c, g, or t
tcagagctcacgtacacgaccggtgctcgatttagagagagtgtgttgggttgggtcgtggccgtaaggaagcagcactggtggtgcctccagccatggcctggaccggttctcctcctcggcctcctctctcactgcacaggctctgtgacgtccgacgagctgattcaggcaccctcgatgtcagtggcccccaggacagacggccaggatttacttgtgcgganccagtgttggagaaagagtgtacactggtaccaacagatgccaggccacggcccctgtgctggtcgtctatgatgatagtgacccggtcctgtgggactccccgagtcgatttcctcgtggcctacccgaagttcgtacgggaaccncccggcccaccccgttgacccggtcaggccgacggggtccgacgggtcggggagtacggacgggtaccgttatttagtttttcggtcgtagggttcggtgggtaactacgtttaagttttggtactaagttgttaggttggttacgggcgggtaacggaccgaagtctacggtcccgttccgtccggtaccgacgacccgtacggtccgtcccgtacccccgttcggtacctacccttcgttccccttcccccgtacccttcccgtacccg

SEQ ID NO: 227498 - DNA, 817 bp, Homo sapiens
  misc_feature: GYAE6OF01DH9QE.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttggaaggagtctggtccgacgcgtggtacgaaacccacacacgaccctcacgctgacctgcagtcttctcgttggtattttcactcaagttagtacgtggagaggcgtggtcgggcgtcggggtccgtcgaccggcccccgaagggaacggcccgtagggaggtcggtcgttcgctactcgtatttagtagggtatgtagtgtagtaacgtactacgtagtcctaattacgtttacgaagacgtactacgtaactacgtaactaacgaaacgtaactaacccgtaaaaccaaaacgtaacggtcgttaacctacgaactaagtacgaaccgtaacgtacgaacgtaccgtcgggaaccgaacgtaaccggacctaaacttaaagtttagttacgtttacggtaccgaaccgtaaacccgtaacccggtaaccgtaacccttaaccgtaaccccgtacccgtaacggtaccggttaaaacggggtaaaaccgtcccggtaaaccgttaacccgggttccgggttaacccccggggaaccccggtacgggggaaccccgttaacccggggttaaccccgttaccggtaccccgttaacccgttcccgttaccccgaccggtaccgttaccccccgaaccggttaaaccccgaaacccggggtcccccttaaccccggg

SEQ ID NO: 227499 - DNA, 779 bp, Homo sapiens
  misc_feature: GYAE6OF01C01LS.47.53.E09.1.454.CMB.1.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaggattacttgtgcggganccagtgttggagaagagtgtacacgtggtaccaanagatcgaccgaggccacggcccctgtcgctggtcgtctatgatgatagtcgacccggtcctcgtcgggactccccggagccgtattccgtcgtcggacctaccgtaagtcggtacgggaaccaccgggacccctacccgtcggaacccgttcgacggtccggtaacggggtaccggtaccggggtacgggggtaacgttcggggtaacgggttcccgtttaagtttacggtttttcggacggttagggttagggttaggggtaacgttaacgtttttaaggttttcgggtacttaacgtttagtttcgggttttcggggttaccggggtacggggttaaacggggtaacccgtaacgggtccggttaccgggttaccccggttcccggttaccgggttaccgaacccgggtaccccggtaacgggtccccgttcccggtccccccccggttagggttaccccgttacccgtttacccgtttaccccgttcccccccttacccgttccccgttacccgg

SEQ ID NO: 227500 - DNA, 691 bp, Homo sapiens
  misc_feature: GYAE6OF01AKSX3.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacgttgtggcgggagccagtgttaggagaaagagtgtacacgtggtaaccaacagatcgccaggccgacggcccctgtcgctggtcgtctagtgatgatacggtcgacccggtccctcgtcgggacctccccggagccgtattcgtcgtcggcctccgaagtcgtaggaaccgaccggccctacccgtcggaccgtcacggccgagggtcggacggtcggggagtcgggagggtccgttatttacgtttttggacgtagggttggtaggggactaacgtttagttttcggtatagttagtttcgggtttcgggttacgggcggggtaacgggtaccgtaacggcgttaccggtaccgtcccggttacggtaccggaccggtaccccggtaagggcccgttccccgggtccccccgttaccgggttcctacccgttcccgtttacccggttacccccctaccccgtttcccgttacccgg

SEQ ID NO: 227501 - DNA, 734 bp, Homo sapiens
  misc_feature: GYAE6OF01CJZ9H.47.53.E09.1.454.CMB.1.raw
tcagagctcacgtacacgaccggtgctcgatttagagagagtgtgttgggtttgggggactcctgtgccccacctatggacacactttgctccacgctcctgctgctgaccactcccgttcatgggtcttgtcccagatcaccttgaaggagtctcggtccgacgctggtcgaaacccacactacgacccttcacgctgacctgcagcttctcgtgtacttttcactcagtagtactggagaggctgtgggctgggtccgtacacgccccgaggaaacggcccgtggagtcggtcttcgctactctagtttacgtgggatcgattcggtagaacgtactacgacgtcctaattacgttacaaggacggtctactactactaccaaccgaaacggtacctaaccgttaaccgaaaaaccgtacggttacggtacctacgaaactaacgttacgaacctaacggtgaacgtcccgtaggacccgggaacaccggaccaactagttaacttagttcgtcgtacgtaacccgtaccgtacgtaccttaacggtaccccgacgtaacggtaccgttaacgggaaacttccggaaacctaccggttaccgggttacccggaccccgggtcggggtaccccgttaaccgggtaccccgttacggtacccgtacccggttccgtaccctaccggaacccgtaccccgtacccgaacccggtaaccgggtccccttaaccggg

SEQ ID NO: 227502 - DNA, 941 bp, Homo sapiens
  misc_feature: GYAE6OF01B496P.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtccagatcaccttgaaggagtctggtccgacgctggtacgaaacccacacacgaccctcacgctgacctgcagcttctcgtggtacttttcactcagtagtacgtggagaggtcgtggtgggcgttcggggtcccgtacgacccggaccccgaagggaaaccggcccgttgggacggtcggtcttcggacctacttcgtaagttttaggtagggtataggtagttgtaagtaacgtactaacgtacgtacctattaacgtttacgaaaggtacggtactacctaacttacgtaacccgaacgaaacggtaaccctaaacccgtttaaaaccgaaaaaaccgtaggttaccggttaccgtaaacgtaaccgtaaacgttaccggaaacccgtaaacggttaaccggaaaccggtacccggttacgggaacccggaaacccggtaacccggtaccgtaaaaccgttaattttaaacgtttaacggttttaccggaccgtaacccgaacccgtaacccgggtaactaaccccgttaaacggttaacccccggaaccgtaacccgggtaacggttaaaccggggtaaaaccgtacccgtaaaaccggtttaacccgggttacccggggtttacccccgggtaaaccccggggttcccggggggtaaaccccggttaaaccccggggttaaacccccgtttcccgtaccccggtttaacccccggttcccgttaccccggtaacccgtaccccggttacccccgttaaacccccggaacccccggggtaaacccgggtccccctttaacccccggggg

SEQ ID NO: 227503 - DNA, 587 bp, Homo sapiens
  misc_feature: GYAE6OF01AF1QW.47.53.E09.1.454.CMB.1.raw
  modified_base (364)..(364): a, c, t, g, unknown or other
  misc_feature (364)..(364): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggagaaagagtgtacactggtaccaacagatgccaggccaggcccctgtgctggtcgtctatgatgatagtgacccggccctcgtcgggactccccgagcgtattctctggcctcaagtctgggaacncggccaccgtcgaccgtcagcagggtcgacgtcggggatggaggtccgtattagttttgacgtaggtggtagggagtactttaagtttggtactagttattggtttcggttcgggcgggaacgggtaccaagtcgtcgaccgtccgtcggtcgacggtacccgaaggtcctccggtcccccgtggtccctactacccgttcggttcccccgtcccttaccccg

SEQ ID NO: 227504 - DNA, 568 bp, Homo sapiens
  misc_feature: GYAE6OF01DQM7X.47.53.E09.1.454.CMB.1.raw
  modified_base (223)..(223): a, c, t, g, unknown or other
  misc_feature (223)..(223): n is a, c, g, or t
  modified_base (314)..(314): a, c, t, g, unknown or other
  misc_feature (314)..(314): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattactgtgcgganccagtgttggagaaagagtgtacactggtaccaacagatgccaaggccaggcccctgtcgctggtcgtctatgatgatgtgaccgcctcgngggactcccggagcgattctcgtggctccgaagtctgggaacncggcccacctgacccgtcaacgngggtcgacggtcgggatcggagccgttattattttgcgaggtgtgggatattagttttgactatacttgttcgttcgggcgggtacggaccaaggtccgtagaccgttccgtcggtccgaacgcccgaacggctcggcccccgtcggtccaccgttccttccgttaccccgcccttccgtcttaccgg

SEQ ID NO: 227505 - DNA, 678 bp, Homo sapiens
  misc_feature: GYAE6OF01C4HFB.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctggtgggcgtgggtccgtcacgcccccgaggaaacggccctggagtggcttgcactcatttattgggatgatgtagaagtactacagtcattattcaagagctcactatccacaagacactacaaaacagtacgtctagaacaatacgaaccaagtcgaagcctggaccggaacaccggaccaactattaacttatcgtcgactaccgaaccgaccgacttaactaccgaccaggccgtaaggaactacgacgtaaacgtcggttaccgaccccggtacgggacccgaacgggtaaccctggtacctacccgtcctacctccgacgccctaccaaccgaccggccctacgtccggttccccttcccccgtacggcccctacccctacccgtaccgaaccgaccgtcccgaccgttcccgggacgggggtccaccggaacgggtccccggacccggttcgggccgtccggtaccggtacggtacccgtaaacggtacccgttaacccg

SEQ ID NO: 227506 - DNA, 666 bp, Homo sapiens
  misc_feature: GYAE6OF01APV5N.47.53.E09.1.454.CMB.1.raw
  modified_base (400)..(400): a, c, t, g, unknown or other
  misc_feature (400)..(400): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcgaggcaccctcgatgtcagtcggcccaggacagacggcaggtattacttgtgcgggacgccagtgttaggagaaagagtgtacacgtcggtaaccaacagatgccaggccacgccctgtcgctggtcgtctatgatgaagtagtcgaccggccctcgtcgggacctccccggagccgtacttctcgtcggcctaccgaacgtcgacggaaccaccggccaccgtcgacccgtnacggcgacgggtaccggacgggtcgggtagtcgggacggtaccgttagtttacgtttttggacgtagggtggtggtaagttacgtttaagttttgtacgttacgttagtttggtttacggttcggggacggggtaacggtaacgtacggccgtacggtacccgttccgtacggtacgaccggtaccgtaaccggtcggtcccgtaccccgttcggtaccctaccgttcccgttacccgtttaccccgtccccgttccgttacccgg

SEQ ID NO: 227507 - DNA, 663 bp, Homo sapiens
  misc_feature: GYAE6OF01ES4CI.47.53.E09.1.454.CMB.1.raw
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (624)..(624): a, c, t, g, unknown or other
  misc_feature (624)..(624): n is a, c, g, or t
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggtatttttcactcagtagtactggagaggctggtgggctgggtccgtcacgccccaaggaaacggccctggagtggcttgcactctatttagttgggatgatgtagaagtactacagtccatatttacaagngctcactanacaccaagactacctaaccaaaaacctaagtcgtcctagacaagtacgaaccgaacgtgaacgccgtacggaccggacaccggaccaactaatattattgtcacacacgacgtctacgacccgacacgacgtacggaaccgactaacgtcggttacccgacccggtcgggaccgtaccgggtaacccttcgtacctacccgttcctccgtccacgtccctaccgaccgaaccggccctacgtcccgttacccttcccccgtcgtccctacccctctacccgacgaccgtcctacccgtcgggtacggggacccacgaccggtcccggcccggtcgggtcnccggtccgtacggtaaccgaacgtcccgtaccgttaccg

SEQ ID NO: 227508 - DNA, 749 bp, Homo sapiens
  misc_feature: GYAE6OF01ASFRR.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcggagccagtgttggagaaagagtgtacacgtggtaccaacagatgccaggccaggcccctgtgctggtcgtctatgatgataggtcgaccggcctcgtgggactccccggagccgtattcgtcgtcggcctaccgaaagttccgtagggaaacctacccggggccctaccccgttggacccgtcgacgccgacggggtcgtacgggtcggggtatcgggaacggtccgttaagttacgttttttcggaccgtagggtttcgggtaggggtaacggttaacgtttaaacggtttttcggggtaccttaaggtttaaccgtttggggtttttacgggtttaccgggggtaccgggggtaacggggttaaaccccgtaaggtacccggttacggtaacccccggttccggtacgggttacccgaccggtacccccggtaaagggtcccgttcccgggtacccccccgttcgggttacccctaaccgttcccgtttcccggtttacccccccgtccccgtttcccgttaccccgg

SEQ ID NO: 227509 - DNA, 738 bp, Homo sapiens
  misc_feature: GYAE6OF01BLI9Z.47.53.E09.1.454.CMB.1.raw
  modified_base (600)..(600): a, c, t, g, unknown or other
  misc_feature (600)..(600): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtcgtggtccgacgcgtggtacgaaacccacacacgaccctcacgctgacctgcagtcttctcgtgtatttcactacagtagtacgtaggagaggtcgtggtgggcgtttttttcgggccgtacgaccgaccccgaaggaaacggcccgtgggagtcggtctcgctactctagtttagtggatggtagtggtagtaacgtactacgtacgtactattaacttacgaagacgtcctactaactacgtaccgaaacccgaaacggtaacctaaaccgttaaaaccctaaaaaaccgtaacggttacgtaccgtaagaacctaacgtacgaacctaacggtacgaacgtcgtacggaccgaaccgacggacctaaactaatttacgtagttcggtactacacccgtacgtaaccgaccttaaccgacccgccgtaacggacgtaacgggtaaacnccgtaaaccgtacggtccgggttaaccccgacccgggtccgggaaccgtacccgggtacccgtttcgacccgtaccccgttaccgtccgaccgtacccgacccttaacccgaaacccgccgggtacccgttaccccgg

SEQ ID NO: 227510 - DNA, 687 bp, Homo sapiens
  misc_feature: GYAE6OF01BSRFJ.47.53.E09.1.454.CMB.1.raw
tcagagctcacgtacacgaccggtgctcgatttagagagagtgtggttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctggtgggcgtcggggtccgtcacgcccccgaaggaaacggcccgtagggacgtggacttgacactctatttagtgggatggagtgtagtaagtactacgtacgtacctattatttacgaagtacggtctacactactaccaaaccgaaaggtaacctaaccttaacccaaaaaccgtagtacggtacctagaactaagtacgaaccgtaacgtagaaccggtcctaggaccggacgaccggacccaataacgttagttattagtacaccaccgaacccgacgtacctaacgtacccgacctacggtcgtaaggaaacttccgaacgtaacgtcggttacccggaccccggttcggggacccgtacgggtaacccctttggtacccgtcccggttcctacccgtccgtacgtaccccttaacccgaccccgaacgggtcccccttaccggg

SEQ ID NO: 227511 - DNA, 735 bp, Homo sapiens
  misc_feature: GYAE6OF01B68RY.47.53.E09.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (665)..(665): a, c, t, g, unknown or other
  misc_feature (665)..(665): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgaccgtccgacgagctgattcaggccacctcgatgtcagtcgccccaggacagacggcaggtattactgtggcgganccagtggttaggaagaaagagtntaacacgtaggtaaccaacagatcgaccaggccacggcccctggtcgcgtggtcgtctagtgatgatcgtcggacccgccctcgtcgggacctccccggagtcgtacttcctcgtcggtcctaccgtaacgtcggtaacgggaaccgacccggaccctaccccgtacgacccgtcgacggcggtacggggtccgacgggttacgggggatacgggaccgggttaccgttagttttacgtttttcggacggttaggggttagggttaacggggtagttaaacgtttttaacggtttttcggtaacgttagtttaacgttttgggtttacgggttccggggtaacggggtacgggaacctaacgggtcgttacccggtcccggtaccgtccggacgtaccggtacccgtagggttccccncccggttccccccgtacggttccctaccgttccccgttacccgtcccccttccccgtcccgttaacccgg

SEQ ID NO: 227512 - DNA, 726 bp, Homo sapiens
  misc_feature: GYAE6OF01EQZ28.47.53.E09.1.454.CMB.1.raw
  modified_base (225)..(225): a, c, t, g, unknown or other
  misc_feature (225)..(225): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctgatgtcagtggccccaggacagacggccaggattacttggtgcggganccagtgttggagaaagaagtgtacacgtggtaccaacagatcgccaggcccaggcccctgtgcgtggtctctatgatgatagtcgaccggtccctcgtcgggactccccgagcgtacttctcgtgctaccgagtccgtagggaacctccgggacccacccgtacggacccgtacgacggtacggacggggtccggtaaccgggtcgggggaactacgggtacgggtaccggttaagtttagtttttacggtacgtacgggttggttaggggtaagttacgtttaaagtttttggtactagtttacgttgggtttggtttaccggggacggggtaacggggtacccgaaggtccgttaacgggacccggtttcccgggtaccggtaccgttaccgggaccccgtaacgggtcccgttccccggcccccccgtttacgggttacccgtacccgtttcccggtttcccccggtttaccccccgtcccccgttccgttaccccgg

SEQ ID NO: 227513 - DNA, 790 bp, Homo sapiens
  misc_feature: GYAE6OF01CSERH.47.53.E09.1.454.CMB.1.raw
  modified_base (260)..(260): a, c, t, g, unknown or other
  misc_feature (260)..(260): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagcttctctggtattttcactcagtagtactggagaggctggtgggactcggggtccgtnacgccccgaaggaaacggccctaggagtggcttgacactctatttagtgggatgatgtagaagttactatacgtacctattatttacgaagtacggtctacgtacttaactaccaaccaaaggacctaacttaaccaaaaaacgtaaggtcggttacctaggaacctaaatacggtaacccaaacggttacgaacggtacccgtaggtaccggaaccgacgggtacccaaacgtaattactttaacgtttagtacgacctaaccgtacccggtaaccgtaccttaacgtaaccccggccgaaacggtaacccggggtaaagtaccgtaaacccggttaaacgttcccgggttaaccccggtacccccgggttaccggggggaaaccccgttaaaccggggtaaacccccgttttacgggtaccccgttaccccgggttcccctttaaccccgtcccgtacccggttccccttaaccccggtaaaccccggtaaaccgggggtccccccttacgggtttaaccccccgggg

SEQ ID NO: 227514 - DNA, 678 bp, Homo sapiens
  misc_feature: GYAE6OF01DP4C0.47.53.E09.1.454.CMB.1.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (295)..(295): a, c, t, g, unknown or other
  misc_feature (295)..(295): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctgatgtcagtcggcccaggacagacggccaggattacttgngcgganccagtgtgagaagagtgacactggtaaccaacgagatcgaccaggccacggcccctggtgctggtccgtntagtgatgataggtcgaccggtcctcgtcggactcccgagcgtacttctcgtcggccttaccgaagtcgtacgggaaccaccgggacccaacccgtcggtaacccgtacgacggtcggacgggtccggaacgggttcggggaagttaggacggtaccgttaatttagtttttcggtacgtacggggttggtacggggtattaacgttaagtttttcggtactaagtttagttgggtttcgggtaccgggttacggggaacggaccggtaaggcctaccgggtaacccgtccgttacggtccgaaccgggtccccgaagggtccctacccggtcccccgtacggtccctaccgttcccgtttcccgtccccgtcccctttcccg

SEQ ID NO: 227515 - DNA, 763 bp, Homo sapiens
  misc_feature: GYAE6OF01DL8WR.47.53.E09.1.454.CMB.1.raw
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagtcttctctggtattttcactcagtagtacgtggagaggcgtggtcggggcgttcggggtcccgtcgaccggaccccccgaagggaaacggcccgtgggaggtcggtcttgcctacttcttagttttagttgggtatggagtaggtagtaagtactacacgtacctaagttattacgaaggngctacactanccaacaacgactaactaaccaaaactagtcgtacagaacatacgaactaacgtagaacgtccgtagacggaacccccaggaccctaacgtaattaactttagttcggtacgaccctaaccgacccgtacgtacctaaccgtacccgaccgtaacggtaccgggtaacgggtaaacctacccggtaaaccgtaaccgggttcccgggttaacccccgggaaccccccgggttcggggggaaccccggtaaacccggggttaacccccgtttggttaacccccgtaccccggttccctaccccgtaccccgtaacccggtaccccccttaacccgggaaaccccgggaaccggggtccccccttaacccggg

SEQ ID NO: 227516 - DNA, 795 bp, Homo sapiens
  misc_feature: GYAE6OF01DDFSC.47.53.E09.1.454.CMB.1.raw
tcagagctcacgtacacgaccggtgctcgatttagagagagtgtgttgggtttgggggtcttgtcccagatcaccttgaaggagtctggtccgacgctggtacgaaacccacacacgaccctcacgctgacctgcagtcttctcgtggtacttttcactcgagttagtacgtgggagacggtcgtggtcgggcgttcggggtcccgtacgacccggacccccgaaagggaaacggtcccgtgggtacgtcggtccgttggcctaactcttaagttttaagtgggattggagttgtagtaacgtactacagtacctaattagtttaccgaaggtaggtctactaacttacaccaaccgtaaacggaactaaccgtttaaaaccgaaaaaccgtaggttccggtacctaagtaactaacgtacgaacccaagggttacaacggtaccgtacgggaccgaaccgaacgggaccctaagtaacggtttactttaacgtagccgtacaaacccgtaccggtactacgttaacgacccgtcaaggtcgtaacggaactccgaacgtacgtcggtccgaccgtcgggaccgtaacggtactcgtacgcccgttacgcctaccgcacccgtaccaacggaaccggcccttacgttccccggtcccgtaccccgtcgtaccccacccttaccgaacgtacgacctccccgtacgtcccgggaggtaccccgaagtcgggccccggtccggtacgggtctacccgggacgttaggtaaccccgttaaagggccccttttaacggg

SEQ ID NO: 227517 - DNA, 194 bp, Homo sapiens
  misc_feature: GYAE6OF01DROZE.47.53.E09.1.454.CMB.1.raw
  modified_base (191)..(194): a, c, t, g, unknown or other
  misc_feature (191)..(194): n is a, c, g, or t
tcagagctcacgtacacgaccggtgctcgatttagagagagtgtgttgggtttgggagactaatttggtcatatgttgttcggcggaggaccaagctgaccgtcctcggtcagcccaaggctcgcccccctggtcactctgttcccgccctcctctacgtgagctctgagcgggctggcaaggcgcatagnnnn

SEQ ID NO: 227518 - DNA, 689 bp, Homo sapiens
  misc_feature: GYAE6OF01CPXZP.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggtattttcactcagtagtactggagaggctgtgggctgggtccgtcacgcccccgaggaacgccctgggagtggcttgcactctatttagttgggatgatgtagaagtactacagtcctattattacaagaggctacactatcaaccaagactaaccttaccaaaactagtcggtacctagacaagtacgaaccgaacgtagaacgcctggaccggacaccggtaccagtacttattagttgtcacacaccgacgctacgtacccgcacgtcgtaggaactcgaacgtaccgttcggtaccgaccccggtcggggacccgtacgggtaacccttcgtacctacccgtcccttaccctcaaccgtcccctacccgaaccgtaaccgggacccgtaacgttcccggttacccctttcccccgtcccggaccctacccccgttccctacccgaacgaccgccgtacccgtcggacggggcccaacggaccggcccggtaccgtccgggtccgtaccggccgttaggtaccgacggttacccgttacccg

SEQ ID NO: 227519 - DNA, 603 bp, Homo sapiens
  misc_feature: GYAE6OF01EZYK0.47.53.E09.1.454.CMB.1.raw
  modified_base (361)..(361): a, c, t, g, unknown or other
  misc_feature (361)..(361): n is a, c, g, or t
  modified_base (404)..(404): a, c, t, g, unknown or other
  misc_feature (404)..(404): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccacggcccctgtgcgtggtcgtctatgatgatagtcgaccggccctcgtgggactccccgagcgtattctctggctccaagtcgtggaacncggccaccctcggaccgtcgagcgagggtccgacggtcggggntggaggtccgttattagttttgtcgtaggtgtagggagtaacttaagttttgtactattatggtttgttcgggacgggtaggtaccgaaggtccgtagaccggttccgtccggtacgacggacccgtaaggccgttcccggcccccctcgggtaccctacgttcccgttccgttcccccgtcccgttcccgttacccgg

SEQ ID NO: 227520 - DNA, 769 bp, Homo sapiens
  misc_feature: GYAE6OF01ADEZ7.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccgaggacaggaccggaccgaggtattacgttggtggacgggacgccgtaggtggttaggaaagaaacggtaagtcgtaacctacgtacggtaacccaacgaagatcgaccgtacgggccgaccggtccccgtgtcggtcgttacggtccgttcgtagtgtataggtaagttacggtcggaccccggtccctcggtacgggtaccctccccggagtcgtacttcgtcgtcgtactaccgtagtccggtaacggaccgaccgccctaccgtcggtaccgagacggacggacgggtcggacgggtcgggagtggtaacggttactttagtttacgttttcggcggtagggttggtacgggtatttaaccggttttagtttacgtagtttattggtttacggttcgggttaccggggtaacggggtaaccggtacctaacggtcccggtaccggtaccccggttccggtacccggtaccgtaccggtaaccccgggtacgtcccggttccccggtacccccggttcgtaccccgttaccgttcccgttacccccttcccccggtcctttcccggtacccg

SEQ ID NO: 227521 - DNA, 720 bp, Homo sapiens
  misc_feature: GYAE6OF01AF4XM.47.53.E09.1.454.CMB.1.raw
  modified_base (707)..(707): a, c, t, g, unknown or other
  misc_feature (707)..(707): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacgaggaccggccaggtatttaccgttggtggcggggacgccgtaaggttggtttagggaaagtaaaaggtaagggttgtaaccgaccgttacgggtaacccaaaccgaaggactaggcccgacggccacgggtcccctggtacgcgtcgggtcgtctatgtatgtagtcggtcgacccggtccctcggtcgggtacctccccggaggtccgtacgttccgtcgtacggtccctacccgtaaaggttccggtaccgggaaccgtacccgggacccctaccccggttacggacccgtacgacgggtacggacgggtacggtacggggtacggggagtacggacgggtacgttatttacgttttgacgtagggtggtaggtacgtacttaagtttgactagttgtaggttggtcgggtcggtacgacgagtcgtacgccgtccgtcggaccacgtacccggaggcccgtacctcccccggtagttccctacgttcccgttacccgttccccncccgttcgtaccg

SEQ ID NO: 227522 - DNA, 724 bp, Homo sapiens
  misc_feature: GYAE6OF01DKWL8.47.53.E09.1.454.CMB.1.raw
  modified_base (501)..(501): a, c, t, g, unknown or other
  misc_feature (501)..(501): n is a, c, g, or t
tcagagctcacgtacacgaccggtgctcgatttagagagagtgtggttggggtttgggggactcctgtcgccccaccatggacacactttgctccacgctcctgctgctgaccactcccttcagtgggtcttgtcccagtatccaccttggaaggagttcgtcggtccgacgcgtggtacgaaacccacacacgaccctcacgctcgacctgcagtcttcgttacgtggttactttcactcgaagtagtacgtggaggcggtcgtggtcgggtcgtcggggtccgtaccgacccgaccccggaagggaaccggtcccgtagggtacggtcggtcgttcgacctacgttcgttaagtttaggtagggtattagggtagttaggtaaggtaacgttaacgtacgtaacgtacgttaattacgttacgaagtacgtctaactactaacgaccgtaaacgaacgtaacctaacctaaaccgaaaacgtacggtacgtaccgtaanaaccaaagtaccgtaaccgtaacggtacgacgtaccgtcggaacggacgaccgaacgtactagttagttctacgcaccgaccacgtaactccgtacgccgacgtagacggtacgaacgacgtaacgtccgtacggtcccgaccgggtaccgaccggtaccgtaacgtccgtaccgtcccgtctccgaccgtactaccccgacgacccgtacggccttacccgg

SEQ ID NO: 227523 - DNA, 713 bp, Homo sapiens
  misc_feature: GYAE6OF01DXKBD.47.53.E09.1.454.CMB.1.raw
  modified_base (243)..(243): a, c, t, g, unknown or other
  misc_feature (243)..(243): n is a, c, g, or t
tcagagctcacgtacacgaccggtgctcgatttagagagagtgtgttgggtttgggggactcctgtgccccaccatggacacactttgctccacgctcctgctgctgaccactcccttcagtgggtcttcgtccagatccacgttgaaggagtcgtggtccgacgcgtaggtacgaaacccacacgacgaccctcgacgctcgacctgcagtcttctcgtgtactttcactcgagtagtacgngggtagagggtcgtggtcgggtcgtcgggtccgtacgaccggaccccgaacggaacggcccgtagggtacggtggtccttcggactacgttacgtagttttaggttagggtagtggtatggtagtaacgtacgtacgacgtacctattaacgttacgaagtacgtactacactacgtaacaacgaacggactaaaccgtaaaccaaaacgtacgttacgtactacgaactaactacgaaccgtaacgtcggaaacgtccgtacggaccgaaccgacgtaccagttaagtacttagttcgacgtacgaccgtaaccgtacgaccgttaacgacccgaggacgtacggtaacggtaacgtaccgtaacgtaccgttacggtacccgtacccgggtcggtaccggaaccggttacctaccgttacggcccttccgtccgtaccaccgtcccaccgaccgcggtcctacccggg

SEQ ID NO: 227524 - DNA, 822 bp, Homo sapiens
  misc_feature: GYAE6OF01A8G01.47.53.E09.1.454.CMB.1.raw
  modified_base (116)..(116): a, c, t, g, unknown or other
  misc_feature (116)..(116): n is a, c, g, or t
tcagagctcacgtacacgaccggtgctcgatttagagagagtgtgttgggtttggggactcctgtgcccaccatggacacactttgctccacgctcctgctgctgaccatcccttnatgggtcttgtcccagatcaccttgaaggagtctggtccgacgctggtacgaaacccacacacgaccctcacgctgacctgcagtcttctcgtgtacttttcactcgagtagtcgtggagtggctggtgggtctcgggtcctcaccgtacccgaggaacggtccgtggagtcggtcttacgctacgttcttaagtttaggtgggtattgtaagtggtacgtaacgttacgtaacgtacgttccttaaattacgtttaacgaagtacggtacccttacaaaccttacgtaacccgaaaccgaaacggtaaccctaaaacccgtttaaaccccaaaaaacggttacggttaccggtaaccctaagtaaaccgttaaaacgtaaccggtaaacccgtaacgggtaacggaaccggtaccgttaccgggaacccggtaaaccggtaacccggtaaccaaacgtttaacgtttacttttaacggtacgtaccgaacgtaacccggtaacccgtaaccgtaaccctaaccgtacccgtacgaaccggtacggtaacgggtaactaaccgtaacgtaacccggttcgggtaccccggtaaccccggtcggggaacccgttaccggtaaacccgtttccggtacccgtaccccgttcgtaccctaccgtacccgaccccgtaacccgacccggtaccggtaccccgttacccgg

SEQ ID NO: 227525 - DNA, 897 bp, Homo sapiens
  misc_feature: GYAE6OF01A4VJE.47.53.E09.1.454.CMB.1.raw
  modified_base (230)..(230): a, c, t, g, unknown or other
  misc_feature (230)..(230): n is a, c, g, or t
tcagagctcacgtacacgaccggtgctcgatttagagagagtgtgttgggtttggggctgggcctaaggaagcagcactggtggtgcctcagccatggcctggacccgttctcctcctcggcctcctctctcactgcacaggctctgtgacgtccgacgagctgattcaggccaccctcgatgtcaggtcggccccaggacagacggccaggtattacgtgtggcggganccgtaggtggttggaagaaaggaagtgtaacacgtggtaaccaacgagaactcgaccgacggcccacgggtcccccttggtcggtcgttcgggttaccgtacttagttacgagtggtaatacgggttacggaccccgggtcccctcggttacggggaacctcccccgggaagtccggttaactttcccgtccggttcgggtacccttacccggtaaacggttccggtaacggggaaacccacccggggtaaccccctacccccggttaggaaccccgttacgaacgggtaccgggtacgggggttacccggtaaaccggggtcggggggtaaccgttagggtacccgggtttaaccggttagttttacgttttttacggggaccgtttaagggggttggttaacggggaacggtttaaccgttttaaaggtttttcgggtaaccttaggtttaagtttcggggttttacgggttacggggtaccggggtaaacgggtaacccgtacgggtaccctacccgggttaacccggttcccggttaccgggtaaccccggtacggtaacccccgtaaggggttcccctaccccgggttcccccggttacggtttacccctaccgttccccgtttacccgttcccccccgttacccgttcccgttaaccccgg

SEQ ID NO: 227526 - DNA, 197 bp, Homo sapiens
  misc_feature: GYAE6OF01AFYVN.47.53.E09.1.454.CMB.1.raw
  modified_base (192)..(197): a, c, t, g, unknown or other
  misc_feature (192)..(197): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctggtcactctgttcccgccctcctctacgtgagctctgagcgggctggcaaggcgcaatagnnnnnn

SEQ ID NO: 227527 - DNA, 753 bp, Homo sapiens
  misc_feature: GYAE6OF01CJ9FJ.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacagctctgtgacgtccgacgagctgattcaggcaccctgatgtcagtcggcccaggacaggaccggccaggtattacgttgtggcgggagccagtggttaggaagaaagaagtgtaacacgtggtaaccaacgagatgccacggccacggcccctgtgctggtcgtctatgatgataggtcgacccggcctcggtagggactccccggagacgtactttcctcgtcggtcctacctaaggtcgtacgggaaaccctccgggacccctacccgtacggacccggttacgacggaccgtacggggtaccggtaccgggttacgggggaagttcggggtaacggtccgttaattttacggttttttcggacggtaggggttcggttaggggagttaaccgtttaaggttttcggtaactagtttaaggttcggtttcgggttaccggggacgggtaagggaaccgtaagggtccgtaaccgggtcccggttacccggtccgggtaaccgaaccggtccccggtaaacgggtccccgttcccgggtcccccccggtaccggttaccctaccggtttaacccgttcccggtttaccccccttaccccgtcccgtttaccgg

SEQ ID NO: 227528 - DNA, 775 bp, Homo sapiens
  misc_feature: GYAE6OF01D1LC0.47.53.E09.1.454.CMB.1.raw
tcagagctcacgtacacgaccggtgctcgatttagagagagtgtgttgggtttgggggactcctgtcgccccaccatggacacactttgctccacgctcctgctgctgaccatcccttcatgggtcttgtcccagatcaccttaggaaggagttcgtgggtcccgacgcgtaggtaacgaaaacccacaacaccgaccctcaccgctcgacctgcagtccttctcgtgttacttttcactcgtaagtacgtacgtagggaggcggtcgtgggtcgggtacggttcggggtcccgtacgacccggaccccggaaagggaaccggtcccgtagggagtcggtcttcgcctaacttacgttaagttttaggtgggatacggtagttcggtaagtaacgtaactacgtacgtacttattaacgttacgaagtcgtactactaactacaaccgaaaccgaaacggtaacccttaaacccgtaaaaaccgaaaaccgttagtaccgtacctaacgtaaactaacgtaccgtaaaccgtacggtaacgaaccgtaccggtacggaaccggtacccgaccgaaccgtaacttaagtttaagtttacgtcgtaacgacccgaactaccggtactaccgtaacacccggacgtacggacgttaacggaaacgttcgtaaccgtacggttaccggtacccggaccgggtaccggaacccggtacggtacccgtccgtaccgtaccgtcctaccgtccacgtcccaccaccggaccgtcccgtaccg

SEQ ID NO: 227529 - DNA, 633 bp, Homo sapiens
  misc_feature: GYAE6OF01D71VI.47.53.E09.1.454.CMB.1.raw
  modified_base (221)..(221): a, c, t, g, unknown or other
  misc_feature (221)..(221): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgaccgtccgacgagctgattcaggccacccgtcgatgtcagtcgccccaggacagacggccaggtattacttgnggcgggagccagtgtaggaagaaagaagtgtacacgtacggtaccaacgagatcgccacggccacggcccctgtcgcgtggtctctatgtactgtatagtcggacccgtcccgtgtacgggactcccgagacgctagtctcgtcgcctacgaacgtcgtacggaacgacccggacccaccgtcggacccgtacgacgaccggaacgggtccggacgggtcggggacgtggtacggtaccgtttagtttagttttcggtacggtagggttcggtagggtacgtagtttaagtttgtacgtattagttgtttgggttcgggacggtacgggtaacgtacggtcgtcggtaccgttccgtcgtcgacgcccgtacgcgtcccgccccgtcgtcacttcgtcctccccgtcctccg

SEQ ID NO: 227530 - DNA, 812 bp, Homo sapiens
  misc_feature: GYAE6OF01BC1NO.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtccagatcaccttgaaggagtctggtccgacgctgggtacaaacccacacacgaccctcacgctcgacctgacagtcttctctgtattttcactcagttacgtacgtaggagaggccgtggtcggggtcgttcggggtcccgtacgaccggacccccgaacgggaaacgggtcccgtagggtacggtgggtccttcggtacctacttcgttaagttttaggttagggtagttaggtagttaggtacggtaacgtaacctacgtacgtacctattatttacgaagtacgtactactactactacaaccgaacggacctaaaccttaaacccgaaaaaccgtacgtaccggtacctacgaacgtaacgtacgtaaccgtaacggtacgaacggtcccgtacggaccgggaacccggtaaccggacctaacgttaactttaacgttttacgttacgttaccggacccaaccggaaccggtaccgtaacttaccggtacccgaaccggtaacggaccgggttaacgggtaaaccttacggtaacgtaccggttaccgggttacccggtaccccgggtaccgggggaacccggtacccgggtaacccgttaccggtaccctcccgggttacctacccgtaccgtacccggtaccctacccgaaaccggtacccggaccccgttacccgg

SEQ ID NO: 227531 - DNA, 866 bp, Homo sapiens
  misc_feature: GYAE6OF01D8H2M.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgtaccctcacgctgacctgcagtcttctctggtatttcactactagtagtacgtggagaggtctggtgggtcgtcgggtccgtacgaccgaccccggaaaggtaacggcccgtagggtacggttcggtacctttcggacctaccgttacttaacgtttttaaggttgggtaactggtaaggttacggtaagtaacggtaaaccgtacgtaacgttacctaagtttaacgttacgttaaggaccggttacctaccgtaaacttaacgtaccgaaaccggtaaaccggtaacctaaacccgttaaaacccgaaaaaacggttacggttaccggtaacccgttaacgaaacgtaaacccgtaacggtaaacccgtaacggttaaccggaaccgttacccggtacggaaccgggtaaacccgaaaccgggtaccctaaagttacttaacgtttagttaccggtaacgacccaaccgaacccgtaccgaccgtttaaccgaacccggtaccgtaacgggtaccgtaaacggggaaacctttaccgggaaccgtaacgttcccgggttaaccccggaccccgggtaggggtaacccccggtaacggtaacccgtttcggtaccctacccggtcccgttacccaccgtaccggaccccttacccggacccggtacgggtccccttacccggg

SEQ ID NO: 227532 - DNA, 741 bp, Homo sapiens
  misc_feature: GYAE6OF01ERLV6.47.53.E09.1.454.CMB.1.raw
  modified_base (229)..(229): a, c, t, g, unknown or other
  misc_feature (229)..(229): n is a, c, g, or t
tcagagctcacgtacacgaccggtgctcgatttagagagagtgtgttgggttggggctgggcctaaggaagcagcactggtggtgcctcagccatggcctggaccgttctcctcctcggcctcctctctcactgcacaggctctgtgaccgtccgacgagctgattcaggccaccctcgatgtcagtcggccccaggacagaccggccaggtattacttggtggcgganccgagtgtggaagaaagagtgacacgtcggtaaccaacgagatcgaccacggccgacggcccctgtcgacgttcggtcgtctagtgtactgagtaggtccgacccgtcctcggtcggaccgtccccgagtccgtacttcgtcgcgtacctaccgtaggtcggtaacgggaaccgtaccgggaccccgtacccgtacggacccgtacgacggtccggtaacggggtacccggtaccgggtacggggtatcggggtaccggttaccgtttaatttacggttttcggtaccggtaggggttggttaacggggtaacgttaactttttaaacggttttggaccgttaagttacggtttgggttaccgggttacgggggtaccgggtaacggtaccgtaaggtcccgtacgggtacccttcggtaccggtacgacccggtacccgtaacgggtccctacccggccccgttacgtaccctaccgttcccttacccgtccccccgtcctccgttaccgg

SEQ ID NO: 227533 - DNA, 780 bp, Homo sapiens
  misc_feature: GYAE6OF01DONM2.47.53.E09.1.454.CMB.1.raw
  modified_base (251)..(251): a, c, t, g, unknown or other
  misc_feature (251)..(251): n is a, c, g, or t
tcagagctcacgtacacgaccggtgctcgatttagagagagtgtgttgggtttgggggactcctgtgccccaccatggacacactttgctccacgctcctgctgctgaccatccccttcagtgggtcttgtcccagactccaccttaggaacggtacgtcgtcggtcccgacgcgtggtaccgaaacccacacacgaccctcacgctcgacctgcacgtcttctgtgtatttcactcagtagtcgtggagnggtctgggtcggcgtcggtccacgaccgaccccggaaggaaccggtcccgtgggagttcggtccgttgacctactacttagttttacggtggataggtagttgggtaacgtaaacgtaccttaacgacgttacctaatttaacgttacgaaacgggacgtcttacctaaccgtactaaccgaaaccggaaaccgtaaccgtaacccttaaaaccccgaaaaacgtcggttaccgtaaccgtacgaaaccgtaacgtaaccggaaaccgtaacggtaacgacggtacccgtacggaaccgaacccggtaccggaacctaacgtacttttacgttacgttaccgtacgaccctaacccggacccgtaacgtaccctacgtacccgaccgtagtaccggtaaggaaaccttccgaacttaccggtccggtacccggtaccgggacggtacccgaacggttacccgtcgttacccgtaccgtccctccgtaccgaccgtaccccacccggaacccgacccggtccttacccgg

SEQ ID NO: 227534 - DNA, 738 bp, Homo sapiens
  misc_feature: GYAE6OF01AICAR.47.53.E09.1.454.CMB.1.raw
  modified_base (527)..(527): a, c, t, g, unknown or other
  misc_feature (527)..(527): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagcttctctggtattttcactcagtagtacgtggagaggcgtggtgggtcgtcgggtccgtcgaccggacccccgaagggaaacggcccgtggaggtggtcttgcactctagtttagttgggtatgtagtgtagtaagtactacagtacctattacgtttacgaaggacggtctactaactactaccgaaccgaaacggtacctaaccttaaaccaaaaccgtaagtcggttacctaacgaactaaacgtacgaaccgtaacggtacgaaacgtccgtacggaccggaacccgaaccgggaccaacgttaactttaatttacggttntacgacctaaccgaccgtacgtacctaacgtacccgacctaggtaccgggtaaggtaaaccgtaccgtaaccgtaacggttccgggttaccccgacccgggttccggggaacccgtaaccggggttacccttacggtacccgtaccccggttcccttacccgacccgtacccggtcccctacccgaaccggtacccgggccccttacccgg

SEQ ID NO: 227535 - DNA, 691 bp, Homo sapiens
  misc_feature: GYAE6OF01BZP2X.47.53.E09.1.454.CMB.1.raw
  modified_base (225)..(225): a, c, t, g, unknown or other
  misc_feature (225)..(225): n is a, c, g, or t
  modified_base (371)..(371): a, c, t, g, unknown or other
  misc_feature (371)..(371): n is a, c, g, or t
  modified_base (672)..(672): a, c, t, g, unknown or other
  misc_feature (672)..(672): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggcccccaggacagacggccaggattacttgtgcggganccagtgttggagaagaagtgtacactggtaccaacagactgccaggccaggcccctgtgctggtcgtctatgatgatagtcgacccggtcctcgtcgggactccccggagccgatttccgctggcctccaagtccgtagggaaccncggcccacccgtgacccgtcagcgagggtacgacggtcggggatcgggtacggtccgttaagtttagtttttggacgtagggttggtaggggtagttaacgtttaagtttttgggtacttaagttagttgggtttacggtttcggggacggggtaacgggtaacccgtaagggtccgttaccggaacccgggtttacgtttaccgggtacgtaaaccggcccccggtaaagggtccccgttaccggtcccccccggttacgggttaccctacccgtttcccgttcccggttttaccccccnccccgtttcccttacccgg

SEQ ID NO: 227536 - DNA, 772 bp, Homo sapiens
  misc_feature: GYAE6OF01EZKPO.47.53.E09.1.454.CMB.1.raw
  modified_base (248)..(248): a, c, t, g, unknown or other
  misc_feature (248)..(248): n is a, c, g, or t
tcagagctcacgtacacgaccggtgctcgatttagagagagtgtgttggggtttgggggactcctgtcgccccaccatggacacactttgctccacgctcctgctgctgaccactcccttcatgggtcttcgtcccagatcaccttgaaggagtctggtccgacgctggtacgaaacccacacacgaccctcacgctcgacctgcagtccttctcgtggtacttttcactcgagtagtacgtgggagnggcgtgggtcggtcggtcgggtccgtccgaccgacccccgaaggaaaccggccgtgggaggtcggtcgttgacctactcttagtttagtaggatgagtgtagtaacgttactacgtacgtacctagttaacttacgaagtacgtacctaccgtaactaactaccgaaaccgtaaaccggtaacctaaacccttaaaacccgaaaaaccgtacggttaccgtacgtaacgaaactaacgtaccggaaaccgtaacgtaacgaccgtaccgtacggaccggaaccgaaccgacgtaactaactttagttacgttacgtacgaccgaccgtaacccgtaccgaccgtaccgaccgtaccgacgtacggtaacggtaacgtaacgtaaccgtaaccggttaccggttaccccggtaccccggtaccgggtaacccggtaccggttacccgttaccgtaccgtcccgtacccgtcccgtaaaaacccgtcccgtacccgtacccgacccgacccggtcccgtaccccgg

SEQ ID NO: 227537 - DNA, 586 bp, Homo sapiens
  misc_feature: GYAE6OF01A753Y.47.53.E09.1.454.CMB.1.raw
  modified_base (372)..(372): a, c, t, g, unknown or other
  misc_feature (372)..(372): n is a, c, g, or t
  modified_base (444)..(444): a, c, t, g, unknown or other
  misc_feature (444)..(444): n is a, c, g, or t
tcagagctcacgtacacgaccggtgctcgatttagagagagtgtgttgggtttgggggggtcttgtcccagatcaccttgaaggagtctggtccgacgctggtgaaacccacacagaccctcacgctgacctgcagcttctctggattttcactcagtagtactggagaggctgtgggctggggtccgtcacgcccccagggaaacggccctggagtggcttgcactcatttattgggatgatgtgaagtactacagtccatatttcaagagctcactatcaccaagacacttaccaaaaaccagtggtcctagacaatcgaccaacgtgaacgcctgcgacaccggccacattatatgtcacacaccgacnctacaccgcagcgtaggaactcgacactggtccgacccgtgggccacggtacctgtccaccgtctcctcacncctccaccgacggcccacgtccggttccctccccgtcgccctacccctccgtaccaacgcgcctacccgtcggtcggggccaccggacggcccgggccccgttggggcctcggcccgttggtaccaacggttccttacccgg

SEQ ID NO: 227538 - DNA, 738 bp, Homo sapiens
  misc_feature: GYAE6OF01C85J9.47.53.E09.1.454.CMB.1.raw
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
  modified_base (324)..(324): a, c, t, g, unknown or other
  misc_feature (324)..(324): n is a, c, g, or t
  modified_base (714)..(714): a, c, t, g, unknown or other
  misc_feature (714)..(714): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctgatgtcagtcgcccaggacagcgcaggattactgngcggancagtgtgganaaagagtgtacagtgacaacngatcgaccagccaggccctgcncgtggtacgtctagtgatagataggtcgacccggtctcgtagggctaccccgancggtattccgtacgtcggtacctaccgtaaagtccgtaacgggaacctaccgggaccctacccgcggtaaacccgttcggacggaccggtacgggtaccgtacggggtacggggtagtacgggtaacggtccgtttaagttaccgtttttaggaccggtaggttcggtacgggaaacgtttacgtttaaaggttttcggaactttagttaagtttcgggtttaggttaccggggtgggtaaccgggtacgtaaacggtccggttaccggtaaccgggttccgttaccggaccgttaaccggacccggtaaccgggttaccgtcccccggttacccccggttaccgggtttacccgtaccccggtttacctttccccggggtttccccccnccccggttcccgtttaaccccggg

SEQ ID NO: 227539 - DNA, 748 bp, Homo sapiens
  misc_feature: GYAE6OF01BMSEX.47.53.E09.1.454.CMB.1.raw
  modified_base (262)..(262): a, c, t, g, unknown or other
  misc_feature (262)..(262): n is a, c, g, or t
tcagagctcacgtacacgaccggtgctcgatttagagagagtgtgttgggtttggggctgggcctaaggaagcagcactggtggtgcctcagcaatggcctggaccgttctcctcctcggcctcctctctcactgcacaggctctgtgacgtccgacgagctgattcaggcaccctcgatgtcagtggccccaggacaggacggccaggattacttgtgcgggagccgagtgttggagaaagagtgtacactggtaaccaanagatgccaggccaggccccagtcgctcgtacggtctacgtagtagagtagtaggtacgccggacccgtccgtacgggtacgtaccccgtaccggacgtcgtacttccgtcgtccgtctaacgtagtcggaaccggtacgacccgacctaccgtaccgacctaggacgtacgggtacgggtaccggtaaccggggtcggtaggtaccgggtaaccgggttactttaagtttttacggtttcggaacgggtttgggtaagggggtacggttaaccgtttagtttttaacgggtttcggttaactttaagtttacgggtttcgttttaaccgggggtacgggtaacgggtaacccggtaagaccggttcgtacccggttacccgttacggtaccggtaccggacccggaaccggtactcccgggtacccccctccggtttcccgacctttacccgtccgtttcccccggttcccctccctttacccggg

SEQ ID NO: 227540 - DNA, 549 bp, Homo sapiens
  misc_feature: GYAE6OF01APTFA.47.53.E09.1.454.CMB.1.raw
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaacggccctggagtggcttgcactcatttatgggatgatgtagagtactacacgtcatattcaagtaggctcactatcacagacactaccaaacagtgtctgacangacagtnagctgcgacacgcanatattattgngcacaccgacgctactacccgcacgacgtacgggaaactcgaactacgtcggttaccgaccccggtcggggacccaacggggtaaccccttcggtacctcccgtccttccctcgtaccgtccctacccgaacccgtacgggcccctacg

SEQ ID NO: 227541 - DNA, 733 bp, Homo sapiens
  misc_feature: GYAE6OF01DBF8J.47.53.E09.1.454.CMB.1.raw
  modified_base (297)..(297): a, c, t, g, unknown or other
  misc_feature (297)..(297): n is a, c, g, or t
tcagagctcacgtacacgaccggtgctcgatttagagagagtgtgttgggtttgggggagtctgggcctaaggaagcagcactggtggtgcctcagccatggcctggaccgttctcctcctcggcctcctctctcactgcacaggctctgtgacgtccgacgagctgattcaggcacctcgatgtcaggtcggcccaggacaggacggccaggattacgttgtgcggagccagtgttaggaagaaaaggagtgtaacacgtggtaaccaacaagaatcgaccaggccacggtccccnggtcgcgtcggtcgtactatacgatagatacggtcggaccgtcccgtcgtcgggactcccgagcgtacttcctcgtcgctacgtaacgtcgacggacacggtccaccgtcgaccgtcacggcgacgggtcggtaccggtccggggtaaggtgggtaacgggtacccgtttaagttttacgtttttcgggtacggtaacgggtttgggtaggggtaacgtttaacgtttaacggtttttggacgttaagtttaagttcggttttaacggggttcgggtaccggggaagggtaaccgtacggtacgtacggtaccccgttacccggttccggtaccggtaccggtacccgagggttccccgttaccccgggtacccccgttaccgggttacccttacccgtttccgtttaccccggtccccttaccccgtttaccccg

SEQ ID NO: 227542 - DNA, 829 bp, Homo sapiens
  misc_feature: GYAE6OF01A73W6.47.53.E09.1.454.CMB.1.raw
tcagagctcacgtacacgaccggtgctcgatttagagagagtgtgttggggtttggggctgggcctaaggaagcagcactggtggtgcctcagccatggcctggaccgttctcctcctcggcctctctctcactgcacgacggctctgtggacgtccgacgagctgattcaggccaccctgatgtcaggtcgaccccgaggaccaggaccggccgaggtattacgttggtggcgggacgtccgtaggttggttagggaaagtaaaaggtaagtcgtaactacgttacgggtaaccaaacgagacgtcgaccgtaacgggccgtaccggtccccttggtcggtccggttcgggttcgttacgttaggtacgtaagtggtaacgttacgggtaccgggtaaccccggtcccgttacggtacgggtacccttcccgggaacgtccggttaacgtttccgttccggttacgggtacccttacccggaaggtttcccggtaaggggaccccacccgggaccctacccggtacggaccgtacgacggtaccgggtacgggtccgggtaccgggtaggggtacgtagggtaacggtaccggtttaagtttacggtttttggacggtagggttacggggtacggtaaggttaacgtttaggttttacggtaagtttacgttaaggttcggtttcggggtacgggtacgggaacgggtaaccacggttccgtacggtacccgttcgtaccggtaccgaccggtacccgtacgggtccctccggtaccccgtaggtaccctacgtttacccgtaccttacccccgttcgtccgtaccgg

SEQ ID NO: 227543 - DNA, 850 bp, Homo sapiens
  misc_feature: GYAE6OF01BTQDJ.47.53.E09.1.454.CMB.1.raw
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggccaccctgatcgtcaggtcggcccaggacacggaccggccgaggtatttacgttggtcggcggggacgccaggttggttagggaagaaaaggtaaggttgtaaccacgtacggtaaccaaacgagtagtacggaccgacgggccgaccgggtccccgtggtccgtcgttacgggttccgtcgttaagtcggtataggagtacggtccggaccccggtcccgttacgggtcgggtacccgttacccggaggtaccgttactttaccgtcggtcggtacctacccggtaacggttcggtaccgggaaacctacccggggtaccccacccgtacggtaacccgttcggaacggaccgggtaacggggtccgaccgggggttacggggtaacggtacgggtaccgggttaccggtttaagtttacggttttttacggacgggttaaggggttcgggtaacggggtaacgttaacgttttacggttttacgggtacttaagttaacggtttcgggtttaccgggtacggggtaccgggaacgggtaacccgaacgttaccggttacgtaccggtcccgtaccggtaccggacggtaaccccggtacgtccggtccccgttcccccgtcggttaccctacccgtttcccgttaccccgttcccccggtccccttcccggttaacccg

SEQ ID NO: 227544 - DNA, 835 bp, Homo sapiens
  misc_feature: GYAE6OF01ENJT2.47.53.E09.1.454.CMB.1.raw
tcagagctcacgtacacgaccggtgctcgatttagagagagtgtgttgggttgggggactcctgtcgcccacatggacacactttgctccacgctcctgctgctgaccactcccttcagtgggtcttgtcccagactcaccgttaggaaggacgtcgtcgggtaccgacggtcgtaggtacgaaaacccacgacgaacgaccctcacgctcggacctggcacgtcttctcgtgttactttcacgtacgagttagtcgtaggagcggtcgtgggtgggcgttacgggtccgtcgacccgaccccggaaggaaccgggtcccgtagggagtcggtcttgcctagtctagtttaggtggtaactgtagtaggtagtaacgtaccgtacgtcgttacgtatttagttaaccgagtacgtccctaactacgtactaccgaaacgaacgtaaacccttaaccgtaaaacccgtaaaaacgtcggttaccggtactaacggaaacctaagtaccggtaacccgaaggtacgtaaccgcggtaaccgacgggttaaacccgccggaaccttaagtaacgttttacgttagtttccggactaccccgaacggtaaccccggtactaccgttaacgtacccgacggttaacggtaaccgttaaagggaaccttccgggttaaaaccggccggtttcccgggtaaaccccgggtcccggggttaccgggaaaccccggttaccgggtttaaccccttgggtaacccccgtccgttacccggttacccctaggaacccccgttaccccgaccggaaacccccggcgggttcccccgtttaacccggg

SEQ ID NO: 227545 - DNA, 715 bp, Homo sapiens
  misc_feature: GYAE6OF01BBR3R.47.53.E09.1.454.CMB.1.raw
  modified_base (334)..(334): a, c, t, g, unknown or other
  misc_feature (334)..(334): n is a, c, g, or t
tcagagctcacgtacacgaccggtgctcgatttagagagagtgtgttgggtttgggggactcctgtcgcccaccatggacacactttgctccacgctcctgctgctgaccatcccttcagtcgggtcttcgtccagactcaccttggaaggtagtctcggtccgacgctggtacgaaaccacacacgaccctcacgctgacctgcagtcttctcgtggtacttttcactcgagttagtacgtggaggtcggtgtgggtggcggtcggtccgtcgaccggaccccgaaggaacggccgtggacgtcggcttcgcgtacttctagtttacggtggngtagtagtgtagacgtacgtactactactagtacttacgagtagctacactacacaacgaacgacctaacgtaaactaaaccgtaagtcgtactagtaacagtacgaacgacgtagacgacgcgacggaccgacgacctaatagttacttaggtctacgaccgaacctacggacctaacgttaccaccggacgtacggtaccggtaaagaaccgtaacggtaaccgtaaccggttcccgggttaccggtaccggggtacccgggtaaacccggtaaccggggttccccttaacggtacccggttacccgtccccggtacccttacccggacccgttaccccgaaccccgtaaccgggacccggttaccccggttacccggg

SEQ ID NO: 227546 - DNA, 617 bp, Homo sapiens
  misc_feature: GYAE6OF01A3TT3.47.53.E09.1.454.CMB.1.raw
  modified_base (298)..(298): a, c, t, g, unknown or other
  misc_feature (298)..(298): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggacttacttggtgcgggagccagtggttggaagaaagaagtgtacacgtggtaccaacagatgccaggccacggcccctgtgctggtctntagtgatgatagtcggaccggcctcgtgggactccccggagcgtattcctctcggcctaccaaggttccgtagggaacctacgggcccacccgtcggacccgtcacggcgagggtcgacggtcggggagtacgggacggtaccgtagttattttggcgtagggttgtagggatacgttaagttttcgcgtattagtggttggttcgggacggtaaggacctaggtcgtcggacccgttccgtcggtacgacggcccgtaaggcccgtccggccccctcggtacctaccgttcttaccgtcccctcccgttccgttaccg

SEQ ID NO: 227547 - DNA, 717 bp, Homo sapiens
  misc_feature: GYAE6OF01A1MH5.47.53.E09.1.454.CMB.1.raw
  modified_base (575)..(575): a, c, t, g, unknown or other
  misc_feature (575)..(575): n is a, c, g, or t
  modified_base (689)..(689): a, c, t, g, unknown or other
  misc_feature (689)..(689): n is a, c, g, or t
  modified_base (694)..(694): a, c, t, g, unknown or other
  misc_feature (694)..(694): n is a, c, g, or t
tcagagctcacgtacacgaccggtgctcgatttagagagagtgtgttgggttgggggactcctgtgcccacatggacacactttgctccacgctcctgctgctgaccactcccttcagtcgggtcttcgtccgagactccaccttggaaggtagtcgtcggtccgacgcgtacggtacgaaacccacacacgccctcgaccgtctcgacctgctacgtctttcgtcgttgtacttttccactacgtagtacgtacgtaggaggaggtcgtgggtgggtcgttcggggtccgtaccgaccggaccccggaacgggaaaccgggtcccggtaggtacgggttcggtaccggtttacgacctacgttcggttagttttaagggttgggtaattggaacgtttttttaggaggtaacgtaacgtacgtacgtaccttaagttacgttactaggacgtactactaacgtactaccgaaacgaacgtaacctaacgtaaacccaaaacgtacgtacgtaccgagaacacgtaacgaaccgagtacgacgccgtacggacggaacacggtacctataagttnttaacgttcgcaccgacgtaccgtacgtactacgaccgcgacgtcgtaacggactacgaactactccgggtaccgaccgggtcggaccgtcgtaccgtcgtaccgtctccaccncgtcncccaccgaccaccgtccctaccg

SEQ ID NO: 227548 - DNA, 808 bp, Homo sapiens
  misc_feature: GYAE6OF01DXIJB.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagtcttctctggtattttcactcagtagtactggagaggctggtgggctgggtccgtcacgccccgaaggaaacggccctggagtggcttgcactctatttagtgggatgatgtagaagtactacagtcctattattacgaagagctacaactactaccaacgaacggacctaacttaaaccaaaaaccgtaggtcggtacctagaaactaagtacgaaaccgtaacgtacggaacgtccgtacggaccggaaccaccggaccaactaattactttagttcggtacaccgtaaccgaccgaacgtactaaccgtacccgactaggtaccgtaaagggtaaactcggaacgtaacgttccgggttacccggaccccggtacggggacccgtaacgggttaaccccgttcgtacccgtacccgttccgtacccctaccgtacccgtacccctaacccgaacccggaaccccgggtccctaacccggttaccccggttcccccgtttacccccgtacggtaccccctaccccttacccgtacccgaaccgtacccgtacccgtacccggttccgggaccgggggtacccaaccgggaccgggtacccgggccccgggtcgggtcccgttccgggtacccgttacgggtaacccgttaacggtacccgtttaaccccgg

SEQ ID NO: 227549 - DNA, 801 bp, Homo sapiens
  misc_feature: GYAE6OF01B99BQ.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacagaccctcacgctgacctgcagcttctctggtacttttcactcagtagtacgtggagaggctggtgggctcggggtccgtacgaccgaccccgaaggaacggcccgtaggaggtgcgttcgctactctaatttagtgggtatggtatagtagaagtactacgacgtacctaatacgtttacgaaggtacgtcctactaactactacctaaaccgaacggtaacctaacccttaaaacccgaaaaaccgtaacggttccggtaaccgttacgaacctaaacgtaccgaaccgtaacggtacgaacccggtccgtaacggacccggtaaccgacccggtaacctaacgttactttaagtttacggttacggacgtacccccgtaacggaaccccgtaaccggtacccttaaccgtaccccgtaccgtaacgggtacggttaacggggaaaaccttcccgggaaaccgttaccgggtttaccccgggttaacccggaccccggggttaccggggaaaccccggttaaccggggttaccccttacgggtaaccccgtacccgttcctaccccgtaacgtacccggcccctaaccccggaaccgggtaaccggtccccgttacccgg

SEQ ID NO: 227550 - DNA, 737 bp, Homo sapiens
  misc_feature: GYAE6OF01CHB3X.47.53.E09.1.454.CMB.1.raw
  modified_base (138)..(138): a, c, t, g, unknown or other
  misc_feature (138)..(138): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
tcagagctcacgtacacgaccggtgctcgatttagagagagtgtgttgggtttgggctgggcctaaggaagcagcactggtggtgcctcagccatggcctggaccgttctcctcctcggcctcctctctcactgcacnggctctgtgacgtcgacgagctgattcaggcaccctcgatgtcagtcggcccaggacagacggccaggattactgtgcggagcagtgtggagaaagaagtgtacacgtgtaccaanagatcgaccaggaccacggcccctgtcgngtggtcgtctagtgatgatagtcgaccgcctcgtcgggacctaccccggacgcgtacgttcgtcgtcggtcctacgaacgtcgtacgggaaccgaccggacccaccgtacggaccgtacgagccggtacgggtaaccggacgggttacggggagtacgggacggtaccgttaagtttagttttggacgttagggttacggtagggtaacgttaacgttttaagttttcggtacttaacgtttaaggtttcgggttacggttcggggtacggggtaacgggtaaccgtaaggtacgttaccgggtaacccgttccggtacccgttacggaacccggtaccccggtaaagggcccggttaccccggtccccccgtttacccgggttacccgtaacccggtttccccggtttcccggtttacccccccggttccccgtttccccgtttaaccccggg

SEQ ID NO: 227551 - DNA, 849 bp, Homo sapiens
  misc_feature: GYAE6OF01DGHHR.47.53.E09.1.454.CMB.1.raw
tcagagctcacgtacacgaccggtgctcgatttagagagagtgtgttgggtttggggggtcttgtcccagatcaccttgaaggagtctggtccgacgctggtagaaacccacacagaccctcacgctgacctgcagcttctctggtattttcactcagtagtacgtggagaggctggtgggtcgtcggggtccgtcaccgacccccgaagggaaacggcccgtggagtggtcttgctacttctatttagttgggatgatgtagaagtactacagtacctattatttacgaagacggctactactacgtacaaccgaacgaacctaacctaaccgaaaacctacgtacggtcctaagacaagtacgaaccgaacgtacgaacgccgtaggaccggacaccggaccactaactttatttaagttgtacgtaccaaccgaccggtaccgtacgtaaccctaccggtaccctaaggtaccggtaaacgggtaaactaccggtaaaccgttaccggttaccgggttaccccggtaccccggtaccgggggaacccggtaaccgggttaacccgttcgtacccgtacccggttccctacccgtaccgacccgtaccccgtaacccgaaccccggtaaacccgggccccgttaaccgttccccggttccccgtttccccccggtaccggtacccccttaacccccttacccgtacccgaacgtacccggtaccgtaccccggtacgggtaccggggtacccgacccggtacccgggtaccccgggtccccgggtacgggtcccgtccggttacccggtacgggttaacccggaaccggttaacccttaaccccggg

SEQ ID NO: 227552 - DNA, 603 bp, Homo sapiens
  misc_feature: GYAE6OF01CA7HI.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtagaaacccacacagaccctcacgctgacctgcagcttctctggattttcactcagtagtactggagaggctggtgggcgtgggtccgtcacgcccccagggaaacggcccgtggagtggcttgcactctatttagtggatgatgtagaagtactacagtaccattatttacaagacggctacgtactatacaaccgaaaggacctaacttaacccgaaaaaacctagttacggtacctagaacaatacgaaccaacggtgaacgccgtaggaccggaacaaccggccaactattaattagttgtacgaccacaacccgacgtcctaagtcccgaccagtccgtagggaaactcgaacacgtcggtaccgacccgtggggacccagggtaaccccttgacctcccgtctcctcacgccctaccaccgacggccctacg

SEQ ID NO: 227553 - DNA, 719 bp, Homo sapiens
  misc_feature: GYAE6OF01BHQ2K.47.53.E09.1.454.CMB.1.raw
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
tcagagctcacgtacacgaccggtgctcgatttagagagagtgtgttgggttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagaccggccaggtattactggngcggganccaggtgtaggaagaaagagtgacacgtgtaaccaanaggactggccaggaccacggtccccttaggtcgcgtcggtctctaagtgactgagtcggtcgacccgtccctggtacggacctccccggaagccgttattccgtacgtcggactaccgagtcgtacgggaacctacggacccacctggacccgtacacggacggtacgggtacggacgggtacggggtatcggggtacggtaccgtttagtttacgttttcgggacgtagggttgggtacgggtaacgttaacttttaaggtttggtacttacgtttagttcgggtttcgggtacggggtaacggacgggtaacgtaacggtccgttacgggtccccgttacggtccggttaccgaccggtacccgtacggttcccgtccccggtaccccggttcgtacccgttacccgtttccgtaccccggtttacccccctaccccgtttcccgttaccggg

SEQ ID NO: 227554 - DNA, 851 bp, Homo sapiens
  misc_feature: GYAE6OF01BGO6J.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtcgacgtccgacgagctgattcgaggccaccctcgatgtctaggtcggaccccaggacaggaccgggaccaggtactttacgttggtggcgggacgccgagttggttagggaagaaaggtaagtagtacgacgtacggtaaccaacgagactcggaccgacggccgaccggtcccctggtcgtcggttaggtccgtctagtagatagcgtacggaccggcccggtccgtacgtaccgggacctccccggagtccgttacgttccgtcgtccggtacctaccgtaacggtcggtaaccggggaaccgacccggtacccctaacccggtacgtacccggtaacgcgggacccggggtacgggtacccgggtaacggggttacgggggacgttacggggtaaccgggttaaccgttttggttttaacgttttgggtaccgggtaggggtttgggtaacggtagtttaaccgttttaggtttacggtacttaaggttttcggtttcgggttacggggttccggggaaccgggtaagggtaacccttaggggccgttaccggtaccccggttacgtaccgggtaccctaaccgggtccccggtaacgggttccccggttcccccggtccccgttaaccggttccccgttccccgtttaccccgggtttccccctttaaccccccgtaccccgtttccccgggttaaccgg

SEQ ID NO: 227555 - DNA, 925 bp, Homo sapiens
  misc_feature: GYAE6OF01D8KPL.47.53.E09.1.454.CMB.1.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgaccgtccgacgagctgattcaggccaccctcgatgtcagtcggcccaggacagacggccaggtattactgtgcggganccagtgtgagaagagtgtacatcggaaccaanagtancgccgacggccgacggcccctgtcgcgttgggtacgtctagtgactgaactacggtcggacccggtcctccggtcgggaccgtacccccggagtccgtacttccgttcggtcggtacccttaccgtaaacggttccggtaaccggggaacccgtaccccgggtacccccgtaaccccggttccggtaaccccggtaacgtaaccggggtacccggtaaccgggggttacccggggtaaccggggttaccggggggtaacggttacgggggtaaacccggggtttacccgtttaagtttttaaccggttttttgggtaccggttaaggggttttaggggttaaccgggggtttaaacgggtttaaaccgttttaaagggtttttttccgggtacgtttaaagttttacggttttcggggttttacgggttaccggggggttacggggggtaaaccgggtaaaccccggttaacgggtcccgttaccggggtaacccccgttcccggtttcccgggtaaccgtaccccggtaaccccgggtaacccgggtccccggttcccccggttaccccccgggttcccggttaccccgtttaccccgttccccgggttttcccccccggtttaaaccccccgtcccccccgtttaaccccggtttccccgg

SEQ ID NO: 227556 - DNA, 935 bp, Homo sapiens
  misc_feature: GYAE6OF01EUYC1.47.53.E09.1.454.CMB.1.raw
  modified_base (148)..(148): a, c, t, g, unknown or other
  misc_feature (148)..(148): n is a, c, g, or t
tcagagctcacgtacacgaccggtgctcgatttagagagagtgtgttgggtttgggggacgtcctgtgccccaccatggacacactttgctccacgctcctgctgctgaccatcccttcatgggtcttgtcccagatcaccttgaagngtctggtccgacgctggtacgaaacccacaccacgacccctcgacgctgacctgcagtcttctcgtgtacttttcactctagtagtacgtgggagaggtctgggtcgggcgttcggggtcccgtacgtaccgacccccgaagggtaaaccggcccgtagggtaggttcggtcttggcctaccgtacgtaacgttttaaggtcggaattcgaagttggtagtaaagtacctacgtacgttaccctaagtttaacgtttaccgaaaggtacgggttaccctaccgtaacgttaaccgttacccaaacccggtaaaacggggtaaccctttaaaaccccgtttaaaaaccccgtaaaaaaaaacccgtaacggggtttaacccgggttaaccccgttaaacgggaaaacccttaaaaccggttaaccgggaaaaccccgtaaaaccgggtttacggtaaaaacccggtcccggtttaacggggaacccccgggtaaaccggaaaccccggtacccgtaaacgtaaacgtttaaacgtttaacggttttcggtaaccgtaacccgtaaacccggttaacccggtaacccgtaaccgttaaccgttaccccgaaccgtaacggtacggtaaacgggtaaaccgtaccgaaacgtaccggttaccgggtacccggtaccccgggttacggggaaccccgtaacggggtaaccccgttggaaccccgtacccggttcctacccgtacggaccgtcccaaccccggtaaccgaacccgggtcccttaaccccggg

SEQ ID NO: 227557 - DNA, 741 bp, Homo sapiens
  misc_feature: GYAE6OF01D3S9X.47.53.E09.1.454.CMB.1.raw
  modified_base (410)..(410): a, c, t, g, unknown or other
  misc_feature (410)..(410): n is a, c, g, or t
tcagagctcacgtacacgaccggtgctcgatttagagagagtgtgttggggtttgggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacaggaccggccaggtattacttggtggcgggagccgaggtggttagggaagaaaaggaagtcgtacacgtaggtaaccaacagaatcgccgacggccgacggtcccctgtcgcgttcggtcgtctagtgatgatagtcggaccggtccctcgcgggacctccccggagcgtacttcgtcgtcggtcctacgtacggtcgtacgggaaccnccggaccctaccgtacggacccgtcgacgggccgtacggggtccgacggggtacggggagtcgggtacggtccgttaagtttgttttacggtcgtaggggttcggtagggtactaacgttttaaggttttcggtattagtttagtttgggtttacgggttaccggggtacgggtaacgggtaacccgtaagggtccgttaccgggtacccgttccggtaccgggtccggaaccggtaccccggtagggtacccgtccccgggtcccccgttccggtacccgtacccgtttcccgttaccccgtttccccccaccccgtttcgttaccccgg

SEQ ID NO: 227558 - DNA, 965 bp, Homo sapiens
  misc_feature: GYAE6OF01C5ZEX.47.53.E09.1.454.CMB.1.raw
  modified_base (134)..(134): a, c, t, g, unknown or other
  misc_feature (134)..(134): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctnactgcacaggctcgtgtgacgtccgacgagctgattcgaggccacccgtgagtgtcaggtccgaccccgaggacgacggaccggaccaaggtactttacgttggtacggacggggtacgaccgtagggttaggttaagggaaaaggtaaaaggtaacggttacggttaaaccgtaaccggttaaccgggtaaaaccaaaccggtaaaggtacgttaccgggacccggaaaccggggccccggtaaccgggttccccccgttagggtcgggtaccggttcgggttaccgttacgttaagttaggtagttaggtaacggttacggtacccggtaccccggttcccgtacgggtccgggtaacccgttccccgggaagtccgttacgtttccgtccggtacggtaccttaaccggtaggtaccgggtaacggtaacccgacccgtaccccgtaccggtacgtaaccggcgaccggacggacggggtaccggacggggtacgggtacgtacgggtaccggtttacggtttaagttttacggttttacggtacggtaggggttagggtacgggttaacgttaacggtttttaagttttcgggtaactttaaggtttacggtttcgggtttacgggtaccgggtacggggtaacggtaacgtacggtaccggttaccggtacccggttcccgggtacgtacccggtaaacccggtacccgggttaaaccggtccccggttaccccccgggtaccgggttaccccgtttacccggtttaaccccggttccccggtttttccccccgggtaacccccgtttcccccgtttaccccgggg

SEQ ID NO: 227559 - DNA, 763 bp, Homo sapiens
  misc_feature: GYAE6OF01CTM88.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctctctctcactgcacagactctgtgcctcctatgtactcgactcacgcctatcctcggtgctaggcggacccaggacaggaccggccaggtacttcccgtggtagggaacggaaaccaacgtagttacgggaaagtaagagttagtaactagtttacggtaaccaaacgaggaacggcctaacggcccgaacggccctaggtcgtaccgttcgggtacctcctaagtcgtatagaacgttacggacccggacccggtccgtacggaacggggtaccttcccgtaggaccgtccgtactttccgtcggtcgtacccttacgtaaacgttcggtaaccgggtaaccgacccggtaccctacccgttacgaacccgtctaccggaacgccggtaccggtacgtaccggaccggacgtacgtcggacggtaccgtaacgttacgtaccgtagtacgggtaggtagtacggtacgtaagttaagtcgtaacgtacgtaccggtacgtcggtttacgggttcggacgggttacggaactacggtaccgttccggtaaccggttaccgaacggtacgaaccggcccggtaacgccgttaccccggtccccggttacgtccctaacgtcccgttacccggttacccccg

SEQ ID NO: 227560 - DNA, 718 bp, Homo sapiens
  misc_feature: GYAE6OF01B6BUM.47.53.E09.1.454.CMB.1.raw
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggccaccctcgatgtcagtcggcccccgaggacagacggccaagggattacgttggtggcgggagcctaggtgttaggaagaaaggaagtgtaactacgtacggtaaccaacgagatcggaccagggcctacggccccgttgtcgtcgtggtcgttctagtgtatgagttaggcgacccggaccctcggtacgggacctccccggagtccgttagttcctcgtacggtccttaccgacggtcgtagggaaccacccggccctacccgtcgaacccgtgacggccgacgggtcggaacgggtcggggtagtcgggtacgtaccggttagtttacgttttagacggtagggttggtacgggtattaacgtttaagttttggtacttagtttagttcggtttcgggtacgggacgggtaacggtacgtaacggtcgtaccggtacccggttccgtacggtccgaccggtacccgaaggtcccgtccccgtcccccggtacgttacccctccgttcccgtttacccggttccccgttccccgttccgttacccgg

SEQ ID NO: 227561 - DNA, 925 bp, Homo sapiens
  misc_feature: GYAE6OF01CRWCJ.47.53.E09.1.454.CMB.1.raw
  modified_base (242)..(242): a, c, t, g, unknown or other
  misc_feature (242)..(242): n is a, c, g, or t
tcagagctcacgtacacgaccggtgctcgatttagagagagtgtgttgggtttggggctgggcctaaggaagcagcactgggtggtgcctcagccatggcctggaccgttctcctcctcggcctcctctctcactgcacaggctctgtgaccgtccgacgagctgattcaggccacctgatgtcgaggtcggaccccaggacaggaccggccaagggtactttacgttggtcggcggggtanccgtagtggttaggaagaaaagaaggtgtaacacgttacggtaacccaaacaggactcggaccgaacgggcccacgggcccccttggtcggccgtggggtttccgtacttaagtggtaacgtggacttacgggttaccgggaccccggtaccccgttgggtaccggggaacctccccccgggtaaggtcccgtacgttttccgtaccgttacgggtaccttaccgtaaggtacccggttacgggaaacccgttacccgggacccgtaacccggttacgggaaccccgttcgaacgggtaccgggaacggggttacccgggtaacggggtccgggggtaacttacgggggtaaaccggtttcccggttttaaatttttcggggttttttaacggtaccgggtttaaggggggtttaccgggttagggggtaaacgttaacggttttttaacggtttttaacggtcgtttaaacgttttacgggttagggttttaccgggggtttaccgggggtaacggggttaacgggtaaaccggtaaccggttcgttacccggggtacccggtccggttacccgggtacgtacccggacccgggttaacggtcccccgttccggtaccccccgttcgggttaccctcgggttaccctttcccgggtcccccctaccccgttccgttacccgg

SEQ ID NO: 227562 - DNA, 1014 bp, Homo sapiens
  misc_feature: GYAE6OF01EXPMO.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggcccaggacacggacggccaaggtattacgttggcgcgggacgtccgaggttggttaggaagtaaaaggtaagttcgtaaccgacgttacggtaaccaaacgaggtaacgtcggaccctaacgggtcccgaacgggtcccccttgggtcgtaccggttacgggtccgttacttacgtacggtacgttagtaacggtacgggttaccggtaaccccgggtccccttaccggttacgggtaaccgtacccccggtaggtacccggtacttttcccgtacggttcgggacccttaacccgtaaaacggggttccggttaacgggggaaacccgtaacccgggtaccccgtaacccggttaccggtaaccccggttacggaaccgggtacgggtaaccggggttaaccgggtaacccggggttacggggggtaacgttcggggaacgggtttaacccggtttaaacggttttacgttttttaccgggaacgggttaggggtttaggggttacgggggtaaaccgtttaaccgttttaaaggttttttacccggacgttaaaacggtttcggttttacgggtttacggggtttacccggggtaaccgggggtaaacgggttaacccggtaacgggtttccggtaacccgggtttaacccgggtttcccgggttacccgggtaaccgtaccccggggttaaacccccggtaacggtacccgggttaccccggttaccccccccgggttaaggttaccccgtttaaaccccggttacggtttaccccccgtttacccccgggttaaccccccttacccgtttaaccccgggg

SEQ ID NO: 227563 - DNA, 925 bp, Homo sapiens
  misc_feature: GYAE6OF01DFSUV.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgaccgtccgacgagctgattcgacggccaccctcgatcgtcaggtccggaccccgaggacacggcggacaggtattacgttggcggcgggagccgtggttgtagggaagaaaaggagtagtaccacgtacggtaaccaagagactcggacccgacggccgaaccggtccccgtggtgtccgtaggtcgtacttatgtatggaagttcggtccggaacccggtcccgtggtccggacccgtacccggacgtccgtacgtttcctcggttcgtcctaacccggtacgtccgggtaacgggaacccgtaccccgggtacccctaacccgtccggtaacccgtacggaccgggtacccgggtaacggggtacccggacgggggttaccggggacggttacggggaaccggtttaccgtttaagttttaggttttacgggtacggttaggggggttacgttagggtaaacggtttaaccggttttttaaagggttttaccgggtaactttaagggtttaacggtttttcgggggttttaccggggttacccgggggtaaccgggggtaaacgggttaacccgggtacggttacccggttaacccgggtccccggtttaccccgggtacccggttccgggtaaaccccggtaccccggtaaaccgggttccccccggttcccccggggttccccccccggttaccggtttaacccccggtcccgttttaaccccggttttccccccgggtttccccccccttaacccccggtttccccggg

SEQ ID NO: 227564 - DNA, 785 bp, Homo sapiens
  misc_feature: GYAE6OF01D1NGM.47.53.E09.1.454.CMB.1.raw
  modified_base (254)..(254): a, c, t, g, unknown or other
  misc_feature (254)..(254): n is a, c, g, or t
  modified_base (419)..(419): a, c, t, g, unknown or other
  misc_feature (419)..(419): n is a, c, g, or t
tcagagctcacgtacacgaccggtgctcgatttagagagagtgtgttgggtttggggagtctgggcctaaggaagcagcactggtggtgcctcagccatggcctggaccgttctccctcctccggcctcctctctcactgcacaggctctgtgacgtccgacgagctagattcacggcaccctcgatgtcaggtcggccccaggacagacgccaggtattctggtcggcggagccaggtgtaggaagaagtagngacacgtggtaaccaacagatcgccgaggacccgacggtcccctagtcgtcgtcggtccgtactagtgagtagtatacggtccgtaccccggtccttacgtcgggtaacctccccgaagtccgtacttccgtcgtacgtcctacgtacggtcgtacgggaacccnccggccctacccgtacgacccgtacgacggcggacgggttccggaacgggtcgggtacgtacgggtacggtacgttagtttacgtttcgggtacgttagggttacgggtagggtaacgtttaacgttttaacggttttcggtacgtaaggttttagtttcggggtttacgggtttaccggggacggggtaaccgggtaaccgtaccgggtacggttacccggtaaccccgggttttccggacccgggtaccggtaacccggtacccggacccgggttaccccggtccccggttacccccccggttaggttaccccccgttaccgttaccccgtttaccccggttcccccctaaccccgttccccgg

SEQ ID NO: 227565 - DNA, 899 bp, Homo sapiens
  misc_feature: GYAE6OF01AT10S.47.53.E09.1.454.CMB.1.raw
tcagagctcacgtacacgaccggtgctcgatttagagagagtgtgttgggtttggggcgtgggccgtaaggaagcagcactggtggtgcctcagccatggcctggaccgttctcctcctcggcctcctctctcactgcacaggctctgtgacgtccgacgagctgattcaggccaccctcgatgtcacggtcgccccgaggacacgaccggccaggtatttacgttggttggcggggacgaccgtaggttggttgggaaaggtaaaacggaacggttagtaaccgtacgttacggtaacccgaaacgtaaggtaacgtcggaccgacgggccgaccggtccccgtggttacgcggttcgggtccgtttactaacgttcggacttaggagttacggtaccggacccggttccctaggtcggaaccgttcccgaggtcgttacttcgtcgtcggtcctaccgaaggttccgtacgggaccgaccggtccctacccggttgacccggttagacggtaccgggtaccggggtccggtaccgggtcggggtacgtacggggtacggtaccggtttagtttacggtttttacggtacggtacgggttagggtacgggtaacggtttaacgttttaacggttttacggttacgttaacggtttaacggtttcgggttttacgggttaccgggggtacggggttaacgggaccgggttaacggtaccggtacccggttaaaccgggtttccccgggtaccggtaaccgggtaacccgggtaacccggttacccgggccccgtttccccgggtaccccccggtttaccgggtccccgttttaacccggttccccggtttaccccggtttacccccccggttccccggtttccccgtttaaccccgggg

SEQ ID NO: 227566 - DNA, 410 bp, Homo sapiens
  misc_feature: GYAE6OF01EHGCL.47.53.E09.1.454.CMB.1.raw
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (367)..(410): a, c, t, g, unknown or other
  misc_feature (367)..(410): n is a, c, g, or t
tcagagctcacgtacacgaccggtgctcgatttagagagagtgtgttgggtttggggctgggcctaaggaagcagcactgggtggtgcctcagccatggcctggaccgttctcctcctcggcctcctctctcactgcacaggctctgtgacgtccgacgagctgattcaggcaccctcgatgtcagtggccccaggacaggacggccaggattacttgtgcggganccagtgttggagaaagaagtgtacactggtaccaacagatgcaggccaggccctgtnctgtcgctatgatgatagtgaaccggccctctgggatccccggagccggaattctctggctccaagtctggaacncgaccccgnnnnnnnnnnnnnnnnnnnnnnnnnnnnnnnnnnnnnnnnnnnn

SEQ ID NO: 227567 - DNA, 766 bp, Homo sapiens
  misc_feature: GYAE6OF01EQGGC.47.53.E09.1.454.CMB.1.raw
tcagagctcacgtacacgaccggtgctcgatttagagagagtgtgttgggtttgggggactcctgtcgccccaccatggacacactttgctccacgctcctgctgctgaccatcccttcagtgggtcttgtcccagactcaccttaggaaggagtcgtggtccgacgcgtggtacgaaacccacacacgaccctcacgctgacctgcagtcttctcgtgttatttcactcagtagtacgtggagaggcgtggtcgggcgtcggtccgtacgaccgaccccggaaggaacggcccgtgggacgtggtcttgacctacttacgttagttttacggtagggtagtggtagtttaggtaacgtaacggtaacctaccgacgttccttaagtttaactttaacgaacggtcgtacctactaacgtactaaccaaccgaacgtaacctaaccgtaaaccgaaaacgtagttacgtctaagaactaagtacgaacgtagtacgaacgcgtaggacgaccgaccgactaacttagttaatttacgttacggacgtacccaaccggtacccgaacctaccgtaaccggtcccgaaccggtacggtacgtaacgggtaactacccggtaacgttaccgtaccgggttacccgacccgggttaccgggaacccgtaccggggttacccttaccggggacccttacccggtcccttaccccggtacctacccggaccccgttaaacccgcccgggtaacccggtccccgttacccggg

SEQ ID NO: 227568 - DNA, 1017 bp, Homo sapiens
  misc_feature: GYAE6OF01B16ZA.47.53.E09.1.454.CMB.1.raw
tcagagctcacgtacacgaccggtgctcgatttagagagagtgtgttggggtttgggggactcctgtcgccccacatggacacactttgctccacgctcctgctgctcgacctattccccttcagtcgggtcttcgtcccagactccaccttagaaggtgtcgtcggtccgacgtcgttagggtacaaaccccacaccacgaccctcacgtctacgacctgctacgttccttctcgttacgttacttttaccaccgttacgtaaggttacggtacgtaggggaaggtaccgggtcgttggggtcggggtccggttacgggggtcccgtaccgacccggacccccggaacggggtaaaccggtcccggtagggacggttcgggtaccgttcgtaccgtacttacgtttaagttttagggttaggggtaagtacggtaagttaggttaacggttaaccggttaaccttaacggtaacgttaaccgttaacgtttaacgtttaacggtaaacggtacgggtacctaacctaaacgttaccgtaaaccgtaaaccccggtaaaacgggtaacctttaaaccccgttaaaaccccggtaaaaccgttaacgggttaccggtaaccgtttaacggaaaccgtaacgtaacccgggtaaacccgtaacggtaaccggtaaccgggtaccgtaccggtacccggggaacccggtacccggtaaccgttaacgttaacgtttaacgtttaacggtttccggtaccgtaacccgtaacccggtacccggtaacccgtaacccgttaaccgtaaccccggtacccgaaggtacccccccccccggtaaagggtaaccggtaacccggtaaccgtacccgggttacccggtaccccgggtacccggtaccggggtaacccggtaaccgggttacccggttaccgttacccgttacccggtacccttacccggtacccgtaccggtaccccgtaccccggtaacccggtacccggtaccccgtacccggg

SEQ ID NO: 227569 - DNA, 881 bp, Homo sapiens
  misc_feature: GYAE6OF01ANS1X.47.53.E09.1.454.CMB.1.raw
  modified_base (149)..(149): a, c, t, g, unknown or other
  misc_feature (149)..(149): n is a, c, g, or t
  modified_base (204)..(204): a, c, t, g, unknown or other
  misc_feature (204)..(204): n is a, c, g, or t
  modified_base (455)..(455): a, c, t, g, unknown or other
  misc_feature (455)..(455): n is a, c, g, or t
  modified_base (826)..(826): a, c, t, g, unknown or other
  misc_feature (826)..(826): n is a, c, g, or t
tcagagctcacgtacacgaccggtgctcgatttagagagagtgtgttgggtttgggggactcctgtcgccccaccatggacacactttgctccacgctcctgctgctgaccactcccttcatgggtcttgtccagatcaccttgaaggngtctcggtccgacgcgtggtacgaaacccacacagacccctcaccgctcgtaccncgactgtccttctcgtaggttaacttttcacttacgtaggttacgtacgttacgggaggtacggcgttacgggtgggtaccgttcggggggtaccgtccgaacccggaacccccgaagggaaacccggtcccgtagggtacggttcgggtccttcggacctacgttaccgttagttttaggtgggtattgggtaattggtaacggtaacgttacctaacgtacggtacctaatttaccgtaagaacggtanccttaacgaacgtactaaccaacgaacggtaaccctaccgtaaaacgtaaacgtacggttactaccgggtataaacctaagtaccgtaaacgtaacggaccgtaaccgtcggtaccgaccgtaacgaaccgtaccgaacttaacgttaacttcgttacgggtaccgtaacccgaaccggtttaaccccgacgttacccgttaccggtaaaccaccccgggttaaatcccgggggttaaacgtaaacctacccggtttaacgaaacccgggtttcccggaaaccccgtacccggggtaccggtaaccgggttaaaccccgggttacccttaccgggtaccctaccccggtttaccctaacccggttaacccncccgtaaacccccgttacccgaaccccggttaaaccgggccccgtttaaccccgg

SEQ ID NO: 227570 - DNA, 746 bp, Homo sapiens
  misc_feature: GYAE6OF01B009V.47.53.E09.1.454.CMB.1.raw
  modified_base (146)..(146): a, c, t, g, unknown or other
  misc_feature (146)..(146): n is a, c, g, or t
tcagagctcacgtacacgaccggtgctcgatttagagagagtgtgttgggttgggcactcctgtgccccaccatggacacactttgctccacgctcctgctgctgaccatcccttcatgggtcttgtcccagatcaccttgaaggngtctcggtccgacgctggtacgaaacccacacacgacccctcacgctcgacctgcacgtcttctcgtggtacttttcactcaagtagtacgtggagaggtctggtcgggctcgggtccgtacgaccggacccccgaagggtaaccggtcccgtagggacggtcggtcttcggacctacttacttagttttacggtgggtatggtattaggtagtaacgtactacgtacgtacctatttattacgaaggtcgtacctactaacgtactaccgaaccgtaagtaacctaactaaaccaaaactagtacggtaccagactaactacgaaccagtacgacgtccgacgggaccgaacgacgacctaacgtactttaacgtttgtacgtacgaccctaaccgaccggtaaccgtctaaccgtaccccggacggacggtacggtaacgggtaaacctccggtaaaccgttaccggttccggggtaccccgtaaccccggggtaggggtaacccccggtaacgggttaccccgttacggtacccctacccggttcttaccccgcgtaacccgtaccccgtacccgaaaccgggtcccgggtaccccg

SEQ ID NO: 227571 - DNA, 878 bp, Homo sapiens
  misc_feature: GYAE6OF01D9V2Z.47.53.E09.1.454.CMB.1.raw
  modified_base (240)..(240): a, c, t, g, unknown or other
  misc_feature (240)..(240): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggccaccctgatgtcagtcggaccccaggacgacgaccggcctaaggtattacgttggtggacgggacnccgtaggttgttagggaaagaaaagtaaggttagtaacctaacgttacggtaaacccaaaacgaacggtaacgttacggacccgaacgggacccgaaccggccccgttggtccgtcggttacgggttccgtagttactggtaagtaggtaatacggtccggaaccccggtccccttacgggtcgggtaaccgtccccggagtaccggtacttccgtcgtcggacctaccgtaagtccggtacggaaccgacccggccctaccgtacggacccgtacgacgtaccggtacgggtccggtacgggtcgggtaagtcgggtacggttaccgtttaagtttaccgtttttgggtaccggttaggtacgggttaggtaacggtttaacgtttttaagggttttcgtacgttaagtttaggttttcggtttccgggggttaccggggaacggggttaaccggaacccgtacggttacccggttaacccggtaccccgggtttacccgtccggggttaacccggaacccgttaccccggggaaaccggtttccccggtaacccccgggtccccccgttaacggttccccgttaaacccttcccggttttacccccgttcccccccgttacccgtttacccccggg

SEQ ID NO: 227572 - DNA, 566 bp, Homo sapiens
  misc_feature: GYAE6OF01BXFMH.47.53.E09.1.454.CMB.1.raw
  modified_base (358)..(358): a, c, t, g, unknown or other
  misc_feature (358)..(358): n is a, c, g, or t
  modified_base (499)..(499): a, c, t, g, unknown or other
  misc_feature (499)..(499): n is a, c, g, or t
  modified_base (548)..(548): a, c, t, g, unknown or other
  misc_feature (548)..(548): n is a, c, g, or t
tcagagctcacgtacacgaccggtgctcgatttagagagagtgtgttgggtttgggggggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttaccaaaaaccagtcggtcctgacaatgaccaaccgtgaagcctgcgacacggccacatattattgtncacaccgacgctataccgccagctagggaatcgacaactggttccgaccccgtggggcccagggacccttgtccaccgtcctccctcacgccctccaccgaacgggcccagtccgtccttcccccgtcggcccaccctccncccaacgcgccgacctcgtcggggcacgcggcggcccgtgggctcgccngggtcacggtccttcccg

SEQ ID NO: 227573 - DNA, 994 bp, Homo sapiens
  misc_feature: GYAE6OF01BTUJV.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcagtgggtctcgtcccagactcacttgaaggtacgtcgtcggtccgacgcgtggtacgaaaacccacgacacgtaccctccacgcttacgacctgacacggtcctttcgtaccgttggttaacttttccactacggtagttacgttaccgtagggtagacgggtcgtaggttgggggtccttccgggggttccgtaccgtaccggacccccggtaaggggaaaccggtcccgtaggggtaacgttcgggtaccgtttacggaccttaccgttacgttaagttttcggttacgggtagttcggtagtacggttacggtaacgttaccgtacgttacgttaccgttaaatttacgttacgaaacggtaccggtcctacctaaccttaacgcccgaaacccgtaccggtaaccttaacccgtttaaaacccgaaaaaccgtacggttaccggtaaccttaacggaacgtaaaccggttaccggaaaccgtaaaccgggttacgtaaacccggtacccggtacggtaacccccgggtaaccggaacccggtaacccgtaaaccgttaagttttaaaccgttacgggtttaacggtaccgtacccggtaaccccgtaaccgggttaaccctaacccggttaaccggtaaccccgaccgggtaacggtaccccgggttaaagggtaacccgttacgggtaacccttaaacggggtttccccggttaaacccggggacccccgggttaaccgggggtacccgtaaacccggggttaaccccgtttaacccggccccgttaaacccgttccgttccccggaaccttacccccgggtaaccccgtaccccggaaaccgggttccccgggaaccccgtttccccggg

SEQ ID NO: 227574 - DNA, 812 bp, Homo sapiens
  misc_feature: GYAE6OF01BZDST.47.53.E09.1.454.CMB.1.raw
  modified_base (202)..(202): a, c, t, g, unknown or other
  misc_feature (202)..(202): n is a, c, g, or t
tcagagctcacgtacacgaccggtgctcgatttagagagagtgtgttggggtttgggggactcctgtcgccccacatggacactactttgctccacgctcctgctcgctgaccacttcccttcgagttgggtccttcgtcccagatccgaccttaggaaggtacgtcgtcggtcccggaacgtcgttgggtaaccaaacccncaaccacgaccccttcacgtctagacctgctagtcttcctgtagtttactttccatacgtagttacggtactgggaagtcggtgtagggtcgggtcgtaccggggtcccgtaccgacccgaacccgaacgggaacgtacccggtaggtacggtacgttctcgactaccttagttaaggtttagttacgggagttacgtaaggtccgtaaggtaaccttaccgtacgttacgtaccttaagttaacgttaacgtacggtaactccgtaacctaactacgtaaccctaaaccggaccgtaaacctaacctaaaccgtaaaacgttcggtaccgtacgtaagaacgacgttaacaaccgtagtacgaaccgtcgtacgacgtaacccgtactacgtacttagttactccgttagcctaaccgacgtaccggacgactaccgggtaccacgtagtacgtaacgtaactcccggaagtaccccggttccggtaaccgggtacccgtaccgggtacccggtacccgttaacccggtagttcccctaccgttcccggtaaccgacccgttaccccgtcccaaaccgggtcccctaccgggaccttaccccccggggg

SEQ ID NO: 227575 - DNA, 796 bp, Homo sapiens
  misc_feature: GYAE6OF01EU0V3.47.53.E09.1.454.CMB.1.raw
  modified_base (311)..(311): a, c, t, g, unknown or other
  misc_feature (311)..(311): n is a, c, g, or t
  modified_base (503)..(503): a, c, t, g, unknown or other
  misc_feature (503)..(503): n is a, c, g, or t
tcagagctcacgtacacgaccggtgctcgatttagagagagtgtgttgggtttggggctgggcctaaggaagcagcactggtggtgcctcagccatggcctggaccgttctcctcctccgcctcctctctcactgcacgaggctctgtgaccgtccgagagctgattcgacggcctacccgtgattgtcgtacggtccggacccccgaggacaggaccggaccgaaggtacttttacgttggtcggacgggacgaccgtaggttggttagggaaacgtaaaggtaagtcgtactagtacggtaaccaaagnggacgccgacggaccgacggcccgtgtcgcgttcggtccgtaccgtagtcgtaagtggtaacgtacgggtcccggaccccggtaccgttcgggtacgggtaccctccccggaagtcgttacttccgtacggtcggtcctaaccgtaggtacggtaccggaaccgtcccggaccccaccgttacgacccggtnacggtacgggtacgggcggacgggttacgggacgtacggaccggttaacgttagttttggtttcggacggttagggagggtcggtaaagtttacgtttaggtttttcgcgttaagttgttagggtttcggacggggtacgggtaacgacgtacggtccgttacgggtaccccgtacggttaccgccggaccgtacccggaaccggttcccgttcccccggtacccgtttccgtaccgtaccccgtttccggttcccccttaaccccctcccccggtttcgtacccgttacggg

SEQ ID NO: 227576 - DNA, 871 bp, Homo sapiens
  misc_feature: GYAE6OF01BFGZY.47.53.E09.1.454.CMB.1.raw
  modified_base (171)..(171): a, c, t, g, unknown or other
  misc_feature (171)..(171): n is a, c, g, or t
tcagagctcacgtacacgaccggtgctcgatttagagagagtgtgttgggtttgggggtcttgtcccagatcaccttgaaggagtctggtccgacgctggtacgaaacccacacagaccctcacgctgacctgcagcttctctggtattttcactcagtagtacgtggagnggctggtgggtcgtcggtccgtcgacgccccgaaggaaacggccgtggagtcggtcttgcactctagtttagtgggatgtatgtagaagtactacgtagtacctattactttacgaaaggtcggtctacatactccgaaaccaaggacctaaccttaaccaaaaacgtagtcgtacacgaactaacgtacgaacgtaacgtagaacgccgtacgaccggaacgaccggtacctaactattaacgttagttcgtacgtaccgaaccgtacccgtaaccgtacgtttaacccgaccgaccgtacggtacgtaacgggtaaactaccgtaaacgtaccgttaccggttaaccccggtaccccggtacggggtaacccgtaacccgggttaaccgtttacccggaccgttaaccccgttccgttacccgtaccgtaacccgtaccccgtaaccccgtaacccgggtaaccgggtacccccgttaacggtttccccccggtttaccccgttccccccgttaccggacccccttaacccccgtacccgtaacccgtaacggtaccccgtacccgtacccggtccgggttaaccgggggacccctaacgggtccccggtaccccggggttccccggtccggggtacccgttacccgggtaccggttaacccgggtaaccgtaaacccggtacccgtttaacccccgg

SEQ ID NO: 227577 - DNA, 731 bp, Homo sapiens
  misc_feature: GYAE6OF01DUVG4.47.53.E09.1.454.CMB.1.raw
tcagagctcacgtacacgaccggtgctcgatttagagagagtgtgttgggtttggggggtcttgtccagatcacttgaaggagtctggtccgacgctggtgaaacccacacagaccctcacgctgacctgcagcttctctggtattttcactcagtagtactgggagaggcgtggtggggcgttgggtccgtcacgcccccaagggaaacgggccctgggaggtggtcttgccacttctattttagttgggatgatgtagaagtactacgacgtcctatatttacaagagctcactatacaccaagacaacttacaaaaccgagtcgtacctagaacaagtcgaaccacgtagacgcgtagcgacgacgaccacattacttattgacacacaccgacgtactaactacccgacaggcgtagggaaactcgaaccgtaccgttacgggtaccgtaccccgggtcggggacccgtaaccggggtacccttacggtcccgtaccgttccgtccctcgaccgtccctacccgaaccgaaccggtcccacgttcccggttaccccgtttcccccggtcgtaccccgttaccccttcccgttacccggaacgtacccgacccgtacccgttcggggacggggtacccaccggcggtccccggggttcccgtaccggggttaccgtcccgggtaacccggttccgggttaaaccgtaaccggttcccgttaaccccgg

SEQ ID NO: 227578 - DNA, 887 bp, Homo sapiens
  misc_feature: GYAE6OF01C17VA.47.53.E09.1.454.CMB.1.raw
  modified_base (141)..(141): a, c, t, g, unknown or other
  misc_feature (141)..(141): n is a, c, g, or t
tcagagctcacgtacacgaccggtgctcgatttagagagagtgtgttgggttgggctgggctaaggagcagcacgtggtggtgcctcagccagtcggcctggaccgttctcctcctcggccttcctctctcacttgcacgnggtctcgtggtcgaccggtccgaacgtgctgaacttcgcgaccacccgttggatcgtctaggtcggcccaaggacacggaccggcctaaggtaactttcgtggtaggcgggagctaaggttgtaggaagaaagagttcgaactacgtacggtaccaaacgtgaagttcgaccgaacggaccgacggtcccctaggtcgccgttagggttaccgtacgtagtcgtacgtagtacggttacgaccggtccggtaccccgttgaacgggtcctacccggacgtacgttacttacgttccggtaccggtaccctaccggtaacgttaccggtaacggaaccgtacccggaccctaccgtacggtaacccgtgaacggcggtaacgggtaccgtaaccgggtacgggtaaggacggtaccggtttaaccgttaatttacgggttttacggtaggtacgggttagggtacgggtaaagttaacccggtttttaaggtttacggtaacgttaacggtttaacggttttcgggtttaacgggtttaacccgggggaccgggttaaacgggggacccttaaacggtcccgggtttaaccggtacccgggttttacccgggaacgttacccgggaacccggtaaacccggtacgggtccccggtttaacccctccccccggggttacgttaaccccggtacccgtttaaccgggttccccgtttaaccccccgggtcctttcccccgggttaaacg

SEQ ID NO: 227579 - DNA, 840 bp, Homo sapiens
  misc_feature: GYAE6OF01AYBH9.47.53.E09.1.454.CMB.1.raw
tcagagctcacgtacacgaccggtgctcgatttagagagagtgtgttggggtttgggggactcctgtgccccaccatggacacactttgctccacgctcctgctgctgaccatcccttcatgggtcttgtcccagatcaccttggaaggagtctggtccgacgctggtacgaaacccacacacgaccctcacgctacgacctgcagtcttctcgtggtattttccactctagtagtacgtggagtacggcgtggtggggcgttcggggtccgtaccgaccggtccccccggaagggtaaaccgggtccctaggggtagggttcggtccttggaaccacttacgttaacgttttaagttggggggtattcggttaagtggttaaggtaaaccgttaacgtacgtaccgtactaactttaacgtttaaccgaagggttaggtaccttactaaccgttaactaccgtaaacccgtaaacggtaaccctaaaccgtttaaaacccaaaaaaccgtggttaccggtaccttaacgaaacctaacgtaacgtaaccgtaacgtacgaaccggtccgtacggaccggtaccggtaaccgacccgtaaatacgtttaagttaacgttcgggtaccacccgtaactacccggtaccggtaaccctacgtaaccccgacgacggtaacgtaaccgggtaaactcccgtaacgtaccggttccgggttaccccggaccccggggttcggggaaccccggtaacgggttaccccgtcgtaaccccggtcccgttccctacccgtccgaacccgtcccctaaaccggacccgtaacccgggtcccttacccgg

SEQ ID NO: 227580 - DNA, 864 bp, Homo sapiens
  misc_feature: GYAE6OF01CPX1P.47.53.E09.1.454.CMB.1.raw
  modified_base (290)..(290): a, c, t, g, unknown or other
  misc_feature (290)..(290): n is a, c, g, or t
tcagagctcacgtacacgaccggtgctcgatttagagagagtgtgttgggttgggctgggcctaaggaagcagcactggtggtgcctcagccatggcctggaccgttctcctcctcggcctcctctctcactgcacgaggctcgtgtgaccgtccgacgagtcgtgattcgaggccaccctcgatgtcgagtccggaccccgaaggacacgggaccgccgaaggtatttacgtggtcggacgggacgcctaaggtgtaggaaagaaagagtcgacacgtaggaaccaaanagactcgaccgacggaccgaccggccccgtgtcggtacctgggttctacgtagtacgtagtaggaacttacgggccgaccccggttcccgtacgggtaaccgggtcccgtacccggaacggtcgttaccggtttcctaaccgggttcgaccccgttacgtaaaccgggtttcggaaaccgggaaccccgtacccgggtcccccgtaaaccggacccggtaccgtaccggaaacgggtccgggtaacgggggtacccgggtacgggggaaccggggtcgtttacggggaacccgggtttaccgtttaagttttacgggttttaccgggacggttacgggggtacggggtttaaggtaaccggtttaaacgttttacggttttacggtaactttggttttacggttacggggttttaccgggtacgggggtaccgggtaaacggtaaccggtaaggtccgttaccggtaccccggttacggtccggtacgtaacccggtaacccgtacggcccgttaccccggcccgtttgaccccttcggttacccgtccccgttcccctacgttcccgttacgg

SEQ ID NO: 227581 - DNA, 973 bp, Homo sapiens
  misc_feature: GYAE6OF01ESRNG.47.53.E09.1.454.CMB.1.raw
tcagagctcacgtacacgaccggtgctcgatttagagagagtgtgttgggttggggggtcttgtccagatcaccttgaaggagtctggtccgacgctggtgaaacccacacagaccctcacgctgacctgcagcttctcgtggtattttcactcagtagtactggagacggctggtcgggtcgtcgggttaccgtcgaaccgacccccggaaagggaaacggtcccgttagggacggttcggtcttcggccgtaacttaccgttaagtttttaaagtcggggtaattaggattacggttacggaaaagttacctaacgtagttacccaagtttaacgtttaacgaaaggacggtaccttactaaacgtactaaccgaaccgtaaacggtaacctaaaccgttaaacccaaaaaaaccttaagggtacggtaacccgtaaggaaacctaaacgtacgtaaccgaaacgtacggtaaacgtaccgtacgggaccgtaacgaccggaccgtaactaacttaacggttaacttacggtacggaaccctaaccgaacccgtaaacggtaaccttaacccgaacccgtaccgaacggtacgtaaacggggtaaactaaccggtaactaaaccggttccgggttacccggaaccccggggtcggggtaacccgtaaaccggggtacccgttacggttaccccggtaaacccgtccttacccgtaccgtaacccggtccctaacccggtaaaccccggaaccggtaccccgttaaccggttaccccgggtttaaccccgtttcccccgggtaacccggtacccccgttaaccccgttacccgttaacccggaaacgggtaaacgtaccccgttacccggtacgggtacggggacccgtaacgtccgggccccgggtacccgtacgggtaccgtcccgttacgtaaccggggtacctaaaaccggggttccctttaacccgg

SEQ ID NO: 227582 - DNA, 185 bp, Homo sapiens
  misc_feature: GYAE6OF02JFDGU.47.53.E09.1.454.CMB.1.raw
  modified_base (185)..(185): a, c, t, g, unknown or other
  misc_feature (185)..(185): n is a, c, g, or t
tcagagctcacgtacacgaccggtgctcgatttagagagagtgtgttggttggagactaatttggtcatatgttgttcggcggaggaccaagctgaccgtcctcggtcagcccaaggctgcccctcggtcactctgttcccgcctcctctacgtgagctctgagcgggctggcaaggcgcatagn

SEQ ID NO: 227583 - DNA, 191 bp, Homo sapiens
  misc_feature: GYAE6OF02GJXVE.47.53.E09.1.454.CMB.1.raw
  modified_base (189)..(191): a, c, t, g, unknown or other
  misc_feature (189)..(191): n is a, c, g, or t
tcagagctcacgtacacgaccggtgctcgatttagagagagtgtgttgggtttgggagactaatttggtcatatgttgttcggcggaggaccaagctgaccgtcctcggtcagcccaaggctgcccctcggtcactctgttcccaccctcctctacgtgagctctgagcgggctggcaaggcgcatagnnn

SEQ ID NO: 227584 - DNA, 137 bp, Homo sapiens; identical to SEQ ID NO: 227380
  misc_feature: GYAE6OF02HDNO0.47.53.E09.1.454.CMB.1.raw
  modified_base (137)..(137): a, c, t, g, unknown or other
  misc_feature (137)..(137): n is a, c, g, or t

SEQ ID NO: 227585 - DNA, 189 bp, Homo sapiens
  misc_feature: GYAE6OF02FFTAZ.47.53.E09.1.454.CMB.1.raw
  modified_base (189)..(189): a, c, t, g, unknown or other
  misc_feature (189)..(189): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgcccctcggtcactctgttcccgcctcctctacgtgagctctgagcgggctggcaaggcgcatagn

SEQ ID NO: 227586 - DNA, 171 bp, Homo sapiens
  misc_feature: GYAE6OF02HP4L9.47.53.E09.1.454.CMB.1.raw
  modified_base (171)..(171): a, c, t, g, unknown or other
  misc_feature (171)..(171): n is a, c, g, or t
tcagagctcacgtacacgaccggtgctcgatttagagagagtgtgttgggtttggggaagaggaagactgacggtccccaggagttcaggtgctgggcacagcggccctgggctgcctggtcaaggactacttcctacgtgagctctgagcgggctggcaaggcgcatagn

SEQ ID NO: 227587 - DNA, 192 bp, Homo sapiens
  misc_feature: GYAE6OF02JP4M9.47.53.E09.1.454.CMB.1.raw
  modified_base (189)..(192): a, c, t, g, unknown or other
  misc_feature (189)..(192): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgcccctcggtcactctgttcccgcctcctctacgtgagctctgagcgggctggcaaggcgcatagnnnn

SEQ ID NO: 227588 - DNA, 524 bp, Homo sapiens
  misc_feature: GYAE6OF02HA44I.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctctgggatccccgagcgattctctggctccaagtctgggaacacggccaccctgacccgtcagcagggtcgacgtcggggatgaggccgtatattttgtcaggttgtgggagactaattttggtctatatgttgttcggcggagggaccaagctgaccgtcctcggtcagcccaaggctcgcccctggtcactctcgttcccgcctcctccg

SEQ ID NO: 227589 - DNA, 190 bp, Homo sapiens
  misc_feature: GYAE6OF02GXPSE.47.53.E09.1.454.CMB.1.raw
  modified_base (190)..(190): a, c, t, g, unknown or other
  misc_feature (190)..(190): n is a, c, g, or t
tcagagctcacgtacacgaccggtgctcgatttagagagagtgtgttgggtttgggagactaatttggtcatatgttgttcggcggagggaccaagctgaccgtcctcggtcagcccaaggctgcccctcggtcactctgttcccgccctcctctacgtgagctctgagcgggctggcaaggcgcatagn

SEQ ID NO: 227590 - DNA, 213 bp, Homo sapiens
  misc_feature: GYAE6OF02G7IQM.47.53.E09.1.454.CMB.1.raw
  modified_base (193)..(213): a, c, t, g, unknown or other
  misc_feature (193)..(213): n is a, c, g, or t
tcagagctcacgtacacgaccggtgctcgatttagagagagtgtgttggggtgtgggagacctaatttggtcatatgttgttcggcggagggaccaagctgaccgtcctcggtcagcccaaggctgccccctcggtcactctgttcccgccctcctctacgtgagctctgagcgggctggcaaggcgcatagnnnnnnnnnnnnnnnnnnnnn

SEQ ID NO: 227591 - DNA, 190 bp, Homo sapiens
  misc_feature: GYAE6OF02GQMDA.47.53.E09.1.454.CMB.1.raw
  modified_base (177)..(190): a, c, t, g, unknown or other
  misc_feature (177)..(190): n is a, c, g, or t
tcagagctcacgtacacgaccggtgctcgatttagagagagtgtgttgggtttgggggaaggaggaagactgacggtcccccaggagttcaggtggctgggcacagcggccctggcctgcctggtcaaggtactacttccgtacgtgagctctgagcgggctggcaaggcgcatagnnnnnnnnnnnnnn

SEQ ID NO: 227592 - DNA, 513 bp, Homo sapiens
  misc_feature: GYAE6OF02JEIA2.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaggccctggagtggcttgcactcatttattgggatgatgtgaagtactacagtccatatttcaagaggctcactatcaccaaggacacttaccaaaacagtgtcctgacaatgaccaacgtgaagcctgcggacacggccacatattattgtgcacaccgacgctataccgccagctgggaaatcgacactggtcgaccctgggccagggacccttgcaccgtctcctcacgcctccaccacggcccacg

SEQ ID NO: 227593 - DNA, 195 bp, Homo sapiens
  misc_feature: GYAE6OF02JTWJO.47.53.E09.1.454.CMB.1.raw
  modified_base (192)..(195): a, c, t, g, unknown or other
  misc_feature (192)..(195): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccaccctcctctacgtgagctctgagcgggctggcaaggcgcatagnnnn

SEQ ID NO: 227594 - DNA, 509 bp, Homo sapiens
  misc_feature: GYAE6OF02GBQA8.47.53.E09.1.454.CMB.1.raw
  modified_base (424)..(424): a, c, t, g, unknown or other
  misc_feature (424)..(424): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttatgggatgatgtgaagtactacagtccatatttcaagaggctcactatcacaaggacacttccaaaaacagtgtcctgacaatgaccaacgtgaagcctgcggacacggccacatattattgtgcacacgacnctataccgcagctgggaatcgacacgtgttcgaccctgggccagggacccttgcaccgtntccncacgcctcaccaggccctacg

SEQ ID NO: 227595 - DNA, 519 bp, Homo sapiens
  misc_feature: GYAE6OF02GTDUN.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctctgggatccccgagcgattctctggctccaagtctgggaacacggccaccctgaccgtcagcagggtcgacgtcggggatgaggccgtatattttgtcaggtgtgggagactaatttggtcatatgttgttcggcggagggaccaagctgaccgtcctcggtcagcccaaggctcgcccctcggtcactctgttcccgccctcctc

SEQ ID NO: 227596 - DNA, 533 bp, Homo sapiens
  misc_feature: GYAE6OF02HTE4D.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggccctctgggatccccgagcgattctctggctccaagtctgggaacacggccaccctgacccgtcagcagggtcgacgtcggggatggaggcgtatattttgtctaggtgtgggagactaattttggtcattattgttgttcggcgggagggaccaaggctgaccgtccgtcggtcacggcccaaggctcgcccctcggtccactctcgttcccaccctcctccg

SEQ ID NO: 227597 - DNA, 192 bp, Homo sapiens
  misc_feature: GYAE6OF02G70L9.47.53.E09.1.454.CMB.1.raw
  modified_base (192)..(192): a, c, t, g, unknown or other
  misc_feature (192)..(192): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccgccctcctctacgtgagctctgagcgggctggcaaggcgcatagn

SEQ ID NO: 227598 - DNA, 193 bp, Homo sapiens
  misc_feature: GYAE6OF02JGVHO.47.53.E09.1.454.CMB.1.raw
  modified_base (192)..(193): a, c, t, g, unknown or other
  misc_feature (192)..(193): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccaccctcctctacgtgagctctgagcgggctggcaaggcgcatagnn

SEQ ID NO: 227599 - DNA, 568 bp, Homo sapiens
  misc_feature: GYAE6OF02HPJIJ.47.53.E09.1.454.CMB.1.raw
  modified_base (423)..(423): a, c, t, g, unknown or other
  misc_feature (423)..(423): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggcccccaggacagacggccaggattacttgtgcgggagccagtgttggagaaagaagtgtacactggtaccaacagatgccaggccaggcccctgtgctggtcgtctatgatgatagtgacccggccctcgtgggactccccgagcgattctctggctcaagtcgtagggacacggccacccgtgaccgtcagcagggtcgacggtcggggatggaggccgtattagttttgngtagggtgtgggagtacttaagttttggtactagttagttgttgttcggcggtagggaccgaagctgaccgtccgtcggtacgacgacccgaaggccgtccgcccccgttcggtcctacctccgtccgttcccctacccttcccg

SEQ ID NO: 227600 - DNA, 565 bp, Homo sapiens
  misc_feature: GYAE6OF02IPQG2.47.53.E09.1.454.CMB.1.raw
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (440)..(440): a, c, t, g, unknown or other
  misc_feature (440)..(440): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacctacacagaccctcacgctgacctgcagcttctctggattttcactcagtagtactggagaggctgtgggctgggtccgtcacgcccccaggaaaggcccctggagtggcttgcactcatttatgggatgatgtgaagtactanagtccattatttcaagaggctnactatcaccaagacacttaccaaaaccagtcgtctagacaatgaccaacgtgaaacgcctagccggacaccgggccaacgatattattgtgacacgaccgacnctataccgaccagctagggaactcgaacaacgtcggttaccgacccgtggggaccctacggggaaccctttggaccctaccgtcctcccgtccacgtccctacccgaaccgaccgggccctacgg

SEQ ID NO: 227601 - DNA, 601 bp, Homo sapiens
  misc_feature: GYAE6OF02IXI92.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctcgtgggactccccgagcgattctctggcctcaagtctagggaacacggccaccctgaccgtcagcgagggtcgacggtcggggatggaggccgtattattttgtcgtaggttggtgggagtacgttaagttttggtactattagttggtttggttcgggcgggtagggacctaaggcgtcggtacccgttccgtcgggtacgacggacccgtaagggcctccggccccccgttcgggttaccctaccgttccgttccggtttcccccggtccccttccccgttaccg

SEQ ID NO: 227602 - DNA, 515 bp, Homo sapiens
  misc_feature: GYAE6OF02JFKFP.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctctgggatccccgagcgattctctggctccaagtctgggaacacggccacctgaccgtcagcagggtcgacgtcgggatgaggcgtatattttgcaggtgtggagactaatttggctatatgttgttcggcggaggaccaagctgaccgtcctcggtcagcccaaggctcgcccctggtcacgtcctcgtcccaccctcctcg

SEQ ID NO: 227603 - DNA, 531 bp, Homo sapiens
  misc_feature: GYAE6OF02GCR7U.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgctaggtgtgggagactaattttggtctattagttgttgttcggcggtagggacaagctgaccgtctaggtcaggcccaaggcccaacccactcgtcacctctcgttccccgccctccc

SEQ ID NO: 227604 - DNA, 568 bp, Homo sapiens
  misc_feature: GYAE6OF02HJD0V.47.53.E09.1.454.CMB.1.raw
  modified_base (422)..(422): a, c, t, g, unknown or other
  misc_feature (422)..(422): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccaggaaaggccctggagtggcttgcactcatttatggatgatgtgaagtactacagtccatatttcaagaggctcactatcaccaaggacacttaccaaaacagtgtctgacaatgaccaagtgaagcctagcggacacgcacatattattgtgcacacgacnctataccgccagctagggaaactcgaactaacgtcggttaccgaccccgttggggacccacggggtaaccccttcggtccgaacccgttccgttacccgtccgtacggaccccttaccccgaacccgtaccggggcccctaaccgg

SEQ ID NO: 227605 - DNA, 569 bp, Homo sapiens
  misc_feature: GYAE6OF02HV6EC.47.53.E09.1.454.CMB.1.raw
tcagagctcacgtacacgaccggtgctcgatttagagagagtgtgttgggtttgggggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccagtggtcctgacaatgaccaacgtgaagcctgcggacacggccacatattattgtgcacaccgacgctataccgcagctgggaaatcgacaactggttccgaccccgtggggccgggaacccgtcggtcaccgtctcttcagcttccaccaacgggcccagtccggtccttcccccgtcggccgccctcgcctccacggacgccaccgtcgtcgggggccacgacggccggcccgtgggcctcggcccgtgggtaccacgggtacttaccg

SEQ ID NO: 227606 - DNA, 535 bp, Homo sapiens
  misc_feature: GYAE6OF02H02NJ.47.53.E09.1.454.CMB.1.raw
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctctgggatccccgagcgattctctggctcaagtctgggaacncggccaccctgaccgtcagcagggtcgacgtcgggngtgaggcgtatattttgtcaggttgtgggagtactaagtttggtctatagtgttgttcggcggagggaccaagctgaccgtcctcggtcacgcccaaggctcgtccccgtcggtcctacgtcctcgttccccaccctccctaccg

SEQ ID NO: 227607 - DNA, 223 bp, Homo sapiens
  misc_feature: GYAE6OF02HSSSX.47.53.E09.1.454.CMB.1.raw
  modified_base (192)..(223): a, c, t, g, unknown or other
  misc_feature (192)..(223): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccgccctcctctacgtgagctctgagcgggctggcaaggcgcatagnnnnnnnnnnnnnnnnnnnnnnnnnnnnnnnn

SEQ ID NO: 227608 - DNA, 563 bp, Homo sapiens
  misc_feature: GYAE6OF02IJCSN.47.53.E09.1.454.CMB.1.raw
  modified_base (444)..(444): a, c, t, g, unknown or other
  misc_feature (444)..(444): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctggggtccgtcacgcccccaggaaacggccctggagtggcttgcactcatttatgggatgatgtgaagtactacagtccatatttcaagaggctcactatcaacaaggacaacttaccaaaaacctagtcggtcctgacaatgaaccaacgtgaagcctagcggacacggccaacatacttattgtgcaacaccgacgctanaccgcagctagggaaactcgaacacgtcggttacgacccgtgggacccagggtaacccttggaccaaccggttcctacccgtacgacgtccctaccgaaccgtaccggggccctaccgg

SEQ ID NO: 227609 - DNA, 556 bp, Homo sapiens
  misc_feature: GYAE6OF02F621K.47.53.E09.1.454.CMB.1.raw
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctggtgggcgtgggtccgtcacgcccccaggaacggccctggagtggcttgcactctatttagttgggatgatgtgaagtactacagtccattatttcaagaggctcactatcacaaggactacttaaccaaaaccaagtcgtacctagacaatgaccaagtagaagcctgcggacacggccanatattattgtcncacaccgacgctacaccgcagcgtagggaactcgaactaacgtcggttaccgacccgtcggggaccgacgggtaacccttggtccacccgttctccctcacgccctccaccgacgggccctacgg

SEQ ID NO: 227610 - DNA, 553 bp, Homo sapiens
  misc_feature: GYAE6OF02HEQRZ.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggactccccgagcgattctctggctccaagtctgggaacacggccaccctgacccgtcagcagggtcgacggtcggggatggaggccgttatagtttttgtctagggtgttgggagtacgttaagttttggtctattattgtttgttcggcggagggaccaagctgaccgtcgtcggtccgagcccaaggcctcgccccgtcggtccaccgtcctcgttccccgcccttcccg

SEQ ID NO: 227611 - DNA, 524 bp, Homo sapiens
  misc_feature: GYAE6OF02ID3SV.47.53.E09.1.454.CMB.1.raw
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
  modified_base (426)..(426): a, c, t, g, unknown or other
  misc_feature (426)..(426): n is a, c, g, or t
  modified_base (451)..(451): a, c, t, g, unknown or other
  misc_feature (451)..(451): n is a, c, g, or t
tcagagctcacgtacacgaccggtgctcgatttagagagagtgtgttgggtttgggcgtgggcctaaggaagcagcactggtggtgcctcagccatggcctggaccgttctcctcctcggcctcctctctcactgcacaggctctgtgacgtccgacgagctgattcaggcaccctcgatgcagtggccccaggacagacggccaggattacttgtgcggganccagtgttggagaaagaagtgtacactggtaccaanagatgcaggccaggcccctgtgctggtcgtctatgatgatagtgaccgggccctctgggactccccgagcgattctctaggctccaagtctgggaacacggccaccctgaccgtcacgcagggtcgacgtcggggatgaggccgtatattttgtcaggttgtggganactaattttgcatatgttgttcggnggagggaccaagtctagaccgtctcggtcagcccaaggctcgcccctcggtcactctcgtcccgccctctccg

SEQ ID NO: 227612 - DNA, 590 bp, Homo sapiens
  misc_feature: GYAE6OF02JLTUY.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgggagccagtgtggagaaagaagtgtacactggtaccaacagatgccaggccaggcccctgtgctggtcgtctatgatgatagtgaccggccctcgtgggactccccggagcgattcgtctggcctccaagtcgtagggaacaccggccacccgtgacccgtcagccgaagggtcgacggtcggggatggacggtccgtattagttttgtcgtagggttgtagggagtacttaagttttgggtactagttagttggtttggttcgggacgggtagggacctaaggtctacggaccgttcgtcggtcacggcccgaaggccgtccgtaccccgtggtcctacgtccgttcgttccccgtccctcccgttaccg

SEQ ID NO: 227613 - DNA, 526 bp, Homo sapiens
  misc_feature: GYAE6OF02H1SLV.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgacggccctctgggatccccgagcgattctctggctccaagtctgggaacacggccaccctgaccgtcagcagggtcgacgtcggggatgaggccgtatatttttgtcaggtgtgggagactaatttggtcatatgttgttcggcggagggaccaagctgaccgtcctcggtcagtcccaaggctcgcccctcggtccactctcgttcccgccctcccg

SEQ ID NO: 227614 - DNA, 554 bp, Homo sapiens
  misc_feature: GYAE6OF02FKJRT.47.53.E09.1.454.CMB.1.raw
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtcgctggtcgtctatgatgatagtgaccggccctntgggactcccgagcgattctctggctcaagtctagggaacncggccaccctgaccgtcagcgagggtcgacggtcggggatggaggtccgttattagtttttgtcgagggtgtgggagtacgttaagttttggtactagtagttgttgttcggcggtacgggacagctagaccgtctcggtcacggccaaggcctcgccccgtcgtcctaccgtctccgttccccgcccttcccg

SEQ ID NO: 227615 - DNA, 557 bp, Homo sapiens
  misc_feature: GYAE6OF02H10YK.47.53.E09.1.454.CMB.1.raw
  modified_base (500)..(500): a, c, t, g, unknown or other
  misc_feature (500)..(500): n is a, c, g, or t
tcagagctcacgtacacgaccggtgctcgatttagagagagtgtgttgggtttgggggctcgggcctaaggaagcagcatcgggggtgccgcagccatggcctggaccgctctccttctgagcctccttgctcacttttacagtttctgtggccttcctttgacctgacttacagccactctcagtgtccgtggccctggggacagacgggccagacttacctgtgggggaagtcaacattggacgtaaaaatgtgcactggtaccaacagaagccaggaccaggcccctgtcctggtcatctataaggataacaaaccggcctcgtgggatccctgacattctctggctcaattcggacacacgccacctgaccatcagcagacgccaagtcggaagatgaggctgactatttctgtactaaattgggactattctccgcttagcggtatccggcgcgaagggacccaagccgtcgaccgtcctaagtccagccaggcncggccccgtggcctactcctacgttcccctacccttccctactaccgtcgacgtccg

SEQ ID NO: 227616 - DNA, 527 bp, Homo sapiens
  misc_feature: GYAE6OF02HC4DQ.47.53.E09.1.454.CMB.1.raw
  modified_base (521)..(521): a, c, t, g, unknown or other
  misc_feature (521)..(521): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggactccccgagcgattctctggctcaagtctgggaacacggccaccctgacccgtcacgcagggtcgacggtcggggatgaggccgtatattttgtctaggtgtgggagactaagtttggtcatatgttgttcggcggagggacaagcgtgaccgtctcggtcacgcccaaggctcgcccctcggtcactctcgttcccnccctcc

SEQ ID NO: 227617 - DNA, 537 bp, Homo sapiens
  misc_feature: GYAE6OF02IVLP9.47.53.E09.1.454.CMB.1.raw
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
  modified_base (506)..(506): a, c, t, g, unknown or other
  misc_feature (506)..(506): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtcctggtcatctataaggatacaaaccggccctctgggatccctgaacgattctctggctccaagtctgggaacacggccacctgaccgtcagcagggtcgacggtcggggatgaggccgtattattttgtctaggtgtgggagtacttaagttttggtctatntgttgttcggnggagggaccaaggttgaccgtctaggtcagcccaggctcgtccctcggtcnctctcgttcccacctcctctacgtcgactcg

SEQ ID NO: 227618 - DNA, 541 bp, Homo sapiens
  misc_feature: GYAE6OF02IAC7A.47.53.E09.1.454.CMB.1.raw
  modified_base (417)..(417): a, c, t, g, unknown or other
  misc_feature (417)..(417): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttatgggatgatgtgagtactacagtccatatttcaagaggctcactatcacaagacacttaccaaaaacagtgtactgacaatcgaccaacgtgaacgcctagcggacacggccacatattattgtnacacacgacgctataccgacagcgtaggaatacgacaacgtcggttaccgacccgtggggaccctagggaacccttggtccacccgttctccgtcacgccctacccaccgaaccgggccctacg

SEQ ID NO: 227619 - DNA, 580 bp, Homo sapiens
  misc_feature: GYAE6OF02IKX1S.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttaccaaaaaccaagtggtcctgacaatgaccaacgtgaagcctgcggacacggccaacatattatgtgcacaccgacgctataccgccagctagggaaactcgacaactggtcgacccgtgggccagggaaccctgtccaccgtcctcctcacgcctcccaccgaacgggcccacgtccggtccttccccgtcggcccacccctcctcccaacgcgccaccgtcggtcgggggcaccgacggcccggcccgtcgggtcgtcggccgtcggtaccgtaacggtaccttaccg

SEQ ID NO: 227620 - DNA, 588 bp, Homo sapiens
  misc_feature: GYAE6OF02HJ98X.47.53.E09.1.454.CMB.1.raw
tcagagctcacgtacacgaccggtgctcgatttagagagagtgtgttgggtttggggagtctgggcctaaggaagcagcactggtggtgcctcagccatggactggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggccctcgtgggactccccgagcgattctctggctccaagtctgggaacacggccaccgtgaccgtcagcgagggtcgacggtcgggatggaggccgtatattttgtcgtaggtgtgggagtacgttaagttttggtactagttagttgtttggttcgggacgggtagggaccgaaggtccgtggtacccgtccgttcggtaccgacggccccgaagggtccgtaccggccccccgttcgggtccaccgttccgttccggttccccaccccgttcccg

SEQ ID NO: 227621 - DNA, 524 bp, Homo sapiens
  misc_feature: GYAE6OF02F6ITR.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggccccctgtgctggtcgtctatgatgatagtgaccggccctctgggatccccgagcgattctctggctccaagtctgggaacacggccaccctgaccgtcagcagggtcgacggtcggggatggaggccgactattactgtcgaggtgtgggacagtaatagtgatccgagcgtaggttttcggcggtggacagctgaccgtcgtaagtcacgcccaaggctcgcccctcggtccactctcgtcccc

SEQ ID NO: 227622 - DNA, 528 bp, Homo sapiens
  misc_feature: GYAE6OF02HVGYK.47.53.E09.1.454.CMB.1.raw
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (498)..(498): a, c, t, g, unknown or other
  misc_feature (498)..(498): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactctatttattggatgatgtgaagtactacagtccatatttcaagaggctcactatcaccaaggacacttacaaaacagtcgtcctgacaatcgacaacgtgaagcctgcgacacggccanatatattgtncacaccgacgctataccgcagctggaactcgacaacgtcggtccgacccgtgggccacgggaacccttgcctaccgtcctccncgacgccctacccaccgacgggccctacgg

SEQ ID NO: 227623 - DNA, 206 bp, Homo sapiens
  misc_feature: GYAE6OF02G7X5Q.47.53.E09.1.454.CMB.1.raw
  modified_base (190)..(206): a, c, t, g, unknown or other
  misc_feature (190)..(206): n is a, c, g, or t
tcagagctcacgtacacgaccggtgctcgatttagagagagtgtggttgggtttgggagactaatttggtcatatgttgttcggcggagggaccaagctgaccgtcctcggtcagcccaaggctgcccctcggtcactctgttcccacctcctctacgtgagctctgagcgggctggcaaggcgcatagnnnnnnnnnnnnnnnnn

SEQ ID NO: 227624 - DNA, 562 bp, Homo sapiens
  misc_feature: GYAE6OF02HUYHE.47.53.E09.1.454.CMB.1.raw
  modified_base (372)..(372): a, c, t, g, unknown or other
  misc_feature (372)..(372): n is a, c, g, or t
  modified_base (433)..(433): a, c, t, g, unknown or other
  misc_feature (433)..(433): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggatttttcactcagtagtactggagaggctgtgggctgggtccgtcacgcccccaggaaaggccctggagtggcttgcactcatttattgggatgatgtagaagtactacagtccatatttcaagaggctcactatcacaagacacttacaaaaaccagtgtccngacaatcgaccaacgtgaagcctgacggacacggaccacataattatgtgacacaccgacnctactaccgcagctagggaaatcgaactaacgtcggttaccgaccccgtggggccaacggggtaacccttcggtacctacccgtcttccctcgaccgtcccttacccgaacccgtacgggcccctacgg

SEQ ID NO: 227625 - DNA, 513 bp, Homo sapiens
  misc_feature: GYAE6OF02IVGGJ.47.53.E09.1.454.CMB.1.raw
  modified_base (422)..(422): a, c, t, g, unknown or other
  misc_feature (422)..(422): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggcccaggacagacggccaggattacttgtgcgggagccagtgttggagaaagaagtgtacactggtaccaacagatgccaggccaggcccctgtgctggtcgtctatgatgatagtgacggccctcaggggtccctggccgatctctggctccaagtctgcgctcagccaccctggccatcagtcgggctccggcccgaggatgaggctgattattactgtgtagttgggatcgnagcctgactgcttacgtcttcggagctgggaccaaggtcaccgttcctagggtcacggcccaaggccctaaccccactgttaccacttccg

SEQ ID NO: 227626 - DNA, 558 bp, Homo sapiens
  misc_feature: GYAE6OF02HMEB9.47.53.E09.1.454.CMB.1.raw
  modified_base (260)..(260): a, c, t, g, unknown or other
  misc_feature (260)..(260): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaanagatgccaggccaggcccctgtgctggtcgtctatgatgatagtgaccggccctcgtgggactccccgagcgattctctggctccaagtctgggaacacggcccacccgtgaccgtcacgcgagggtcgacgtcggggatggaggccgtattattttgtcaggttgtgggagtacttaagtttgtctatatgttggttcggcggtagggaccaaggctggaccgtccgtcggtcacggcccgaaggcctccgtcccccgtggtcctacctccgttccggtttccccgccctccctccg

SEQ ID NO: 227627 - DNA, 571 bp, Homo sapiens
  misc_feature: GYAE6OF02HSC40.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgggagccagtgttggagaaagagtgtacactggtaccaacagatgccaggccaggcccatgtgctggtcgtctatgatgatagtgaccggccctctgggactccccgagcgattctctggctccaagtctgggaacacggccacctgaccgtcacgcagggtcgacggtcggggatggaggccgtattagtttttgtcgtagggtgtggggagtaacgttaagttttgggtctaagttagttgtttggtttcgggcggtagggaacccaaaggccgtagaccgttcccgtcggtccgacggcccaagggcctacggccccctcggtccacctccgtcgttccccacccttccc

SEQ ID NO: 227628 - DNA, 595 bp, Homo sapiens
  misc_feature: GYAE6OF02IUGMM.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccgaaggaaacggcccgtggagtggcttgcactcatttatgggatgatgtagaagtactacagtccattatttacaagaggctcactatacaaccaaggactacttaaccaaaacgtagtacgtacctagacaatcgaaccaacgtagaacgccgtaggaccggacaccggaccaactaattattagttgtagaccaccgaacccgacgcctactacccgccagcgtagggaactccgaactacgtcggttaccgacccgtggggacccacggggtaacccttggtaccctacccgttcctcccgtcgacgtccctaccacccgacggcccctacgg

SEQ ID NO: 227629 - DNA, 632 bp, Homo sapiens
  misc_feature: GYAE6OF02H1NYB.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggccccctgtgctggtcgtctatgatgatagtgaccggccctctgggactccccgagcgattctctggctccaagtctgggaacacggccaccctgaccgtcagcagggtcgacggtcggggatggaggccgtatatttttgtcgagggttgtgggagtacttaaagttttgggtactaagttagttaggtttgtttcgggccgggtaaggggacccgtaaaggccgttacgggacccggttccgttacccgggttccgaacggtcccccgaaagggccgttaccgggccccccccttacggggtccctaacccgtttccggttccggtttccccccggtcccccgtttaccccgg

SEQ ID NO: 227630 - DNA, 682 bp, Homo sapiens
  misc_feature: GYAE6OF02J3CF5.47.53.E09.1.454.CMB.1.raw
tcagagctcacgtacacgaccggtgctcgatttagagagagtgtgttgggtttgggggacgtcctgtgccccaccatggacacactttgctccacgctcctgctgctgaccatccttcatggtcttcgtcccagatcaccttgaaggagtcgtggtccgacgctggtacgaaacccacacacgaccctcacgctgacctgcagtcttctctggtatttcactcagtagtactggagaggtctggtgggcgtcgggtccgtcgaccgaccccgaaggaacggcccgtgggagtcggtcttgctacttctatttagtgggatgtatgtagtaagtactactacgtcctaattacttacgaagtacggcttacactactaccaaccgaaacggtacctaaacgttaaccctaaaaacgaacggttcggttaccctaggaaccaagtaccgaaccgaacggtacgaacgtccgtacggaccggtacaccggacctagtaattattacgttacgtcgaccaccgaaccgacacctacgaccgcgacgtacgtaggaacctacgactaaccgtccggtacccgacccggtcgggacccgtaacggtacccgttcgtacccgtaccccggttctacccggtactacccgccccgttacccggaacccgacccggggtcccttacccggg

SEQ ID NO: 227631 - DNA, 200 bp, Homo sapiens
  misc_feature: GYAE6OF02FF6R6.47.53.E09.1.454.CMB.1.raw
  modified_base (175)..(175): a, c, t, g, unknown or other
  misc_feature (175)..(175): n is a, c, g, or t
  modified_base (177)..(200): a, c, t, g, unknown or other
  misc_feature (177)..(200): n is a, c, g, or t
tcagagctcacgtacacgaccggtgctcgatttagagagagtgtgttgggtttgggggaagaggaagactgacggtcccccaggagttcaggtgctgggcacagcggccctgggcctgcctggtcaaggtactacttcctacgtgagctctgagcgggctggcaaggcgcatagntnnnnnnnnnnnnnnnnnnnnnnnn

SEQ ID NO: 227632 - DNA, 626 bp, Homo sapiens
  misc_feature: GYAE6OF02HQLRV.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccgaggaaacggccctggagtggcttgcactctatttagttgggatgatgtagaagtactacagtccattatttacaagaggctcactatcacagacactaccaaaacagtcgtctagacaatcgaaccaacgtagaacgccgtaggaccggacaccggaccaactaattaattagttagtcgaccaaccaaccggaccgtaccttaacgtacccgaccgacgccgtaggggaaacttccgaacgtaaaccgttcgggttacccgaccccggtcggggacccgtaacggggtaaccccttggtacccgacccggttcctccccgtacgaccgtccccgtacccgaacccgtaccgggcccctaaccgg

SEQ ID NO: 227633 - DNA, 562 bp, Homo sapiens
  misc_feature: GYAE6OF02FYWGP.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgacccggcctctgggactccccggagcgattctctggctccaagtctgggaacacggccaccctcgaccgtcagcagggtcgacggtcggggatggaggccgtattagtttttgcgtaggttgtgggagtacttaagttttggtctagttattggttgttcgggcgggagggtaccaagcgtgacccgttccgtcggtcacgcccgaaggcctccgtcccccgtcggtccactccgttccgtccccgtcccctcctccg

SEQ ID NO: 227634 - DNA, 664 bp, Homo sapiens
  misc_feature: GYAE6OF02JDLOO.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggccccctgtcgctggtcgtctatgatgatagtgacccggccctcgtgggactccccgagcgattctctggctccaagtcgtgggaacacggccaccctgaccgtcagcgacgggtcgacggtcggggatggaggccgtattagttttgtcgtaggtgtagggagtaacgtttaagttttggtactagttagttggtttcgggttccgggtacgggtaacgggtaacccgtaaaggtccgtacggtacccggttcccgttaccgggttacccgaacgggtacccccgtaaacggggtccccgttacccgggtcccccccgttaccgggttacccgtaccccgtttacccgtttcccgggtttcccccccggtcccccctttacccccgg

SEQ ID NO: 227635 - DNA, 628 bp, Homo sapiens
  misc_feature: GYAE6OF02I1J01.47.53.E09.1.454.CMB.1.raw
  modified_base (225)..(225): a, c, t, g, unknown or other
  misc_feature (225)..(225): n is a, c, g, or t
  modified_base (363)..(363): a, c, t, g, unknown or other
  misc_feature (363)..(363): n is a, c, g, or t
tcagagctcacgtacacgaccggtgctcgatttagagagagtgtgttgggtttggggcgtgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggganccagtgttggagaaagaagtgtacactggtaccaacagatgccaggccaggcccctgtcgcgtggtcgtctatgatgatagtgacccggcctcgtggactccccggagcgatcgtctggctccaagtcgtacggaacncggccaccctgaccgtcagcgagggtcgacggtcgggagtggaggtccgtattagttttgctagggtgtgggagtaacgttaagtttcggtactagttagttgtttggttccgggaggtacgggtaccgaagtccgtacggtacccgttacccgtcggtaccgacggtaccccggaaggtacccgtcccggtaccccccgttccgggtaccgttacccgttcccggtttaccggttcccccgttacccccgttcccgttaacccg

SEQ ID NO: 227636 - DNA, 192 bp, Homo sapiens
  misc_feature: GYAE6OF02H3HQ8.47.53.E09.1.454.CMB.1.raw
  modified_base (191)..(192): a, c, t, g, unknown or other
  misc_feature (191)..(192): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgcccctcggtcactctgttcccaccctcctctacgtgagctctgagcgggctggcaaggcgcatagnn

SEQ ID NO: 227637 - DNA, 546 bp, Homo sapiens
  misc_feature: GYAE6OF02HFC2I.47.53.E09.1.454.CMB.1.raw
  modified_base (421)..(421): a, c, t, g, unknown or other
  misc_feature (421)..(421): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccgaggaacggccctggagtggcttgcactcatttatgggatgatgtgaagtactacagtccattattcaagagctcactatcacaagacactacaaaacaagtgtctgacaatcgaccaacgtgaacgcctggacggacacggaccacaacttattattgtnaccacaccgacgctaacaccgccagcgtagggaaatcgaacaacgtcggtaccgacccgtggggccacggggacccttggacctaccgtctccctcacgtccctacccgaccgacgggccctacg

SEQ ID NO: 227638 - DNA, 199 bp, Homo sapiens
  misc_feature: GYAE6OF02FFK45.47.53.E09.1.454.CMB.1.raw
  modified_base (189)..(189): a, c, t, g, unknown or other
  misc_feature (189)..(189): n is a, c, g, or t
  modified_base (195)..(199): a, c, t, g, unknown or other
  misc_feature (195)..(199): n is a, c, g, or t
tcagagctcacgtacacgaccggtgctcgatttagagagagtgtgttgggtttggagactaatttggtcatatgtcgttcggcggaggaccaagctgacccgtcctcggtcacgcccaaggcctcgcccccctggtccactctcgttccccgccctcctctacgtgagctctgagcggctggcaaggcncatagnnnnn

SEQ ID NO: 227639 - DNA, 663 bp, Homo sapiens
  misc_feature: GYAE6OF02HCXIR.47.53.E09.1.454.CMB.1.raw
  modified_base (348)..(348): a, c, t, g, unknown or other
  misc_feature (348)..(348): n is a, c, g, or t
tcagagctcacgtacacgaccggtgctcgatttagagagagtgtgttgggtttggggctgggcctaaggaagcagcactggtggtgcctcagccatggcctggaccgttctcctcctcgccgtcctctctcactgcacaggcgtctgtgacggtccgacgagctgattcaggcaccctccgtatgttcgagtggccccgacggagagacggccgaggattacttgtgcgggagccagtgttggagaaagaagtgtacactggtaccaacagatgccaggccaggcccctgtgcctggtcggtctatgatgatagtgccggccctctgggactccccgagcgatttccngtcgggctaccaaggttcgtgggaaaccgaccgcccaacccctgaccgtcagccgagggtccgacggtacgggggagtggacggccgttagttaagtttttcggtacgtagggttggtggggtaagtacgtttaaagtttttcggttcgtaatagtttggtttggttaccgggtcggggacgggtaacccgaaagttccggacggtacccgttcccgtcggttaccgacggccccggaaggtcctcccggtacccccgttaccggttccgtaccttccgtttcccggttacccccgttaccccctcctttacccg

SEQ ID NO: 227640 - DNA, 572 bp, Homo sapiens
  misc_feature: GYAE6OF02J2YE8.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtcctcacgcccccaggaaacggccctggagtggcttgcactcgatttattgggatgatgtgaagtactacagtccatatttcaagaggctcactatacaccaaggacacttaccaaaaccagtcgtcctagacaatgaccaacgtgaacgcctgaccggacacggccacatattatgtgactacaccgacgcctagtaccgccagtctacgggaaactccgaactaacgtcggttaccgacccgtggggaccctacggggtaaccccttggacctaacccgtcctcccgtaccacgcccttaccgacccgtacgggcccctaccgg

SEQ ID NO: 227641 - DNA, 591 bp, Homo sapiens
  misc_feature: GYAE6OF02JGZ5P.47.53.E09.1.454.CMB.1.raw
  modified_base (224)..(224): a, c, t, g, unknown or other
  misc_feature (224)..(224): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggganccagtgttggagaaagaagtgtacactggtaccaacagatgccaggccaggcccctgtgctggtcgtctatgatgatagtgaccggcctcgtgggactccccgagcgattctctggctcaagtctagggaacacggccaccctgacccgtcacgcgagggtcgacggtcggggatggaggccgtaagttagttttgtcgtaggttggtgggtagtacttaagtttggtctagttagttgttggttcgggacgggtagggtaccaaaggtcttacggacccgtccgtacggttcgacggtcccgaaggtccgtccgtcccccgtggtccctacgttccgttccggttccccctaccctccgttacccg

SEQ ID NO: 227642 - DNA, 686 bp, Homo sapiens
  misc_feature: GYAE6OF02HXJ10.47.53.E09.1.454.CMB.1.raw
tcagagctcacgtacacgaccggtgctcgatttagagagagtgtgttgggtttgggctgggcctaaggaagacagcactggtggtgcctcagccatggcctggaccgttctcctcctcggcctcctctctcactgcacaggctctgtgacgtccgacgagctgattcaggcaccctcgatgtcagtggccccaggacagacggccaggattccctgtggagaaacaacattaggaagtaagagtgtacattggtaccaacagagcaggccaggcccctgtgctggtcgtcatgatgataggcgaccggccctgagggactcccgtgacgcgcttcgtctcggtctaccaatttcgtgggaaacctaccgggaccctacccgtgaaccctatccgacggccggacggtaccgaacggcccggaagtacgtacggacggtaccggaacttaacgttacgtcggtaccgtagggttaggtacgggtaacgtaaggttaaagtaggttacgaacgtccccggaagttaccggttaacgggttttccggggaccgggtttacggggaaacccgtaacggcccgttaccggtacccggttacccgtaaacgggttcccaacggtaccccgaacggtcccgtaccgtccccccgttacggtccctaaccgttcccgttaccggttccccccgg

SEQ ID NO: 227643 - DNA, 194 bp, Homo sapiens
  misc_feature: GYAE6OF02I1UE0.47.53.E09.1.454.CMB.1.raw
  modified_base (191)..(194): a, c, t, g, unknown or other
  misc_feature (191)..(194): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgcccctcggtcactctgttcccgccctcctctacgtgagctctgagcgggctggcaaggcgcatagnnnn

SEQ ID NO: 227644 - DNA, 609 bp, Homo sapiens
  misc_feature: GYAE6OF02JXVO9.47.53.E09.1.454.CMB.1.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (371)..(371): a, c, t, g, unknown or other
  misc_feature (371)..(371): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
tcagagctcacgtacacgaccggtgctcgatttagagagagtgtgttgggtttgggggtcgttgtcccagatcaccttgaaggagtctggtccgacgctggtgaaacccacacagaccctcacgctgacctgcagcttctctggattttcactcagtagtactggagaggctgtgggctgggtccgtcagcccccaggaaacggccctggagtggcttgcactcatttattgggatgatgtgaagtctacagtccatntttcaagaggctnactatcaccaagcacttcaaaaccagtaggtctgacaatgaccaacgtgaagcctagcggacacgggccacatattaacgtgtgcacgaccgacgcttanaccgccagccagggaaatcgacaactggttacgacccgtcgggcacgggtaacccttgaccaccgtctccnctaacgccctccgaccaccgggacccncgtaccgtccgtttccccccgaggtcccgtacccgtcccgtacccgaacgtaccgccgaccctcggtcgggggccctacgccggtaccggtcccgtcggcccgtcggcccgttcggtaccggtaccggtccttaacccgg

SEQ ID NO: 227645 - DNA, 611 bp, Homo sapiens
  misc_feature: GYAE6OF02G7Z51.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctcgtgggactccccggagcgattctcgtcggctccgaagtcgtagggaaccacggcccacccgtcgaccgtcacgcgacgggtcgacggtcggggatggacggccgttattagttttgcgtaggttgtgggagtacgttagttttggtactagttagttgtttgttcgggcgggtacgggaccgtaaggtcgtacggtacccgttccgtcggtccgaacggcccgaagggtcctcccggcccccgttccggtaccctaccgttcccgttccggttccccgtccccgtcccgttacccgg

SEQ ID NO: 227646 - DNA, 524 bp, Homo sapiens
  misc_feature: GYAE6OF02IXMWF.47.53.E09.1.454.CMB.1.raw
  modified_base (338)..(338): a, c, t, g, unknown or other
  misc_feature (338)..(338): n is a, c, g, or t
  modified_base (449)..(449): a, c, t, g, unknown or other
  misc_feature (449)..(449): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaaccaacagatgccaggccaggcccctgtgctggtcatctataaggatacaaaccggcctctgggactcccgagcgattcnctggctccaagtctgggaacacggccacccgtgaccgtcagcagggtcgacgtcgggatgaggccgtatatttgtcaggtgtggatactaatttgtcatatgttgttcggnggaggacaagctagaccgtctcggtcacgaccgaaggctcgcccctcggtcactctcgttcccgcctcctctacg

SEQ ID NO: 227647 - DNA, 552 bp, Homo sapiens
  misc_feature: GYAE6OF02HYHNR.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgccccccaggaaacggccctggagtggcttgcactctatttattgggatgatgtgaagtactacagtccatatttcaagaggctcactatacaccaaggacacttacaaaaacagtgtcctagacaatcgaacaagtgaagctgacgacacggcacatatatgtgcacacgacactactaccgcagctacggaatacgacaaacgtggttaccgacccgtggggaccctacgggtaacccttggttaccacccgtaccgtccctacacgtacccctaccgaccaccgggccctaccgg

SEQ ID NO: 227648 - DNA, 666 bp, Homo sapiens
  misc_feature: GYAE6OF02JNIBY.47.53.E09.1.454.CMB.1.raw
tcagagctcacgtacacgaccggtgctcgatttagagagagtgtgttgggtttggggtctgggcctaaggaagcagcactggtggtgcctcagccatggcctggaccgttctcctcctcggcctcctctctcactgcacaggctctgtgacgtccgacgagctgattcaggcaccctcgatgtcagtcgccccaggacagacggccaggattactgtgcgggagccagtgttggagaaagagtgtacactggtaaccaacagatgaccacggccacggcccctggtcgcgtcggtcgtctatgatgatagtcgaccgcctcgtcgggactccccgagcgtacttccgtcgtcggtcctaccgtaagtcgtacgggaaccaccggtccctaacccgtggaacccgttcgaacggccgacgggtaccggtaccggtacgggtacggtacggacggtacggtacgttagttttcgttacgtaggtggttacgggtacgtagtaagtagtagtacgtaccgtacgtacgtacggttcgggtcgggtacgggtacgtacgtacgtacgtaccgtacctaacgggggggggggtactacggtaccgtaacggtaccgtccgtcccgtaccggtccgtaccgttccgtccgttaccccgtaccccgttacccg

SEQ ID NO: 227649 - DNA, 552 bp, Homo sapiens
  misc_feature: GYAE6OF02IDDWP.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggactccccgagcgattctctggctccaagtctggaacacggccaccctgaccgtcagcgagggtcgacggtcggggatggaggccgtatattttgtctaggttgtgggagtacgttaagttttggtctattagttgttgttcggcggtagggaccaagctgaccgtcctcggtcgacgcccgaacggctacgcccccgtcgtcctacctcctcgttcccctacccttcctaccg

SEQ ID NO: 227650 - DNA, 523 bp, Homo sapiens
  misc_feature: GYAE6OF02GGJ07.47.53.E09.1.454.CMB.1.raw
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccaggaaaggccctggagtggcttgcactcatttattgggatgatgtgaagtactacagtccattattcaagagctcactatcacaagacactacaaaacagtgtcngacatgacagtganctgcgacacgcanatattatgncacacgacgctataccgcagctagggaactcgaacaacgtcggtaccgacccgtgggaccaacgggtaacccttgtaccacccgttcctccgtcgacgccctaccaccgacgggcccctacg

SEQ ID NO: 227651 - DNA, 539 bp, Homo sapiens
  misc_feature: GYAE6OF02GDU6C.47.53.E09.1.454.CMB.1.raw
  modified_base (455)..(455): a, c, t, g, unknown or other
  misc_feature (455)..(455): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctctgggatccccgagcgattctctggctccaagtctgggaacacggccaccctgaccgtcagcgagggtcgacgtcggggatggaggccgtattattttgcaggttgtgggagtactaattttggtctattatgttgttcggnggaggaccaagcgtgaccgtctcggtcacgcccaaggcctcgcccccgtggtccacgttccgtcgttccccgccctccttaccg

SEQ ID NO: 227652 - DNA, 558 bp, Homo sapiens
  misc_feature: GYAE6OF02I7OKM.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggactccccgagcgattctctggctccaaatctgcaacacgcctccctgaccatctcgtcgggctcgagtctggaggacgaggctgtattacttcttgttcgctcttgggcaacttacgttgttacgtttgggtgttcggcggtacgggacctaaggttcgacgttccgtaggtccgtacgccgaaggtcctaccggtcccccgtcgggtcctacgttccgttccggttaccccgtccccg

SEQ ID NO: 227653 - DNA, 548 bp, Homo sapiens
  misc_feature: GYAE6OF02HP0S8.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccggcctctgggatccccgagcgattctctggctccaagtctgggaacacggccaccctgacccgtcagcagggtccgacgtcggggatggaggccgtattattttgtcaggttgtgggagtacgttaattttggtctagtatgtttgttcgggcggagggaccaaggctgaccgtccgtcggtcacgcccgaaggcctcgccccgtcggtccacgtccgtcgttccccaccctccgttaccg

SEQ ID NO: 227654 - DNA, 545 bp, Homo sapiens
  misc_feature: GYAE6OF02FEKEN.47.53.E09.1.454.CMB.1.raw
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggcctgggtccgtcacgcccccaggaacggccctggagtggcttgcactctatttattgggatgatgtgaagtactacagtccattatttcaagagctcactatcacaaggacacttaccaaaaaccagtggtcctagacaatcgaaccaacgtgaagcctgacggacacggccacatattattgngacacacgacnctatacccgcagctagggaactcgaacaacgtggtaccgacccgtggggaccacgggtaacccttgaccctaccgtcctcctcacgccctccaccgacgggccctacg

SEQ ID NO: 227655 - DNA, 623 bp, Homo sapiens
  misc_feature: GYAE6OF02H3SI9.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccaggaaacggccctggagtggcttgcactctatttagtgggatgatgtgaagtactacagtccatatttacaagacggctcactactacaaccaaggacctaaccttaaccaaaaaaccacgtacggtacctagaacaagtacgaaccaacgtacgaacgccctaggaccggaacaccggaccaacgtaattatttattgtacgacaaccgaccgacgacctaacgtacccgccaggcgtagggaaataccgaactaacgttcggtaccgaccccggtggggacccgtacggggtaacccttcggtccgtacccgttcctaccgtacgaccgcccgtacccgaaccgaccgggtccctaaccgg

SEQ ID NO: 227656 - DNA, 194 bp, Homo sapiens; identical to SEQ ID NO: 227386
  misc_feature: GYAE6OF02IZ6M9.47.53.E09.1.454.CMB.1.raw
  modified_base (192)..(194): a, c, t, g, unknown or other
  misc_feature (192)..(194): n is a, c, g, or t

SEQ ID NO: 227657 - DNA, 617 bp, Homo sapiens
  misc_feature: GYAE6OF02GVMFF.47.53.E09.1.454.CMB.1.raw
tcagagctcacgtacacgaccggtgctcgatttagagagagtgtgttgggtttggggggtcttgtcccagatcacccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccattatttcaagaggctcactatcaacaagacacttaccaaaaacagtggtacctgacaatgaccaacgtgaacgcctgcgacacggccacatattatgtgcacaccgacgctataccgcagctagggaaatcgacaactggttaccgaccccgtggggaccacgggtaacccttgtacctacccgtctccctcacgccctccgaccgaacgggcccaacgttccgtcccttcccccgtacggccctaccccgttccctacccgaaacgtaccgcctacccgtccgtacgggggccaaccgacggcccggccccgtgggcccttcggccccgttagggtacccgaacgggtcccttaacccg

SEQ ID NO: 227658 - DNA, 642 bp, Homo sapiens
  misc_feature: GYAE6OF02FU7EC.47.53.E09.1.454.CMB.1.raw
  modified_base (365)..(365): a, c, t, g, unknown or other
  misc_feature (365)..(365): n is a, c, g, or t
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcattttatgggatgatgtgaagtactacagtccatatttcaagaggctcactatcaccaaggacacttaccaaaaaccagtcggtcctgacaatcgaaccaacgtagaacgcctgacggacaccggccaacattaattattgngaccacgaccgacgctatacccgccagtcgtagggaaatccgaactaacgtcggttcccgaaccccggtcggggaccgacgggtaacccttgtaccgtacccgtccttacctcgacgccctcccgaaccgaaccgggcccgtaccgttccggttaccctttcccccgtggtacccctaccccttccctacccaacggaccgaccctaccgtcggtcggggccaacgccggccggcccgtcgggctccggccgtacggtaccgacggtaccttacccg

SEQ ID NO: 227659 - DNA, 588 bp, Homo sapiens
  misc_feature: GYAE6OF02HZFMC.47.53.E09.1.454.CMB.1.raw
  modified_base (358)..(358): a, c, t, g, unknown or other
  misc_feature (358)..(358): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacgccaggattactgtgcggagccagtgttggagaaagagtgtacactggtaccaacagatgccaggccaggcccctgtgctggtccgtctatgatgatagtgacccggcctcgtgggactccccgagcgacttctctgctccgaagtctagggaaccncggccacctcgaccgtcagcgagggtcgacggtcgggatggacggcttagttgttttgtcgtaggtgtgggagtacttagttttggctagtagttgttggttcggacggggtaggaccgtaagcgtacggtaccgtccgtcgggtcacggaccccgaaggccgtaccggtaccccccgtcggttcctaccttccgttacccggttaccccctacccgttcccttacccgg

SEQ ID NO: 227660 - DNA, 541 bp, Homo sapiens
  misc_feature: GYAE6OF02G86UK.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcacaaggacacttacaaaaccagtgtacctgacaatgaccaacgtgaagcctgcggacacggccacatattattgtcgcaccaccgacgtctactaccgccagcgtagggaactcgaacaacgttggttaccgacccgtgggccgacgggtacccttgtcccaccgtcctcctcgacgccctaccaccgacggccctacgg

SEQ ID NO: 227661 - DNA, 630 bp, Homo sapiens
  misc_feature: GYAE6OF02GPD54.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctcgtgggactccccggagcgattctctggctccaagtctgggaacacggcccaccctgaccgtcagcgagggtcgacggtcggggatggaggtccgtatagttttgtcgtgggttgtggggagtacgttaagttttggtactagttaacgttggtttggttccgggtacgggtacggggtacccaaaggtctaggtacccgttcccgttcgggtccgacgggtcccccgaaacgggtcccgttccggccccccgtttccgggtaccctaaccgttccgttcccggtttcccccggtacccccttcccgttaccccgg

SEQ ID NO: 227662 - DNA, 642 bp, Homo sapiens
  misc_feature: GYAE6OF02HBBCX.47.53.E09.1.454.CMB.1.raw
  modified_base (223)..(223): a, c, t, g, unknown or other
  misc_feature (223)..(223): n is a, c, g, or t
  modified_base (390)..(390): a, c, t, g, unknown or other
  misc_feature (390)..(390): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacgccaggattacttgtgcggganccagtgttggagaaagaagtgtacactggtaccaacagatgccaggccaggcccctgtgctggtcgtctatgatgatagtgaccggcctcgtgggactccccggagcgacttcgtcgtggcctaccgaagttcgtcggggaaaccaccggcccacccgtgacccgtnacgcgacgggtcgacggtcggggatggacggtccgtattagttttgcgtaggtgtgggatacgttaagttttggctagttacgttggtttggtttcgggcggagggtaaccgaaggtccttccggtaacccgttcccgttcgggttaccaccggtacccggaacggtccgttacccggaccccccggtttcgggttaccctacccggtttcccgttccggtttccccccggtccccttaccctttaccccgg

SEQ ID NO: 227663 - DNA, 551 bp, Homo sapiens
  misc_feature: GYAE6OF02GRU6S.47.53.E09.1.454.CMB.1.raw
  modified_base (443)..(443): a, c, t, g, unknown or other
  misc_feature (443)..(443): n is a, c, g, or t
tcagagctcacgtacacgaccggtgctcgatttagagagagtgtgttggggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctggggtccgtcacgcccccaggaaacggccctggagtggcttgcactcatttattgggatgtatgtgaagtactacagtccattattcaagaggctcactatcacaaggacacttaccaaaacagtcgtctagacaatcgaaccaagtgaacgcctaggcggacacggccaacatattattgtcgcacaccgacactanacccgcagcgtagggaactcgaacacgtggtaccgacccggtgggaccacgggtaacccttggtaccaccgttcctccgtcgaccgcctacccaccgacggccctacg

SEQ ID NO: 227664 - DNA, 552 bp, Homo sapiens
  misc_feature: GYAE6OF02FTU8J.47.53.E09.1.454.CMB.1.raw
  modified_base (438)..(438): a, c, t, g, unknown or other
  misc_feature (438)..(438): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctgggtccgtcacgcccccaggaacggccctggagtggcttgcactcatttattgggatgatgtgaagtactacagtccatatttcaagagctcactatcacaagacacttaccaaaacagtcgtctagacaatacgaccaacgtagaacgcctggaccggacaccggaccaacataattattgtgcaccacgacnctactaccgcacgctagggaactcgaacacgtggtaccgacccgtgggcccacgggtaacccttggtaccgaccgttcctccgtcacgccctaccgaccgacgggccctaacgg

SEQ ID NO: 227665 - DNA, 588 bp, Homo sapiens
  misc_feature: GYAE6OF02JTW7K.47.53.E09.1.454.CMB.1.raw
  modified_base (223)..(223): a, c, t, g, unknown or other
  misc_feature (223)..(223): n is a, c, g, or t
  modified_base (337)..(337): a, c, t, g, unknown or other
  misc_feature (337)..(337): n is a, c, g, or t
tcagagctcacgtacacgaccggtgctcgatttagagagagtgtgttgggtttggggcgtgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgganccagtgttggagaaagagtgtacactggtaccaacagatgaccaggccaggcccctgcgctggtcgtctatgatgatagtcgaccggtcctgtgggactccccgagcgtattcnctggctcgagtctagggacacggccacctgaccgtcagcgaggtcgacggtgggactggacggcgttattagttttcgtcgtaggtggtgggtagtacgttaagtttcggtactagttgttagttaggttcgggcgggtaacggaccgtaaggtacgtacggtaccgtccgttcggtacgacggccgaacggtctaccggtccccgtacggtaccttacgtccgttcgttacccctacccgttccttaccg

SEQ ID NO: 227666 - DNA, 545 bp, Homo sapiens
  misc_feature: GYAE6OF02JE34H.47.53.E09.1.454.CMB.1.raw
tcagagctcacgtacacgaccggtgctcgatttagagagagtgtgttgggtttggggagtctgggcctaaggaagcagcactggtggtgcctcagccatggcctggacctttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtcctggtcatctataaggatacaaaccggccctctgggactccctagaacgattctctggctccaattcggacaacacggccaccctgacccatccagcagacgacccaagtcggagatgaggctgactatttctagtactaaagtttgggactatcctccgctgtcggtattcggcgcgagggaccaagctacgaccgtctaagtcacgaccaacggtcctaccgccccgtcggtccacgtcctccgttcccctaccccg

SEQ ID NO: 227667 - DNA, 578 bp, Homo sapiens
  misc_feature: GYAE6OF02IDP3K.47.53.E09.1.454.CMB.1.raw
  modified_base (316)..(316): a, c, t, g, unknown or other
  misc_feature (316)..(316): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctgngggactccccgagcgattctctggctccaagtctagggaacacggccaccctgaccgtcagcagggtcgacggtcggggatggaggccgtattagtttttgtcgtaggttgtgggatacgttaagttttggactattagttggtttcgttcgggcggagggaccaaggcgtacgaccgttccgtcggtcacggcccgaaggccgtaccgcccccgtcggtccaccgttccgttccggtttccccaccccgttccgttaccgg

SEQ ID NO: 227668 - DNA, 582 bp, Homo sapiens
  misc_feature: GYAE6OF02JKG3H.47.53.E09.1.454.CMB.1.raw
  modified_base (437)..(437): a, c, t, g, unknown or other
  misc_feature (437)..(437): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaggccctggagtggcttgcactcatttatgggatgatgtgaagtactacagtccatatttcaagaggctcactatcaccaaggacacttaccaaaaaccagtggtcctagacaatgaccaacgtgaacgcctggcgacacggccacatattattgtgccacaccgacgcttaanacccgccagctagggaaactcgactaaactgggttaccgaccccgttgggggacccaacggggtaaccccttttggaccctaacccggttccttaccccgtacgtacggccccttaccccgaaccgtaacggggccccctaacgg

SEQ ID NO: 227669 - DNA, 560 bp, Homo sapiens
  misc_feature: GYAE6OF02IC7BI.47.53.E09.1.454.CMB.1.raw
  modified_base (224)..(224): a, c, t, g, unknown or other
  misc_feature (224)..(224): n is a, c, g, or t
  modified_base (527)..(527): a, c, t, g, unknown or other
  misc_feature (527)..(527): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggganccagtgttggagaaagaagtgtacactggtaccaacagatgccaggccaggcccctgtgctggtcgtctatgatgatagtgaccggcctctgggactccccgagcgattctcgtgctccaagtctagggaacacggccaccgtgaccgtcagcagggtcgacgtcggggatgaggcgtatattttgtcgtaggtgtgggagtacttaagttttggtctattagttgttggtttcgggcggagggaccaaggctagaccgtcctcgggtccacggcccaaggcctccgtcccccgtcggtaccnccgttcctcggttcccccgcccgttcccttccg

SEQ ID NO: 227670 - DNA, 187 bp, Homo sapiens
  misc_feature: GYAE6OF02GWIE8.47.53.E09.1.454.CMB.1.raw
  modified_base (173)..(187): a, c, t, g, unknown or other
  misc_feature (173)..(187): n is a, c, g, or t
tcagagctcacgtacacgaccggtgctcgatttagagagagtgtgttgggtttgggggaagaggaagactgacggtcccccaggagttcaggtgctgggcacagcggccctgggctgcctggtcaaggactacttcctacgtgagctctgagcgggctggcaaggcgcatagnnnnnnnnnnnnnnn

SEQ ID NO: 227671 - DNA, 610 bp, Homo sapiens
  misc_feature: GYAE6OF02I87HP.47.53.E09.1.454.CMB.1.raw
  modified_base (259)..(259): a, c, t, g, unknown or other
  misc_feature (259)..(259): n is a, c, g, or t
  modified_base (483)..(483): a, c, t, g, unknown or other
  misc_feature (483)..(483): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaanagatgccaggccacggcccctgtcgcgtggtcgtctatgatgatagtcgaccggcctcgtcgggctcccgagcgtattcgtcgtcgctccgaagtcgtacgggaaccgacggccacccgtacgacccgtcgaggcgacgggtaccggtacgggtcggggacgtacgggacggtaccgttagttacgttttggacgtagggttggtaggagtacgttagttttgntagtagttgttggtcggcgggaggacaagcgtacgaccgtccgtcgtacgacggcccgtaacggtccgtaccgcccccgttggtaccgtaccgtccgttccgttccccctacccgttcccgttaccg

SEQ ID NO: 227672 - DNA, 628 bp, Homo sapiens
  misc_feature: GYAE6OF02G6OQ8.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggagccagtgtgagaaagagtgtacactggtaccaacagatcgccgaggccacggccccctgtcgcgtggtcgtctagtgatgataggtcgacccggccctcgtcgggactccccggagccgtacttctcgtggctcgaacgtcgtacgggaacaccggcccacccgtcgacccgtcacgcgacgggtccgacgggtcggggatcggacggtaccgttattacgtttttgtcgttagggtggtagggtataacgtttaagtttggtactagttagttgtttacggtcgggtacgggacgtacgaagtcgtacgaccggttccgtcggtccgaacggtcccgaagggtccctacccggtccccttcgggtcctacccgttccgttcccggttcccgtccccttaccg

SEQ ID NO: 227673 - DNA, 572 bp, Homo sapiens
  misc_feature: GYAE6OF02F38NY.47.53.E09.1.454.CMB.1.raw
  modified_base (362)..(362): a, c, t, g, unknown or other
  misc_feature (362)..(362): n is a, c, g, or t
  modified_base (467)..(467): a, c, t, g, unknown or other
  misc_feature (467)..(467): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgataggtgacccggcctcgtgggactccccggagcgattctctggctaccgaagtctagggaacncggccaccctgaccgtcagcgagggtcgacggtcggggatggagtccgtattgttttgcgtagggtgtgggagtattaagtttggtctagttagtgttggtcggnggacggacagtctacggccgtcgtcggtacacggtacccgaacggtcctcccggtccccgtcggtacctccttacgttcccgttccccctacccttccgtacccg

SEQ ID NO: 227674 - DNA, 572 bp, Homo sapiens
  misc_feature: GYAE6OF02J03UL.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaagaagtgtacactggtaccaacagatgccaggccaggcccctgtcgctggtcgtctatgatgatagtgaccggccctcgtcgggactccccggagcgtattctcgtggctccaagtctgggacacggccaccctgaccgtcagcgacgggtcgacggtcggggatggacggccgtattagttttgcgtaggtgtgggataccgttaattttggtctatagttggtttaggttcgggacgggtagggtaccgaaggtcgtggtacccgtccgtcggtcacggcccacggctccgccccgtcgtccgaccttcctcgttccccgtccctccgtaccg

SEQ ID NO: 227675 - DNA, 174 bp, Homo sapiens; identical to SEQ ID NO: 227362
  misc_feature: GYAE6OF02GGJZ0.47.53.E09.1.454.CMB.1.raw
  modified_base (173)..(174): a, c, t, g, unknown or other
  misc_feature (173)..(174): n is a, c, g, or t

SEQ ID NO: 227676 - DNA, 623 bp, Homo sapiens
  misc_feature: GYAE6OF02IKKOF.47.53.E09.1.454.CMB.1.raw
  modified_base (316)..(316): a, c, t, g, unknown or other
  misc_feature (316)..(316): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctcgngggactccccgagcgattctctggctccaagtctagggaacacggccaccgtgaccgtcagcgagggtcgacggtcgggatggacggtccgtattagtttttcgtgtaggttggtagggagtaacgttaagttttcggtactaagttagttggtttggtttacgggcgggtaaggggaaccgtaaggtccgttacggacccgttaccgtcgggtaccgacggacccgtaacgggtcccgtaccggcccccgttaccgggtccctaccgttccgttacccggtttacccctaccccgttccgtacccg

SEQ ID NO: 227677 - DNA, 791 bp, Homo sapiens
  misc_feature: GYAE6OF02GJSKZ.47.53.E09.1.454.CMB.1.raw
tcagagctcacgtacacgaccggtgctcgatttagagagagtgtgttgggtttgggggactcctgtgccccaccactggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctgtgggctgggtccgtcacgcccccaaggaaacggccctggagtcggcttgcactctatttagtgggatgtatgtagtaacgtactacacgtctattatttacgaagtaggtctcgtaactactacaaccgaaggaacctaacccgttaaaccaaaaaaccgtaaggttaccggttactacggaactaaacgttacgaacccgtaaacgtagaaccgtccgtacggaccgggaaccgaccgggacccaacgtacttaatttacgttggtacgactaacccgacccggtaacctaccgttaaccgtacccggacccgtacggtaccggtaacgggggtaaacttacccgggtaaacccttaaacggttcccggggtttaaccccggtaccccccgggttaccggggggtaccccggtaaacccgggggttaacccccgttttacggtaacccccgttaaccccggttacccgtttaccccccgttaaccgtaccccgtacccccgttacccccggtaaccccggtaaccccggggtcccccctttaaacccgggg

SEQ ID NO: 227678 - DNA, 657 bp, Homo sapiens
  misc_feature: GYAE6OF02HUH8Y.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtatttttcactcagtagtactggagaggctggtgggctcggggtccgtcacgcccccgaagggaaacggcccgtggagtcggcttgctactctatttagttgggatgatgtagaagtactacagtcctattatttacaagagctacactatacaacaaggactaaccttaaccaaaaaaccgtagtacggtacctagaactaacgtacgaaccaaggtacgaacgtcctaggaccggacgaccggaccaactaattaattagtttacgtacgacaaccgaaccggacgtacctaactacccggaccacgtacgtaagggaaacttccggaaactaacgttaccggttacccgacccggtcggggacctaaccggggtaaccccttacggtacccgtaccgttcctaccgtcgacgtacccctacccgaacccgaccgggccctaaccgg

SEQ ID NO: 227679 - DNA, 719 bp, Homo sapiens
  misc_feature: GYAE6OF02HIFWA.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaggattactgtgcggagccagtgtggagaaagagtgtacactggtaaccaacagatcgaccgaggccaggccccctggtcgcgtggtcgtctagtgatgatagcgaccgcctcgtggactccccggagccgtattctcgtcggcctccgaagttcgtacgggaacccaccgggtaccctaccccgtcggtacccgtcgacggaccgacggggttaccgacgggtaccgggggagtacgggacggttccggttaatttagttttttcggtccgtaagggttgggtagggtaacgttaacgtttaaggtttttcggaccttaagttagtttagggtttcggtttaccggggacggtagggtaccccgtaaagggtcccgttacggacccggtttcccgtacggttaccggtacccgacccggtaacggtccctaccccggtacccccgttacccgggttacctacccgttcccggttaccccggtttcccccgtcccccgttcccgttacccgg

SEQ ID NO: 227680 - DNA, 606 bp, Homo sapiens
  misc_feature: GYAE6OF02G5QD0.47.53.E09.1.454.CMB.1.raw
tcagagctcacgtacacgaccggtgctcgatttagagagagtgtgttgggtttgggggactcctgtgcccaccatggacacactttgctccacgctcctgctgctgaccatcccttcatgggtcttgtcccagatcaccttgaaggagtctggtccgacgctggtagaaacccacacagaccctcacgctgacctgcagcttctctggtattttcactcagtagtactggagaggctggtgggctgggtccgtcagcccccgaggaaacggccctggagtggcttgcactctatttattgggatgagtggtagaagtactacagtccattatttacaagtaggctcactatcaacaagacacttaccaaaacctagtcgtactagacaatacgaaccaacgtagaacgcctaggaccggacacggaccaacattatttattgtcgacaccaaccgacgtacctaactacccgaccaggccttagggaaactccgaactaacgttcggttacccgaccccgtggggacccgtacggggtaaccccttggtacctacccggttcctacccgtcgaccgtcccttacccgacccgacgggcccctacgg

SEQ ID NO: 227681 - DNA, 685 bp, Homo sapiens
  misc_feature: GYAE6OF02GA7LB.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtcgctggtcgtctatgatgatagtgaccggcctctgggactccccgagcgattctctggctccaagtcaggacacggccaccctgaccgtcacgcgagggtcgacggtcggggatggacggccgtattagttttgtcgtagggttcggtgggagtaccgttaagtttttggtctaagtttacgttaggttttcggtttacggggtacggggtaacggggtaacccgtaaacggtccgttacgggtaaccccggtttcccggttccgggttacccgaccgggtaaccccggtaaacgggtcccggttacccgggtacccccccgttacccggggttacccgttaacccgtttcccggttacccggttttcccccccgtaacccccgtttccccgtttaaccccgg

SEQ ID NO: 227682 - DNA, 201 bp, Homo sapiens
  misc_feature: GYAE6OF02JE51R.47.53.E09.1.454.CMB.1.raw
  modified_base (192)..(201): a, c, t, g, unknown or other
  misc_feature (192)..(201): n is a, c, g, or t
tcagagctcacgtacacgaccggtgctcgatttagagagagtgtgttgggtttgggagacgtaattttggtcatatgttgttcggcggagggaccaagctgaccgtcctcggtcagcccaaggctgccccctcggtcactctgttcccacctcctctacgtgagctctgagcgggctggcaaggcgcatagnnnnnnnnnn

SEQ ID NO: 227683 - DNA, 662 bp, Homo sapiens
  misc_feature: GYAE6OF02HGN8N.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaaccaacagatgccaggccaggcccctgtgctggtcgtctatgatgatagtcgaccggccctcgtgggactccccggagccgattcgtctggcctcaagtcgtaggaacacggcccacccgtgacccgtcgacgcgacgggtcgacggtcggggagtcgggacggtccgtagttagtttttgtcgtagggttggtggggaacgttaacgtttaagtttttcggtactaagtttagtttaggtttcggtttcgggacggggtaacgggaacccgtaaacggtcgtacggtacccgttcccgtccgggttaccgacgggtaccccgaagggtcccctacccggtccccccgttaccgggttcctacccgttcccgttccggtttcccccgtcccccgttcccttacccgg

SEQ ID NO: 227684 - DNA, 543 bp, Homo sapiens
  misc_feature: GYAE6OF02GQA0T.47.53.E09.1.454.CMB.1.raw
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccaggaaacggccctggagtggcttgcactcatttagttggggatgatgtgaagtactacagtccattattcaagagctcactatcacaagacactaccaaaacagtgtcngacatgacaagngaagcctgcgacacgcacatattattgncacaccgacnctactaccgccagctagggaactcgacaacgtggtaccgacccgtggggaccacgggaacccttggtacctacccgttcctcccgtacaccgtcccctacccgacccgaaccgggccctaccgg

SEQ ID NO: 227685 - DNA, 540 bp, Homo sapiens
  misc_feature: GYAE6OF02HJ3GN.47.53.E09.1.454.CMB.1.raw
  modified_base (502)..(502): a, c, t, g, unknown or other
  misc_feature (502)..(502): n is a, c, g, or t
  modified_base (510)..(511): a, c, t, g, unknown or other
  misc_feature (510)..(511): n is a, c, g, or t
  modified_base (514)..(540): a, c, t, g, unknown or other
  misc_feature (514)..(540): n is a, c, g, or t
tcagagctcacgtacacgaccggtgctcgatttagagagagtgtgttgggtttgggacccccgggcagagggtcgtcatctcttgctctggaagcagctccaacatcggaaggaatgatgtgtactggttgcagcaacctcccccggaacggccccccaaactcctcatctataacaatgatcagccggccctcgacggggtccctggccgattctctggctccaagtcctggccgcctcacgcccacccgtggccatcaggtcgggcctcccggcccgaggatggaggctgattattactgtgtagggttgggatcgcagtcctgactgtactttacgtcgttacggagcgtgggaccaaggtcccaccgtcgtaggtccgacgcccgaaacggccccaaccccgtatcgtacctaacccttcgttaccgttcccccaccccttccttacgtaaccgttgaccgtcctcgtggacggcgggtcctcgggacaacggggccnctaagtgnngcnnnnnnnnnnnnnnnnnnnnnnnnnnn

SEQ ID NO: 227686 - DNA, 623 bp, Homo sapiens
  misc_feature: GYAE6OF02FON1O.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtcgaccggccctcgtgggactccccggagcgattctctcggctccgaagtcgtagggaaccacggcccaccctgacccgtcgagcgagggtcgacggtcgggatgacggtcgtagttacgttttgtcgtaggttggtagggagtacgttaagttttggtactagttagttggtttggttaccgggtcgggtacgggaaccgtaaggccgttacgggacccgttccgttaccggtccgacggaccccgtaaggccctccggtcccccgtccggtcctaccgttcccgtaccggtttccccctaccccgttcccttacccgg

SEQ ID NO: 227687 - DNA, 650 bp, Homo sapiens
  misc_feature: GYAE6OF02IRWLZ.47.53.E09.1.454.CMB.1.raw
  modified_base (259)..(259): a, c, t, g, unknown or other
  misc_feature (259)..(259): n is a, c, g, or t
  modified_base (332)..(332): a, c, t, g, unknown or other
  misc_feature (332)..(332): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattactgtgcgggagccagtgttggagaaagaagtgtacatggtaccaanagatgccaggccaggcccctgtgcgtggtcgtctatgatgatagtgaccgccctgtggctcccgagcgatctntgctcagtctacgggacacggccacctgaccgtcagcgagggcgtacggtcggggacgtcggacggtccgttagttacgttttcggcgtaagggttggtcgggaagtaccgtttaagttttcggtacgtaagttagttcgtttagggtttccggacgggggtaacgggtaaccgtaaggtacctccgggtacccgttacccggttcgggtaccgaccggtcccggaaccgggtcccgtcccggcccccccggttcgggttacccgttacccggttccgttaccccggtttcccccggtcccccttccgtttaccccgg

SEQ ID NO: 227688 - DNA, 518 bp, Homo sapiens
  misc_feature: GYAE6OF02GOUOF.47.53.E09.1.454.CMB.1.raw
  modified_base (422)..(422): a, c, t, g, unknown or other
  misc_feature (422)..(422): n is a, c, g, or t
  modified_base (463)..(463): a, c, t, g, unknown or other
  misc_feature (463)..(463): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttatgggatgatgtgaagtactacagtccatattcaagagctcactatcacaaggacacttacaaaacagtggtcctgacatgaccaacgtgaagcctgcggacacggcacatattattgtgacacaccgacncctataccgccagctagggaatcgacaacgtggtcacccgngggccaggggacccttgccaccgtcctcctcacgccctaccacacgggccctacg

SEQ ID NO: 227689 - DNA, 576 bp, Homo sapiens
  misc_feature: GYAE6OF02IDIAX.47.53.E09.1.454.CMB.1.raw
  modified_base (226)..(226): a, c, t, g, unknown or other
  misc_feature (226)..(226): n is a, c, g, or t
  modified_base (467)..(467): a, c, t, g, unknown or other
  misc_feature (467)..(467): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcggganccagtgttggagaaagagtgtacactggtaaccaacagaatgccaggccaggcccctgtcgctggtcgtctatgatgatagtgaccggcctgtcgggactcccgagcgtattcctcgtcggctccaaggtcgtacgggaaccacggcccacccgtcgaccgtcacgcgacgggtcgacggtcgggatggacggtcgttattagtttttgcgtaggttgtagggtatacgttaagtttggtntattagttgttgttcggacggtaggtacgaagcgtcgaccgtcgtcggctacgccgaacggtcctccgccccgttcgtccgtaccttcgtacttcccctacccttcccg

SEQ ID NO: 227690 - DNA, 548 bp, Homo sapiens
  misc_feature: GYAE6OF02HOHT8.47.53.E09.1.454.CMB.1.raw
tcagagctcacgtacacgaccggtgctcgatttagagagagtgtgttgggtttggggctgggcctaaggaagcagcactggtggtgcctcagccatggcctggaccattctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggccccctgtgctggtcgtctatgatgatagtcgaccggcctcgtgggactcccggagcgattctctggctccgaagtctaggacacggccacccgtgaccgtcagcgacgggtcgacggtcggggatcggaggtccgtattagttttggtacaggttggtgggagtacgtaattttggactattagttgttgtcggcggtacgggacagctacgtaccgtcgtcggtcgacgcccaaggcctcgccccttcggtcacctcttcgtcccaccttcc

SEQ ID NO: 227691 - DNA, 593 bp, Homo sapiens
  misc_feature: GYAE6OF02GMLNF.47.53.E09.1.454.CMB.1.raw
  modified_base (459)..(459): a, c, t, g, unknown or other
  misc_feature (459)..(459): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgcccccaggaaacggcccgtggagtggcttgcactctatttagttgggatggatgtagaagtactacagtcattatttacaagagctcactatcacaagacacttaccaaaacagtgtcctagacaatcgaccaacgtgaagtccgtacgacggaccaccggaccactaagttattagttgtcgacaccgaaccgacgccttaanacccgccaggactagggaacttccgaactaacgtggttacccgacccgtggggacccaacggggtacccttggtcccgtaacccgttccttacccacgtacgccccttaccaacccgaacggtcccctaaccgg

SEQ ID NO: 227692 - DNA, 532 bp, Homo sapiens
  misc_feature: GYAE6OF02I9CE0.47.53.E09.1.454.CMB.1.raw
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (511)..(511): a, c, t, g, unknown or other
  misc_feature (511)..(511): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggcctcgtgggactccccggagcgattctcgtggctccgaatttcgngggaacacggcccacctgaccntcagcgcggtcgaagccgganagtgacggccgactagttactgtcaggtgtaggacgagtaagtagtagatacccgagccgtaggtttcggcggtgggaccaaggcgtgaccgtcgtaatcgagcccgaaggcncgccccgtcgtcacgtctccg

SEQ ID NO: 227693 - DNA, 660 bp, Homo sapiens
  misc_feature: GYAE6OF02HTV6N.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtatttttcactcagtagtactggagaggctggtgggctggggtcctcacgcccccaggaaacggccctggagtggcttgcactctatttagttgggatgatgtagaagtactacagtaccattatttacgaagtaggctacactactacaaccgaaggacctaaccttaaccaaaaaccgtaagtcgtacctagaactaatacgaacctaacgtagaacgtccgtacggaccgggaaccgaaccggacccaaactaagttatttaacgtttcggtacgaccaaccgtaacccgaccgtaccttaacgtaacccgaccgacgtaccggtaagggaaactaccgaacctaacgtccgggttaccgacccggtcggggacccgaacggggtacccttccggtacctaccgttcctccgtaccgacgcccctacccgaccgtaccggccctaccgg

SEQ ID NO: 227694 - DNA, 193 bp, Homo sapiens
  misc_feature: GYAE6OF02HIA1T.47.53.E09.1.454.CMB.1.raw
tcagagctcacgtacacgaccggtgctcgatttagagagagtgtgttgggtgtgggagactaattttggtcatatgttgttcggcggagggaccaagctgaccgtcctcggtcagcccaaggctcgccccctcggtcactctgttccccaccctcctctacgtgagctctgagcgggctggcaaggcgcatag

SEQ ID NO: 227695 - DNA, 629 bp, Homo sapiens
  misc_feature: GYAE6OF02I3H2M.47.53.E09.1.454.CMB.1.raw
  modified_base (226)..(226): a, c, t, g, unknown or other
  misc_feature (226)..(226): n is a, c, g, or t
  modified_base (361)..(361): a, c, t, g, unknown or other
  misc_feature (361)..(361): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcggganccagtgttggagaaagagtgtacactggtaccaacagatgccaggccaggcccctgtgctggtcgtctatgatgatagtcgaccggcctcgtgggactcccgagcgattctctcggctccaagtcgtacggaacncgcccaccgtcgaccgtcacgcgacgggtcgacggtcgggagtggacggccgtagttagttttgcgttaggtggtagggtagtacgttaagttttggtactagttacgttggtttggttccggggtagggtaacgggtaacgtaaacggtccgttacggtacccggttcccgtacggttccgtaacggtcccggaacggtccgttccgaccccccggttcgggtaccctacccgttccgttacccggttcccccgtcccgttaccccg

SEQ ID NO: 227696 - DNA, 546 bp, Homo sapiens
  misc_feature: GYAE6OF02FOIVV.47.53.E09.1.454.CMB.1.raw
  modified_base (431)..(431): a, c, t, g, unknown or other
  misc_feature (431)..(431): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctgggtccgtcacgcccccgaggaaaggccctggagtggcttgcactctatttattgggatgatgtgaagtactacagtccatatttacaagagctcactatcacaagacacttaccaaaacagtcgtcctagacaatgaaccaacgtagaacgccgtaggaccggacaccggaccacgatattattgncacaccgactctactaccgaccagctaggaactcgaactacgtgttacgacccgtgggaccacgggtacccttgaccaccgtctcctacacgccctaccgacgtaccggcctacg

SEQ ID NO: 227697 - DNA, 842 bp, Homo sapiens
  misc_feature: GYAE6OF02H7RSP.47.53.E09.1.454.CMB.1.raw
tcagagctcacgtacacgaccggtgctcgatttagagagagtgtgttgggtttgggggactcctgtgcccaccatggacacactttgctccacgctcctgctgctgaccatcccttcatgggtcttgtccagatcaccttgaaggagtctggtccgacgctggtagaaacccacacacgaccctcacgctgacctgcagtcttctctggattttcactcagtagtactggagaggtctggtgggcgtcggggtccgtcaccgacccccgtaaggaaacggtcccgtgggacgtggcttggacacgttactatttagtgggtatgtatgtagagtactacgatccattattacgaagacgtcactacgtactacgaacgaacggacctaactaaaccaaaaaccgtaggtacggtaccctaaggaacctaaaggtacgtaaacccgtaacggtacggtaaacggtacccgtacgggaaccgggtaaccgtaacccgggaaccttaaacgttaacgtttaaacgttttaacgttacggttaacgacccgttaaaccgggtaaccccggtaacgtaacccgttaacggtaaccccggtaacccgaacgggttaacggtaaacggggtaaaaccttacccggggtaaaaccttaaacccggggttacggttaccccggggtaaccccggttaccggggggtaaaccccggttaaacggggttaaacccccgttcgggttaaccccgtaaccccgggtttaccgttaacccccggtacggttaacccggtaaccccccgtttaccggaaaccccgggttaacccgggggccccctttaaacccgggg

SEQ ID NO: 227698 - DNA, 661 bp, Homo sapiens
  misc_feature: GYAE6OF02HVYC2.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctggtgggctgggtccgtcacgcccccgaaggaaacggcccgtggagtggcttgcactctatttagtgggatgagtgtagaagtactacagtcctattatttacaagtagctacactactacaaccaagacctaaccttaaccaaaaaccgtaagtacgtacctagaacaagtacgaacctaacggtacgaacgccgtacggaccggacgaccggaccaacgtattacttattgtacgacctaacgtaccgacgtacttaacgacccgaccgtacgcgtaacgggaactccgaacctaacgttccgggttacccgacccggttacggggacccgtacggggtaaccccttcggtacccgtacccggttacccttcccgtaccgaccgtacccctacccgaaccggtaccgggtaccccttacccgg

SEQ ID NO: 227699 - DNA, 656 bp, Homo sapiens
  misc_feature: GYAE6OF02H8MRA.47.53.E09.1.454.CMB.1.raw
  modified_base (224)..(224): a, c, t, g, unknown or other
  misc_feature (224)..(224): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtggccccaggacagacggccaggattactgtgcggganccagtgttggagaaagagtgtacacgtggtaaccaacaggatgaccgaggcccaaggccccctgtcgactggtccgttctagtgatcgataggtcgacccggtcctgtcgggtacctccccggagcgtattccgtctggcctaccgaagttcgagggaaccaccgggcccacccgttggaaccctgacggccgtagggtccgaacggtcggggatcggacggtccgtattacgttttcggacgtaggttggtagggaactaccgtttagtttgctaagttacgttggttacgttcgggacgggtacggtacgaacggtctacggtacccgttcgtccggtactaccggcccgtaacggtccgtcccggtacccccgtttggacccttacccgtccgtttaccggtacccccttaccccgttccttaacccgg

SEQ ID NO: 227700 - DNA, 741 bp, Homo sapiens
  misc_feature: GYAE6OF02ILUMB.47.53.E09.1.454.CMB.1.raw
tcagagctcacgtacacgaccggtgctcgatttagagagagtgtgttggggtttggggggactcctgtgccccaccatggacacactttgctccacgctcctgctgctgaccatcccttcatgggtcttgtcccagatcaccttgaaggagtctgggtccgacgctggtgaaacccacaccagaccctcacgctcgacctgcagtcttctcttggtattttcactcagtagtactggagaggctggtgggcgtcgggtccgtcacgccccgaaggaacggccgtgggtagtggcttgcactctatttagtggatgtagtgtagtaagtactactagtcctattactttacgaagtaggtctactactaactacaaccgtaaacggtacctaaccttaaaccgaaaaaccgtacggtacggttaccctagaacctaacgtaccgtaaaccgtaaacggtacggtaaacccgtaccgtacgggacccggaacgacccgggacctaacgttaattaacgttttagttacgtaccgtaccgaaccgtacccgtacgtaccttaacgtacccgaccgtaacgtaccgtaacgggtaaacttaccggtaaccgtaaaccggttccgggttaaccccgtacccgggttacggggaacccgtaccggggtaacccttcggtacccgtacccgttcctacccgtaccaccggtccccttaaccgacccggtaccgggacccttacccggg

SEQ ID NO: 227701 - DNA, 636 bp, Homo sapiens
  misc_feature: GYAE6OF02HXJZK.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcggagccagtgttggagaaagagtgtacactggtaccaacagatgccaggccaggcccctgtgctggtcgtctatgatgatagcgaccggccctcgagggactcccgtggacgccgtcttctcgtcggcctcccgaagttcgtagggaaccaccggcccaccccgtcggaacccgtcgacggcgacggggtccgacgggtcgggggatcgggacgggaccgttagttacgtttttcggtcgtagggttggtgggtagtacgttaagttttggtactagttagttggtttggttcgggacgggtagggtaacccgaagtcgtacggtacccggttccgtccgggtccacggcccggtaacggtcctccggacccccgttcggtaccctaccgttcccgtccgttccccgtcccccg

SEQ ID NO: 227702 - DNA, 620 bp, Homo sapiens
  misc_feature: GYAE6OF02IZMJJ.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaggattactgtgcgggagccagtgttggaagaaagaagtgtacactaggtaccaacagatgaccaggccaggcccctgtcgcttggtcgtctagtgatgatagtcgacccgtcctgacggactccccggagcgtattcctcgtcggctccgtaagtcgtagggaacaccggcccacccgtgaccgtacgagacgacgggtcgtacggtcggggactacggacggtaccgttaagttacgttttagcgtagggttgtcgggaatacgtttagtttcggatatagttggttggtacgggaggtacggacgtaacgcgtacggtaccgtcgtcgtacgtaccggaccggtaacgtccgtcccgttaccccgtcggtacctccgttaccgttccgttccccgtacccttctacccgg

SEQ ID NO: 227703 - DNA, 776 bp, Homo sapiens
  misc_feature: GYAE6OF02GLQW5.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctgtgggctgggtccgtcacgcccccgaggaaacggccctggagtggcttgcactctatttattgggatgatgtgaagtactacagtcctatatttacaagaggtctaccactactaccaacctaaacggacctaaacccttaaacccaaaaaaccgtaaacgttacgggttacccttaggaacctaaagttacgaacccgtaaaacggttacgaaacggtccccgtagggacgggtaaccgaaccgggacccgtaacctaagttactttaagtttacggtacgaccgtaaccgtaaacccggtaccgaaccgttaaccgtaaccccggaccgtaacggaccggttaacggggtaaaacgttaccgaaaccgtaaaccggtttaccgggttaccccggtaacccccgggttcgggggaaccccggtaaccgggggtaacccctttaccggttacccgtaacccccggttacccgttaccccgttccgtaacccgtccccgttacccccgaaacccggtaacccggggtacccctaacccgg

SEQ ID NO: 227704 - DNA, 534 bp, Homo sapiens
  misc_feature: GYAE6OF02G1SZX.47.53.E09.1.454.CMB.1.raw
  modified_base (345)..(345): a, c, t, g, unknown or other
  misc_feature (345)..(345): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (504)..(504): a, c, t, g, unknown or other
  misc_feature (504)..(504): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcacttcagtagtactggagaggctgtgggctgggtccgtcacgcccccaggaaacggcccctggagtggcttgcactcattttatgggatgatgtgaagtactacagtccattatttcaagtggctcactanacaccaagacacttaccaaaactagtcgtctagacatcgaccaacgtgaagcctgacgacacgcacatattattgtncacacgacgctanccgccagctaggaactcgacaacgtggtccgtacccgtgggaccacgggtaacccttgaccaccgttcncctcgacgtcctcccgacgacggccctacg

SEQ ID NO: 227705 - DNA, 799 bp, Homo sapiens
  misc_feature: GYAE6OF02JDSCV.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcacgccccaggaacggcctggagtggcttgctactctatttagttggatgatgtgtaacgtactacacgtacctattatttacgaagtacgtcctacaacttactaccgaaccgaaacggtacctaacccttaaccgaaaaacctaacggtcggttaccctaggaacctaacgtacgaaaccctaacggtacgtaaacggtcccgttaggaccgggaaacccgtaccgggaccctaaccgtaagttaacttttaacgttaggtaccgtaccgtaaaccccgaacccggtaccgtaaccttaaccgttaccccgacccgtaaccggtaccggtaaaggggtaaaacccttacccgggaaaacccttaaaaccgggtttccggggttaccccggtaacccccgggttaccgggggaacccccggtaacgggggtttaaacccccttttcgggttaacccgtaaccccgtttcccgtaacccccgttcggaacccgttacccccgtaacccccggaacccgggtaaccccgggtaccccctttaacccggg

SEQ ID NO: 227706 - DNA, 602 bp, Homo sapiens
  misc_feature: GYAE6OF02HYLB6.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctgtgggctgggtccgtcacgcccccaggaaacggccctggagtggcttgcactctatttagtgggatgatgtgaagtactacagtacctaattatttacgaagtaggctacactatacaccaagacaacttaaccaaaaacagtgtactagacaatcgaaccaagtgaagcctagcggaacaccggaccaacattattattgtagccaaccgaccgacgacctacgaccgaccagacgtagggaactaccggaactaacgtcgggttacccgaccccggtggggacccgtaacggggtaaccccttcgtaccgtacccgttcctaccgtcgaccgccctacccgaaccgaccgggtccctaaccgg

SEQ ID NO: 227707 - DNA, 624 bp, Homo sapiens
  misc_feature: GYAE6OF02GHURP.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtgaccgccctcgtgggactccccgagcgattctctggctccaagtctgggaacacggcctacccgtgaccgtcagcacgggtcgacggtcggggatggacggtccgtattagttttgcgtaggtggtgggagtacgttaagtttggtactagttagttggtttggttccggggacgggtacgggtaaccaaagggtccgtacggtacccggttcccgtccgggtactaccggacccgtaacgggtccctcccggtaccccccgttggtacccgtaccgttcccgttccggtttacccccctaccccgttcccttaaccccgg

SEQ ID NO: 227708 - DNA, 680 bp, Homo sapiens
  misc_feature: GYAE6OF02IPBXC.47.53.E09.1.454.CMB.1.raw
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacgccaggattacttgtgcgggngccagtgttggagaaagagtgtacacgtggtaccaacagatgccaggccacggcccctgngctggtcgtctatgatgatagtcgaccgcctcgtcgggtacncccgagcgacttcncgtaggcctaccgagtcgtaggaacgaccggccacctcgaccgtcacgtcgacgggtcgacgggtcgggagtcggacggtccgttagtttagttttacggtgtagggttgggtgggtaacgtacgtttaagttttcggtcttaagtttagtttcggtttagggtttccggggacgggtacggggtaaccgaacggtccgtaccggtacccggttcccgttcgggtaccgtacccggtacccggtaaaccgggtcccggtcccggtaccccccggttccggttacccgtacccgtttcccggttaccgtttcccccctacccccgttccccgtttaaccccgg

SEQ ID NO: 227709 - DNA, 543 bp, Homo sapiens
  misc_feature: GYAE6OF02FID6A.47.53.E09.1.454.CMB.1.raw
  modified_base (220)..(220): a, c, t, g, unknown or other
  misc_feature (220)..(220): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgngcgggagccagtgttggagaaagaagtgtacactggtaccaacagatgaccaggcccaggccccctgtgctggtcgtctatgatgatagtcgacccggtccctctgggactccccgagccgattctctggctccaagtctagggaaccaccgggcccacccctgacccagtcagcgcggtcgaaacgccgggagatggacggccaacttacttacgtgtcgaggtgtgggactttagaatagtgactccgagtcgaggtttcggcggtgggaccagcgcgaccgtacctaagtcacgccgacgctcgcccctcggtcactccg

SEQ ID NO: 227710 - DNA, 610 bp, Homo sapiens
  misc_feature: GYAE6OF02J0OGQ.47.53.E09.1.454.CMB.1.raw
  modified_base (281)..(281): a, c, t, g, unknown or other
  misc_feature (281)..(281): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtggcccaggacagacggccaggattacttgtgcgggagccagtgtggagaaagtagtgtacacgtggtaccaacagatgcagccacggcccctgngcgtgtccggtcatgatgatagtcggaccgtccctgtcgggactccccgaagcgtattcgactggtactccgaggtcgtagggaactaccggccctaccgcggtacccgtcgacgacgacggtcggacggtacgggagtggacggtcgttaacgttagttttcgagtacggtgtggggattacgttaagtttggtacattacgtggtttcgtacgggtcgggtaacggactacggacgtcgtccgtaccggtcgtctacggacccgagtcccgtcccgtaccccgtccggttacacccgtcgttcctaccccgccccgttacctaccgg

SEQ ID NO: 227711 - DNA, 620 bp, Homo sapiens
  misc_feature: GYAE6OF02I3QQ3.47.53.E09.1.454.CMB.1.raw
  modified_base (415)..(415): a, c, t, g, unknown or other
  misc_feature (415)..(415): n is a, c, g, or t
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgggagccagtgtggagaaagaagtgtacacgtggtaccaacaggaatgccaggccaggcccctgtgctggtcgtctatgactggatagtcgaccggccctgtagggactccccggaagcgtacttctctcggtcctaccaagtctacgggaaccacgggccaacccgtgaaccgttcagcgacggtcgacgtcggganggacgccgtattagttttgctaggtcgtagggagtacttaagtttcgtcgtattacgttgttggttccggcggtaacgggtaccgtaaggtcgacgtaccggtcccgtcggttaccgacggtacccgtaaggtcccgttccgggtccccccttagggttccaacggttcctccggtttaccccccggtcctccccgtttaaccgg

SEQ ID NO: 227712 - DNA, 724 bp, Homo sapiens
  misc_feature: GYAE6OF02HUMI1.47.53.E09.1.454.CMB.1.raw
  modified_base (204)..(204): a, c, t, g, unknown or other
  misc_feature (204)..(204): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttcncgtggtattttcactcagtagtacgtggagaggctggtcgggcgttgggtccgtcgaccgcccccgaagggaaacggcctggtagtggcttgctactctattagtgggatgtatgtagtaagtactacgtagtcctattacgttacaagtacggtctacacttataccaaacgtaacggtaacctaacgttaacccaaaaaacgtaggtacgtacctaggaacctaagtaccgaaccgaagtcggaaacgtccgtaggaccggaacgaccggaccctaaacgacgtttaacgtttaagttacggtacgtaaccgtaaacccgacccggtaactacccgttaaccgttaacccgaccgtacgtaaccgttaggggtaaacctaccgaacgttaacgttccgggtacccggtaccccggtacggggtacccgttaaccgggtaaccctttacggaccgtaacccgttccctaccgtacgacccgtacctaccccggaaccggtacccggtccgttaacccgg

SEQ ID NO: 227713 - DNA, 568 bp, Homo sapiens
  misc_feature: GYAE6OF02IY2UY.47.53.E09.1.454.CMB.1.raw
  modified_base (334)..(334): a, c, t, g, unknown or other
  misc_feature (334)..(334): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaggagtctggtccgacgctggtgaaacccacacagaccctcacgcctgacctgcagcttctctggattttcactcagtacgtactggagaggctgtgggctgggtccgtcacgcccccgaaggaaggcccctggagtggcttgcactcatttattgggatgatgtagaagtactacagtccatattcaagnggctcactatcaaccaagactactaccaaaacagtgccganactgacaacgtnaagcctgcgacacgcacatacttatagtgcctaccgaccacgcttacgtacccncgacgcgtaacggaactcgaacctacgttcggtcccgaacccgtcggggaccgaacggtacccgttagtccaccgtcccttaccgactaccgccctaccgacccgtaacggcccgtacgttacccgg

SEQ ID NO: 227714 - DNA, 680 bp, Homo sapiens
  misc_feature: GYAE6OF02FKC9A.47.53.E09.1.454.CMB.1.raw
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
tcagagctcacgtacacgaccggtgctcgatttagagagagtgtgttgggtttgggggggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaggccctggagtggcttgcactctattttattgggatgatgtgaagttactacagtccattatttacaagagctcactatcaccaagacacttaccaaaaacagtcgtctgacaatcgaaccaagtgaacgcctgacgacacggccanatattattgtncacaccgacgntactaccnccagctagggaactacgacaacttcggtaccgaccccggttcgggcccgtaacggggtaaacccttcggtacccgtaacccggtttctaccccttacgaccgtccccgtaacccacccggaaacccgggccccttaacggtccccgggtttcccgtttccccccgtaagggtccccctaccccttaccccgtacccgaacgtacctcccgtacccgtccgggtacccggggacaccgaccgggcccgggttcccgcgggtcctccggtaccgtaccgggtactaccgggtacctttacccgg

SEQ ID NO: 227715 - DNA, 764 bp, Homo sapiens
  misc_feature: GYAE6OF02IKYL6.47.53.E09.1.454.CMB.1.raw
  modified_base (359)..(359): a, c, t, g, unknown or other
  misc_feature (359)..(359): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttcgtcccagatcaccttgaaggagtctggtccgacgtctgggtacgaaacccacacacgaccctcacgctgacctgcagcttctctggtattttcactcagttagtcgtaggagaggctggtgggctggggttccgcgaccggaccccccgtaagggaaacggtccccgtagggtacggtcggtcgttacggcacgttctaagtttagttgggatgagtgtaggaactactanacgtctaattactttcgaagtaggtctacaacgtactacaacgtaacggtacctaaaccttaaccgtaaaaaacccgtaggttacggtaccttaacggtaactaaaacgtacggtaacccgtaagttacggtaaaccggtacctacgggtaccggaacccgaaccgggtaaccaaaccggttatttaaacggttcctttagggactaccgaaccgtaacccgtaacggaccgtttaacgtaacccgcgtaaccggtaaccgtaagggtaaaccgtacgaacccgttaaacgtcgggttaacccggcccggttacgggaacccgtaccgggtaacccgttgtaccccgtaacggttccctacccgtacgaccgtcccgtaaccgaccgtaccggtcccctaaccgg

SEQ ID NO: 227716 - DNA, 625 bp, Homo sapiens
  misc_feature: GYAE6OF02H9FON.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgacccggccctgtcgggactccccggagcgacttctcgtggctccaagtcgacgggaacacggcccaccctggaccgtcgacgcgagggtcgacggtcggggatggacggtcgtattagtttttcggcgtaggttggtgggagtacttaagttttggactagttagttggtttcgtcgggtcggtaacgggacctaaggtccgtacggaccgttccgtaccgggtcaccggcccgtaacgggtcctcccggtccccccgttcgggtaccctaccgttacccgttcccggttcccccgtacccccgttcccgtttaacccgg

SEQ ID NO: 227717 - DNA, 678 bp, Homo sapiens
  misc_feature: GYAE6OF02I4K68.47.53.E09.1.454.CMB.1.raw
  modified_base (572)..(572): a, c, t, g, unknown or other
  misc_feature (572)..(572): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtcgaaacccacacacgacccctcaccgctgacctgcagcttctctggtattttcactcagtagtactgggagagggctggtcgggcgtgggtacctcgacgccccaaggaaacggccccgtgggagtggtccttgccacgtctattttagttgggatgtagtgtaggaagtactactagtcctaattatttacgaagtcggactacgactactaccaaccaacggacctaactaaccaaaacctagtacgtactacgaacaactacgaaccaacgtacggaacgtccgtaggccggaacgaccggaccactaacttaattacgtgtacgaccgtaccgaacccgaacgtacctaacgacccgaccgtacgacgttaggaactaccgtaacgtaacctgggttacccncccggtacgggacccggtaacggtaacccgtttccggtaccgtacccgttccttacccgtacggtacccgtccctaaccccgaaccggtaccggtacccgtaccgg

SEQ ID NO: 227718 - DNA, 588 bp, Homo sapiens
  misc_feature: GYAE6OF02HNZF5.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctgtgggctgggtccgtcacgcccccgaaggaaacggccctgggagtggcttgcactctatttagttgggatgatgtagaagtactacagtaccattattacaagagctcactatcacaagacaacttaccaaaaccaagtgtcctagacaagtcgaccaacgtagaagccgtgcggacacgacacatattattgtgcacaccgacgtctacaccgccgagcgtagggaactcgaactaacgtcggttaccgacccgtacgggacccgtaacggggtaacccttcggacctacccgttccttacccgtacctaccgtaccccgttacccaccccgtaacgggtcccctaccgg

SEQ ID NO: 227719 - DNA, 680 bp, Homo sapiens
  misc_feature: GYAE6OF02JEU90.47.53.E09.1.454.CMB.1.raw
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctgatgtcagtggccccaggacagacggccaggattacttgtgcggganccagtgttggagaaagagtgtacactggtaccaacagatgccaggccgacggcccctgngctcggtcgtctatgatgatgtgacccggccctgtcgggactccccggagcgtacttctcgtgctccgaagtcgacgggtaaccacggccctacccgtcggacccgtcacgccgtagggtaccggacgggtcgggagtacgggacgggtccgttaagtttgtttttcggtaccgtgggttacggtgggtaacgttaaccttaagtttttcgggtacttaagttagtttcggtttacgggtttccggggacggggtacgggtaacctaagggtccttaccggaccgttccggttcggtacgtaccggtaacccggaaccggttccgtacccgtcccccggttcgggtacccttaccgttcccgtttcccgttacccccgttaccccctccggttaccgg

SEQ ID NO: 227720 - DNA, 604 bp, Homo sapiens
  misc_feature: GYAE6OF02HU952.47.53.E09.1.454.CMB.1.raw
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcgccccaggacagacggccaggtattactgtggcgggagccagtgttggaagaaagaagtgtacacgtggtaccaacagatcgccaggccacggcccctgtcgctggtcgtactatgatgacttagtcggacccggccctcgtgggactccccgagcgtattcnctgctcagtcgaggacncgccaccctgaccgtnacgcgaggtcgacggtcgggatgacggtcttagttagtttttgtcgtagggttggtagggtatacgtttaagttgtactnttagttggtttggtcgggngggtaacgggaccgacggtctacggtaccgttccgcggtccgacggcccgaacggtcctcccggcccccgttcggtacctaccgttccgttcccggttccccgtccccttccgttacccgg

SEQ ID NO: 227721 - DNA, 642 bp, Homo sapiens
  misc_feature: GYAE6OF02H4QEE.47.53.E09.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgagagctgattcaggcaccctcgatgtcagtcggccccagganagacggccaggtattactgtgcgggancgagtgttggaagaaagagtgtacactaggtacaacagatgccaggccaggcccctggtcgcgtggtacgtctagtgatgataggtcgacccggtccctgtcgggactcccggagtcgtacttccgttcgtcggcctaccgtaaggtccgtaaggggaacccaccggaccctacccggtcgaccgtctacgacgtaggggtccgacgggtacgggagtcggacggtacgttatttagttttcgtacgtaggttaggtagggtaacgttaacgttaggttttagtactagttacgttggttacggttcgggacgggtacgggaaccgaagtcgtacgaccgtccgttcggtacgccgaccgaacggtccgtccgccccgtcggtacctcctaccgttcgttccccgtcccttcccg

SEQ ID NO: 227722 - DNA, 191 bp, Homo sapiens
  misc_feature: GYAE6OF02IIEED.47.53.E09.1.454.CMB.1.raw
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttcccaccctcctctacgtgagctctgagcgggctggcaaggcgcatag

SEQ ID NO: 227723 - DNA, 749 bp, Homo sapiens
  misc_feature: GYAE6OF02JS92V.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatccttcatgggtcttgtcccagatcaccgttgaaggagtctggtccgacgctaggtagaaacccacaccacgaccctcacgcctgacctgcagtcttctctggatttcattcgagttagactggagtagggctggtgggctagggtcccgtcgaggtacccccagggaaacggcctgggacgtggcttggctaacgtctagttttagtggggactgagttagtaaacggtaaacgtttaccacgttactactaagtttacgtaacgaacggtacgtactaccgtactaacgtacccgaaaaccgtaacgtaaacccctttaaaccgttaaaaacccgaaaacggttacggttccgtaaccgtaacgaaacctaacgtaccgaaaccggtaggtaacgacccgtacggaccgggaacctaaccggaccgtaactaagtaagtttacttcgtacgaccaccgtaaccgtaccgccttaagtacccggaccgaaagtcgtaacgggaaacttcgaaccaaaccgttggggttcccgaacccggtaccgggttccggaaccgggtaacccgtttccgtacctacccggtacccgtccctaccgacggaccccgttacccaaccggaccgggtcccctacccg

SEQ ID NO: 227724 - DNA, 602 bp, Homo sapiens
  misc_feature: GYAE6OF02IV4A4.47.53.E09.1.454.CMB.1.raw
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (448)..(448): a, c, t, g, unknown or other
  misc_feature (448)..(448): n is a, c, g, or t
  modified_base (569)..(569): a, c, t, g, unknown or other
  misc_feature (569)..(569): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgngcggganccagtgttggagaaagagtgtacactggtaccanagatgccaggccaggcccctgtgcgtggtcgtctagtgagtgataggcgaccggtccctcgtcgggactccccggaggcctagttcctcgtggcctaccgaagttcgtaggaaccacggtcccacccgtacggacccgtcgaggccgagggtccgacgggtcgggatcggacgtccgtagttattttcggngtagggtgtgggagtacgttaagtttggctagttgtagttcggtacgggcggtacgggactacggcgtcggaccgtaccgtcggacgcgacccggagccgtaccgtcccccgtcggtaccnccgttccgtccgtaccccgtccctcccgtaccg

SEQ ID NO: 227725 - DNA, 753 bp, Homo sapiens
  misc_feature: GYAE6OF02JEWQC.47.53.E09.1.454.CMB.1.raw
  modified_base (225)..(225): a, c, t, g, unknown or other
  misc_feature (225)..(225): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacgccaggtattactgtgcgggacnccaggtgttggagaaaggaagtgtactacgtcggtaaccaacgtagactcgaccgacggaccctacgggtccccctggtcgtccgttcggggttccgttacgtattcggtaacgttacggtaacgttaggtacccgtacccgggtccccgttacggtacggggaccttcccccggaaggtccgtaactttcctcgtcggtcctaccgtacgtcgtacgggaccacggtcccgacctacggtacccgtcgaacggtcgtacggggtaccgtacgggcgggtaactcgggacggttccgttaagtttacgtttcgtacgtaggggttcggttacgggtacgttaacgtttcggttttaacggtccgttaagttagttcggtttacggtttaccgggacggggacggttaaccgacggttcgtaccgggtccgtccggttcgacgaccggtacctacggtaccgtcccgtacccccgtttcggtaccttacccgttccgtcccgtttaaccccgccccgttaccgttaacg

SEQ ID NO: 227726 - DNA, 692 bp, Homo sapiens
  misc_feature: GYAE6OF02GHQLY.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagtcttctctggtattttcactcagtagtactggagaggtctggtgggcgtcgggtccgtcgaccggcccccgaagggaaacggcccgtggagtggcttgctactctatttagtgggatgagtgtagaagtactacagtcctattattagaagagtctactactactaccaacgaacgacctaaccgttaaccaaaaacgtacgtcggtactacgaactaagtacgaacctaacggtagaacgtccgtacggtccggaaccgaccggtacctaacgtactttaagttacgttacggtacgtaccgaaccgtacccgacgtacttaccgacccgaccgtagtaccggtaacgggaaactacggaaccgtaaccggttcgggttacccgaaccccgggtggggaacccgtacggggtaacccttcggtacccgtacccgttccgtacccgtacgtaccgtccccgtaccgtaccggaccggtcccttacccggg

SEQ ID NO: 227727 - DNA, 749 bp, Homo sapiens
  misc_feature: GYAE6OF02HVBOJ.47.53.E09.1.454.CMB.1.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
tcagagctcacgtacacgaccggtgctcgatttagagagagtgtgttgggtttggggcgtgggcctaaggaagcagcactggtggtgcctcagccatggcctggaccgttctcctcctcggcctcctctctcactgcacaggctctgtgacgtccgacgagctgattcaggcaccctcgatgctagcggccccaggacaggacggccaggtattagtgtggcgggancgtagtgttaggaagaaagagtgtaacacgtacggtaccaagagatcgccgaggccgacgtccccgtggcgtcgtggtaccgttctacgttagnttgagtacgtcggacccgtccgttcggtcggaccgccccgagccgtaactcctcgtacggcctacgtaacgtcggacggaaaccgaccggtacctacccgttacgaccgtacgacgtacgggtacgggtccgtaacggggcgggtaaacgtacggacggtaaccgttactttaaggttttcgtaccggttaagggttcggttacgggaacggttaaccgttttaagggtttacgtaacggttaacttagggtttaacgtttcggggtttaccggggtaaccggggaacgggttaaacccgtaaggtccgtaaaccggttccgtaccgtacccggtacgtaccgaaccgggtaccggttcgaccccgtccccggtttaggtccctaaccgtttcccgacccggttttaccccacccgtttcctaaccgg

SEQ ID NO: 227728 - DNA, 701 bp, Homo sapiens
  misc_feature: GYAE6OF02IKT60.47.53.E09.1.454.CMB.1.raw
  modified_base (225)..(225): a, c, t, g, unknown or other
  misc_feature (225)..(225): n is a, c, g, or t
tcagagctcacgtacacgaccggtgctcgatttagagagagtgtgttggggtttggggctgggcctaaggaagcagcactggtggtgcctcagccatggcctggaccgttctcctcctcggcctcctctctcactgcacaggctctgtgacgtccgacgagctgattcaggccacctcgatgtcagtcgccctggacagacgccaggtattactggtggcggganccgtagtggttacgaagaaagtagtgtacacgtcggtaaccaaacagatcgaccacggaccgaccgggccccttggtcgtcggttcggtccgttacttaagtagtagtacggtattacgggtaccgacccggtccccttggaccgggtaacctccccggagtacctcgttcctcggttacggtccctaccgtaacggtcgtacgggaaacctcccggaccctacccgtcgaccgtcgacggcgtagggccggacggtcgggagtcggaccgttacgttatttgtttcggtctaagggtggtaaggtcttaagtttagttacgtataagttcgttagggtttcggtacgggacgggtaacggacctaacggtcgttaaccggtacccgttcggcggtacgtaccggaccgtaaccgggctccccggtccccgtacggtcctacgttccggttcccgtcccgttcccctaccggttcg

SEQ ID NO: 227729 - DNA, 671 bp, Homo sapiens
  misc_feature: GYAE6OF02I89E4.47.53.E09.1.454.CMB.1.raw
  modified_base (319)..(319): a, c, t, g, unknown or other
  misc_feature (319)..(319): n is a, c, g, or t
tcagagctcacgtacacgaccggtgctcgatttagagagagtgtgttgggtttggggcgtgggcctaaggaagcagcactggtggtgcctcagccatggcctggaccgttctcctcctcggcctcctctcctcactgcacaggctctgtgacgtccgacgagctgattcaggcaccctcgatggtcagtggcccccaggaccagaccggccgaggtacttacttggcgacgggagcccagttgttggaagaaagaagtgtaacactggtaccaacagatacgccaggccaggccccctggtcgctgggttcgtacctancggtatgactaggtcgaccggccccttgtgggacttcccccgagcgtattctctggctaccaagtctacgggaacacggcccacctcggaccgtcgagtcgagggttccgacggtaccggggtagtcggacggtccgttaacgttagtttttacggtccgtagggttacggttacgggtagttacgttaaagtttttcggttacgtaacgttagttggttttggtaccgggtcggtaacggggtaccaacggtcgtacggtaccgtcccgtcggtacgaccggtcccgaacgtcgaccgtccccgttaccggttccaccgttccgttcctaccccgtaccgttacccgtccg

SEQ ID NO: 227730 - DNA, 898 bp, Homo sapiens
  misc_feature: GYAE6OF02JVWB5.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagtcttctcgtggtacttttcactctagtagtactgggaggaggcgtggtgggtcgtaggggtccgtccgaccgtcccccgaagggaaacggtccccgtgggagtcggtcgttgctactctattttagtcgggtatgtatggtagtaagttaaccgtactacgtccttaattactttaccgaaaggtacggtctacgaccttacgtaccgtaaccgaaacggtaacctaacccttaaacccgtaaaaaaccgtaacggttaccggtaccttacggtaaacctaacgtaacggtaaacccgtaacgggtaacggtaaaccgtacccggttaccgggaccgggtaaccgaacccggggtaaaccctaaccgtaaacttttaacggtttaacgtttaacgggtacccgtaaccgaacccggttaaacccgggtacccgttaaccgttaaaccccggtaacccgtaaaccccggtacgggttaaaccggtaaacgggggttaaacctttaacccgggaacccgttaaacccgggttacccggttacccgggacccccgggttacgggggttaaccccgggtaaccgggttaaccccgtttaccggttaccccggtaacccggttcccgttaaccccgtaccggttaacccgtccccccggttaacccgaccccgggttaaccccggtaccccggtttaaccccgg

SEQ ID NO: 227731 - DNA, 658 bp, Homo sapiens
  misc_feature: GYAE6OF02JPGBM.47.53.E09.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
tcagagctcacgtacacgaccggtgctcgatttagagagagtgtgttgggtttggggcgtgggccgtaaggaagcagcactggtggtgcctcagccatggcctggaccgttctcctcctcggcctcctctctcactgcacaggctctgtgacgtccgacgagctgattcaggccaccctcgatgtcagtcggccccaggacngacgccaggattacttgtgcgganccaggtgtgganaaagagtgacagtggtaaccaanagactgccaggccacggcccctgtgcttaggtccgtctatgacnggtatggtcgaccgtcctcgtgggacctccccgagctacgttcncgtgctaccaagtctaggaacnccgacctcccngacctcgacgcgacgggtcgacgggtcgggagtcggacggtacgttaacgtttgttttacggacgttagggttagttcggggtaacgtaccgttaaagttttcggtacgttattacggtttggttacggttcgggtacggtaacgggaacctaaggtcgttaccggtaccgttcccgttaggtacgaccgggtacccgtaacgtccgtaacccggttccccgacggttccctacggttcccgtaccggttcccccgtaccccgttccgttacccgg

SEQ ID NO: 227732 - DNA, 804 bp, Homo sapiens
  misc_feature: GYAE6OF02HB0FE.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatccttcatgggtcttgtccagatcaccttgaaggagtctggtccgacgcgtggtacgaaacccacacacgaccctcacgctcgacctgcagcttctctggtattttcactcagtagtacgtggagaggtcttggtcgggtcgtcggggtccgtcgaccgacccccgaagggaaaacggtcccgtagggtcggtcggtcttacggacctaccgttacgtaagtttttaggttgggtaataggtattacggtaaggtaaacgttaactaaccgtacgttacctaattaacgtttacgaaacggtaacggtcttaccgaacttaacgtaaccgaaaccgtaaacggaacctaaaccttaaacccgtaaaaaaccgtaacggttaccggtaccgtaacggtaaactaacgtacgtaaaccgtaaacggttacgaaaccgtaccgttacggaacccggtaacgaccggaaccaacctaaagtttaacgtttaacgttacgtacgaacctaaccgtaacccgaacgtacccgtttaaacgacccggaccgtaaggaccgttaacgggaaacttaccggaaaccgtaacgtacgggttacccgacccggttacggggaccctacgggtaaaccccttggtaccgtacccgttcgtaccgtccgtacgccccgttaaccgaacccgacggacccttaccgg

SEQ ID NO: 227733 - DNA, 691 bp, Homo sapiens
  misc_feature: GYAE6OF02J1T3I.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtagaaacccacacacgaccctcacgctgacctgcagcttctctggtattttcactcagtagtactggagaggctgtgggctgggtccgtcgacgccccgaggaacggcccgtggagtggcttgctactctatttgtgggatgagtgtagaagtactacgacgtacctattactttacaaggtacggtacctacgaacgttactaccgaaccgaacggtaacctaaccgttaaaccaaaaaccgtaagtcggtacctagaactaacgtagaaccgtaacgtagaacgccgtcggaccggaacgaccggaccaacgtatagttacgttgtacgacaaccgaccggtactacgttaccgtacccgccgtaacgtacgtaagggtaaaccttaccgaacgtaaccggtccgggttaacgaccccggtacgggacccgtaaccgggtaacccttacggtacctaacccggtttccacccgttaccgaaccggtccccgtaacccgaaccggtacccgggtaccctaaccgg

SEQ ID NO: 227734 - DNA, 737 bp, Homo sapiens
  misc_feature: GYAE6OF02IUMPX.47.53.E09.1.454.CMB.1.raw
  modified_base (169)..(169): a, c, t, g, unknown or other
  misc_feature (169)..(169): n is a, c, g, or t
  modified_base (658)..(658): a, c, t, g, unknown or other
  misc_feature (658)..(658): n is a, c, g, or t
tcagagctcacgtacacgaccggtgctcgatttagagagagtgtgttggggtttggggggtcttgtcccagatcaccttgaaggagtctggtccgacgctggtgaaacccacacagaccctcacgctgacctgcagcttctctggtatttttcactcagtagtactggngaggctgtgggctggggtccgtcacgcccccgaaggaaacggccctggagtggcttgcactctatttagtgggatgatgtagtaagtaactacgagtcctaattagtttacgaaaggtacggcctacaactactacaaccgaaaggtaccaaccttaaaccaaaaaacccgtaacggttacggttacctaggaaacctaaagtacgtaaacccgaacggttaggaacgtacccgtggaaccggaacaccggtacaaccaattactttaagtgtacgacaccgaaccgacgtactaacgtaccgaccaaggtccgtaagggaactccgaacgacgttacgtaccggtaacccgcgggtaccgaacgggtaccttacggtctaacccgtccttcctaccgaccgtacctacccgaaccgaccggacccgtaccgttccggttacccctaccccgtcggaacccctccccgttaccctaccgaacgtaaccnccgtacccgtacggtccgggaacacgtacgggccgtcccggtgggccgtacggccgtacggactacggacccttaccgg

SEQ ID NO: 227735 - DNA, 742 bp, Homo sapiens
  misc_feature: GYAE6OF02HRSAQ.47.53.E09.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtcgaaacccacacagaccctcacgctgacctgcagtcttctctggtatttttcactcagtagtacgtggagaggctggtggggcttggggtccgtcacgcccccgaaggaaacggcccgtggagtggcttgcactctatttagtgggntgatggngtaagtactacngtacctaattattacgaagtaggtctacaactactaccaacaacggacctaaaccttaacccaaaaacctaaggtcggtacctagaacctaagtacgaaccgaagtacgaacgtaccgtacggaccggaaccgaccgggaccctaacgtaattaactttagttacggtacgacctaaccgaacccggtaccgtaccgttaaccgtaaccccggacccgtaacggtaccgggttaagggtaaaccttaacccgaaaccgttaaaccggttaccgggtttaccccggaaccccggttcgggggaacccctaaccgggggttaacccctttccggtacccgtacccggttcccttacccgttaccgacccgtaccccgtaccccgaacccggtacccgggcccttaacccggg

SEQ ID NO: 227736 - DNA, 535 bp, Homo sapiens
  misc_feature: GYAE6OF02GMO7H.47.53.E09.1.454.CMB.1.raw
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
tcagagctcacgtacacgaccggtgctcgatttagagagagtgtgttgggtttgggggactcctgtgcccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggctgggtccgtcacgcccccgaaggaaacggccctgggagtggcttgcactcatttagtgggatgatgtgaagtactacagtccatactttcaagagctcactatcacaagacactacaaaacagtgtctgacatgacaagngagcngcgacacgcanatattatgngcacaccgactctactacccgccagcgtagggaactcgaactaacgtggtacccgacccgtggggacccacgggtaacccttggtccaccgtcctcgtaccacgccctacccaccgacggccctacgg

SEQ ID NO: 227737 - DNA, 757 bp, Homo sapiens
  misc_feature: GYAE6OF02GKSBO.47.53.E09.1.454.CMB.1.raw
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagtctgacttcgacggccaccctcgatgtcaggtcggaccccaggaccagaccggccagggtacttaccgttgtcggccggggtacncccgagtcggttaggaacgaaacggtacgtcgtacctacgtcgtaaccaacngactcgccaggcccgacggtcccctggtcgcttagggtcgtacttactgacgtgagttacggtccgacccggtcccttcggtcgggtacctccccggtagtccgtacttccgtcgtcggcctaccgtaagtcgtacgggaacctaccgggcctacccgtcggacccgtacgacggtaccgtacggggtccgacgggtcgggactcgggtaccgtaccgtttagtttacgttttcgacggtggttacggtacggactttaacgttagtttcggactagtttacggtcggtttacgtccggtaaccgggacggtaacctacggtccgtaccgggtaaccgtttccgacggttaccaaccgggtacccgtaaccggtcccttaccccgggtaccccgttacggtaacccttacccggttccccggtttaacccggtccccccgttaccgttcccggttaccgg

SEQ ID NO: 227738 - DNA, 710 bp, Homo sapiens
  misc_feature: GYAE6OF02I05HC.47.53.E09.1.454.CMB.1.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggcccaggacagacgccaggattactgtgcggncagtgtgagaagagtntacactggtacaanagatcgccaggccacggccctgtcgctggtcgtctatgtatgatagtcgacccggtcctcgtaggacctccccgagcgtattcgtcgtcggtcctaccgaagtcgtacggaacgccggacccacccgtacggacccgtacacggacgacgggtacggacggtcgggagtgggtacggtaccgttatttagttttcggtacggtagggttaggtacgggttaacgttaacgtttaacgttttcggtacgttaacgtttaggtttacggttttacgggttaccggggtaaccgggtaacggggtaaccttaacgggtaccgtttacgggtaaccccggttccgttaccgggtaccgaaccgggtaccccgtaaacgggtcccgttacccgtaccccccggtttggtacccgttaccgttcccgttacccggtttacccccttacccgttacccgtttacccgg

SEQ ID NO: 227739 - DNA, 892 bp, Homo sapiens
  misc_feature: GYAE6OF02F1WQ7.47.53.E09.1.454.CMB.1.raw
  modified_base (242)..(242): a, c, t, g, unknown or other
  misc_feature (242)..(242): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgaccgtccgacgagctgacttcaggccaccctcgatgtacagtcggccccaggacacgaccggccacggtacttaccgttgtcggccggggtacncccgtaggtcgtttacgggaacgtaaacgacggttacgtaaccgtaccgtacggttaacccaacgtacggtaactccggaccccgtaacgggtccccgaaccggggtccccccttggtccggccttacgggttcccgttacgtacttacggaacttaggtacgttaacggttccggaaccccggtccccgttacggtaccgggtaccctacccccggacgtaccggttaacttccgtccggtaccgggtcccttaacccggtaacggtttacccggtaacggggtaacccgaccccgggtaccccgtaaccccggttaccgtaaccccggtaccgacgggtcccgtaaaccggggttcccggtaacccgggttaccggggaactccgggtaaccgggtacccgtttaaagtttacgtttttccggacgtacgggttaggtaccgggtaacgttaacgtttaacgtttttcggccgttaaagtttcgttacggtttacggtaccgggacgggtaacggaccgtaacgtccgtacgtacccgtccgttacccgggtacgtaccggtacccggtaacggtccctacccggtcccccgttaggtccccgtaccgttacccgttacccggtaccccctaccgttcccgtaaccgg

SEQ ID NO: 227740 - DNA, 694 bp, Homo sapiens
  misc_feature: GYAE6OF02I6F52.47.53.E09.1.454.CMB.1.raw
  modified_base (222)..(222): a, c, t, g, unknown or other
  misc_feature (222)..(222): n is a, c, g, or t
  modified_base (324)..(324): a, c, t, g, unknown or other
  misc_feature (324)..(324): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcagcaccctcgatgtcagtggccccaggacagacggccaggattactgtgcggganccagtgttgagaaagagtgacactaggtaccaacagatcgaccaggccgacggccccctgtcgctgggtacgtctaatggatgataggtcgacccggcctgngggctccccgagcgtacttctcgtcggtcctaccgaagtccgtagggaaccaccggtacccacccgtcgacccgttcacgccggtagggtaccgacgggtcggggactagggaccggtccgttagtttacgttttcggacgtagggttaggtaggggtaacgttaacgtttaacgtttttgggaccttagttaacgtttggtttcgggttacgggtccgggtaacgggaaccctaagggtccgttaacggtacccggttccggttcggtaccgaccgggtacccgtaacgggtcccgttcccggacccccgttgggtaccctccgtttcccggttacccgttacccccttaccccgtccctttacccggg

SEQ ID NO: 227741 - DNA, 771 bp, Homo sapiens
  misc_feature: GYAE6OF02FMI8Q.47.53.E09.1.454.CMB.1.raw
  modified_base (225)..(225): a, c, t, g, unknown or other
  misc_feature (225)..(225): n is a, c, g, or t
  modified_base (382)..(382): a, c, t, g, unknown or other
  misc_feature (382)..(382): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggtcaccctgatgtcagtggccccaggacagacggccaggattacgttgtgcggganccagtgttggagaagaagtgtacactggtaccaaacagatgccacggccaggcccctgtcgctggtcgtctatgatgatagtcggaccggcctcgtcgggacctaccccggagcgtagttccgtcgtggtctaccgaacggttcgtacgggaaaccnccgggaccctacccgtacgacccgtactaacggaccgacgggtaccggtacgggttacggggacgtacggtaacgggtaccgtttaagtttaacgtttttcggtacggttaacgggttgggtaacgggttaacggttaaaccgttttaaacggtttttggtaaccgttaaacgtttaaggtttgggtttacggtttaccggggtaacggggtaacgggtacccgtaaacggttcgtaaccggttacccgggttaccgtccgggttaccgtacccgggtaaccccgtaaacgggtcccgtacccggttaccccccggttaccgggttcccgaacccggttttacccgtttcccggtaccccccgtttaccccgttaccccgttaacccgg

SEQ ID NO: 227742 - DNA, 539 bp, Homo sapiens
  misc_feature: GYAE6OF02H0LV7.47.53.E09.1.454.CMB.1.raw
  modified_base (261)..(261): a, c, t, g, unknown or other
  misc_feature (261)..(261): n is a, c, g, or t
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattaacttgtgcgggagccagtgttggagaaagagtgtacactggtaccaaanagatgccaggccaggccccctgtgctggtcgtctaatgatgatagtgacccggcctctgggatccccgagcgatctctggctcaagtcngggaactacggccaccctgaccgtcagcagggtcgacgtcggggatgagctatnttttgcaggtgtgganactaattttggcatatgttggttcgnggagggacctaaggntagaccgtcctcggttacacgccgaaggctacgcccccgtcggttccgacttccgtacggttccccacccttccctcg

SEQ ID NO: 227743 - DNA, 746 bp, Homo sapiens
  misc_feature: GYAE6OF02I1VDN.47.53.E09.1.454.CMB.1.raw
  modified_base (188)..(188): a, c, t, g, unknown or other
  misc_feature (188)..(188): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacaccagaccctnaccgctgacctgcagcttctctggtattttccactcagtagtacgtggagtaggctggtgggctgggtccctcacgccccgaggaaacggcctggacgtggtccttgccacttctattttagtgggatgtagtgtaggaagtactaacgtagtccaattactttacaaggaggactccaacttaacacctaaccgaaaggacctaaccgtaaccaaaaaccgtaagtcggttaccctagtaaccacgttaacgaacccgtaaccgttaacgaacggtacccgttacggaccgggaaccaccggggacccctaaacgtaaacttaacgttttaacggttttaggtaccgacgaaccgtaaccccggaaacccgtccgttaacgtaaccccggtaccgaacgttaccgggtaaggggaaccttaaccggtaacctaacgttaaccgggttcccgtaaccccgtccggggtaccgtaccgggggtacccttaacggtccgtaacccggtcctacccgttaccgaccgtcccgtacccgtaccgtaccggtaccctacccgg

SEQ ID NO: 227744 - DNA, 715 bp, Homo sapiens
  misc_feature: GYAE6OF02ISVLH.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattactgtgcgggagccagtgttggagaaagagtgtacactggtaaccaacgagatgccaggccaggcccctgtcgcgtggtcgtctatgatgatagtcgacccggccctcgtagggactccccggagcgtattctacgtggcctacgtaacgtcgtacgggaaccaccgggcccacccgtcgacccgtcgacgcgacgggtcggtacgggtcggggatacgggacggtaccgttaagtttacgtttttacggtacggttagggttcgggttaggggtaacgtaaccgttttaaagtttttcgggacgttaagtttacggtttaggttttcggtttaccggggacgggtaacgggtaaccgtaaacggtccgtaccgggtacccttccggttaccggtaccgtacggaaccccgtagggtacccgtacccggtaccccccgttacgggttaccctacccgttcccgttacccgtttacccccgtaccccgttacccgtttaacccgg

SEQ ID NO: 227745 - DNA, 653 bp, Homo sapiens
  misc_feature: GYAE6OF02H1JKK.47.53.E09.1.454.CMB.1.raw
  modified_base (408)..(408): a, c, t, g, unknown or other
  misc_feature (408)..(408): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtggccccaggacagacggccgaggattacttgtggcgggagccgagtggttggaagaaagagtgtacactagtaccaacagtatcgaccgaggccgacggcccctgtgcgtggtcgtctagtagatagtagtaggtcggacccggtccctcgtcgggacctccccgagtccgtacttctcgtcggtcctaccgagtcgtacgggaaccaccggccctacccncggacccgtcgacgcgacgggtcggacggtcggggatcggacggtccgtattacgttttcgtgtaggtaggtgggtaagtaactttagtttggactagtttagttggttagttcggggacggtacgggtaaccgtaagtcgtacggtacccgttccgtaccgtacgaccggacccgtacggtcctaccggtcccccgttcggtccttaccgtccgttccccggttcccgtacccctcttacccgg

SEQ ID NO: 227746 - DNA, 725 bp, Homo sapiens
  misc_feature: GYAE6OF02FGTOG.47.53.E09.1.454.CMB.1.raw
  modified_base (253)..(253): a, c, t, g, unknown or other
  misc_feature (253)..(253): n is a, c, g, or t
  modified_base (354)..(354): a, c, t, g, unknown or other
  misc_feature (354)..(354): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctcgtcgaccgtccgacgagctgacttcgacggccaccccgtcgatcgtaccacggtccggccccaggacacggaccggcctaggtacttaccgttggcggccgggtacnccgtagtcggttaggaaacgaagtacgtcgtacacgtacgaaccaagagacgtcgaccgtacggcccgacggtcccctggtccgtcttaggtccgtactanagtacgttacgacgtaccggtccggacccgtcccgtaggtaccggccctaccccggagtccgttactccgtgtaccggtctaccggtacgtccgtaacggacccaccgtacccgtccgacggtacccgtacgacggtacggtacggtccgggacggtcggacgtacggtaccgtacgtttagtttcgtacgtcggtaggtgtacggttactacgtttagttcgtagtaggttcgtacggttacggtaccggagggtaccgtacgacgtaccgtcgtacccgtaccgtcggtaccaccggtacccgacgtccccgtacccgtccgtccgttaccgtccgtccccgttcccggtacccctccgttcgtaccgg

SEQ ID NO: 227747 - DNA, 826 bp, Homo sapiens
  misc_feature: GYAE6OF02GF25C.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctggtgggcgtgggtccgtcacgcccccaggaacggccctaggacgtggcttgcactctatttagtgggatgatgtagaagtactacagtcctatatttacgaagaggtctcactactacaaccgaaggacctaaccgttaaacccaaaaaccgtaaggtacggtaccctagaactaaacgttacgaaacccgtaacgtaacggaacgtccgttaacgggacccgggaaaccgaacccgggtacccaaacgtaacgtttaacgtttaacggtttcggtacgtaaccgtaacccggaacccgtacccgtaaccgttaacccgtaaccccggtacccgaacgggttacccggtaaagggggtaaaacccttacccgggtaaaaccgttaacccggtttaccgggggtttaacccccggtaaccccccggggttagggggggaacccccgttaaaccggggggttaaaccccccgtttaccggttacccccggttaaaccccgttcccgttaccccgttaaccccggtaccgttaccccccgtaacccccggaaaccccggggttaacccgggtacccccgttaacccccgggg

SEQ ID NO: 227748 - DNA, 658 bp, Homo sapiens
  misc_feature: GYAE6OF02GRN9X.47.53.E09.1.454.CMB.1.raw
  modified_base (519)..(519): a, c, t, g, unknown or other
  misc_feature (519)..(519): n is a, c, g, or t
tcagagctcacgtacacgaccggtgctcgatttagagagagtgtgttggggtttgggggactcctgtgccccaccatggacacactttgctccacgctcctgctgctgaccatcccttcatgggtcttgtcccagatcaccttgaaggagtcgtggtccgacgctggtacgaaacccacacagaccctcacgctgacctgcagcttctctggtattttcactcagtagtactggagaggctggtcgggcgtggggtccgtacgaacgcccccgaagggaaacggccccgtgggacggtggcgtttggcctactctaatttttagtgggatggtatggtagtaagtactacgacgtaccattagtttacaagacggctcactacacaaccaagactaacttaccaaaaacgagtacgtcctagaacatcgaacaacgtagacgacgtcgacggacacgacacgtataattattgtcgacacgacgactacctacgacccgcaacggtctaacgggtaaanaccgaacgtaaaccgtcggggttacccgacccggtaccgggggaccgtaccgggggtaaccccttcggtacccgtacccggtccctcccgtaccgaccgtcccgttaaccccgacccgtaaccggaccccgttacccgg

SEQ ID NO: 227749 - DNA, 676 bp, Homo sapiens
  misc_feature: GYAE6OF02JLVEZ.47.53.E09.1.454.CMB.1.raw
  modified_base (222)..(222): a, c, t, g, unknown or other
  misc_feature (222)..(222): n is a, c, g, or t
tcagagctcacgtacacgaccggtgctcgatttagagagagtgtgttgggtttggggctgggcctaaggaagcagcactggtggtgcctcatccatggcctggaccgttctcctcctcggcctcctctctcactgcacaggctctgtgacgtccgacgagctgattcaggcaccctcgatgtcagtcgcccaggacagacggccaggattactgtgcggganccagtgtcggagaagagtgtacactggtaccaacagatcgaccgaggccacggcccctggtgcgtacggtcggtctagtacgactagatacggtacgaccggtccctcgtcgggtacctccccggagtcgtacttctcgcggtcctacgaacgtcgtacgggaaccaccggcccaacccgtcggacccgttacacggtacggacgggtacccggacgggttaccggggacttgggacggtaccgttaagtttacgttttcgacgtagggttacggtagggtacgttacgttaaacgttttggactaagttagttggttacgttcggggacgggacggtaaccgaaggtcttaacggccggtaccttcggtaccgaccgtacccggaaggtcctacccggccccgttcgtacccgtaccgttcccgtaccggtttaccccaccccttcgtacccg

SEQ ID NO: 227750 - DNA, 791 bp, Homo sapiens
  misc_feature: GYAE6OF02JBJD9.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacagaccctcaccgctgaccgtgcagtctttctctggtacttttcactcgagttacgtactgggagtaggtcttgggtgggtccgtcggggttacccgtccgaccgaccccccggaagggaaacggccccggttagggtaacggttcggtcctttacggcctaaccttacttaagtttttaacggttacggggtattaggtagttaggttacggtaaacggttaaccgttaacggtaacggttacctaagtttacttacgtaaacggcggtacctacctaactaaccttaccgaaaccgaacggtaaccctaaaccgttaaaacccgaaaaaccgtaacgttcgggttacctacgtaacgtaacgtccaaccgtaacgtaccgaaacgtccgtacggaccggaaccgtacgggacccaacttaacttaacgtttagttacgtacgtaaccaaccgacccgtaacgtccgtaacgacccgtcgacgtacggtacgggtaaactcgaaccgttacgttcggtaacccgaccggtcgggaccgtaacgggtacccttcgtccgtaccgtccttacgtaccgccgtacctacccgaaccggtaccgtacccgtaccgg

SEQ ID NO: 227751 - DNA, 668 bp, Homo sapiens
  misc_feature: GYAE6OF02HM1NU.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggcccaggacagacggccaggacttacttgtggcgggagccaggttgttaggaagaaagaagtgtacactggtaccaacagatgccaggcccaaggccccctggtcgctggtcgtctatgatgatagtgacccggccctcgtgggactcccggagcgtacttctcgtggctaccaagttccgtagggaaccaccggaccctaccctcggacccgtacacggtcgaggggtccggtacgggtcggggatggacgggtaccgttaagtttagtttttcgcgtagggtcgggttagggacgtaacttaaggttttgtacgttattagtttaggtttgggttcggtacgggacggtaaccaaggtcgtcgtaccggttccctcgggttaccgaacggtaccccggaaggtcccgtcccggtccccccgttaggtcccttacccttccgtttacccgtccccttaccccgttcccttaacccggg

SEQ ID NO: 227752 - DNA, 742 bp, Homo sapiens
  misc_feature: GYAE6OF02J1DMQ.47.53.E09.1.454.CMB.1.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (405)..(405): a, c, t, g, unknown or other
  misc_feature (405)..(405): n is a, c, g, or t
tcagagctcacgtacacgaccggtgctcgatttagagagagtgtgttgggtttggggactgggcctaaggaagcagcactggtggtgcctcgagccatggcctggaccgttctcctcctcggcctcctctctcactgcacaggctctgtgacgtccgagagctgattcaggcaccctgatgtcagtcggacccaggacngacggccgaggacttacgttgnggcgganccaggtcgttaggagaaacgtagtgtaaccagtcggtaaccaanacggatcgccaggtccagggccctggtcncgtggtccntagngatcggatacggcgtaaccggctcgtacgggacctcccggagccgttagtcctagtcggtacctaccgaaggtttccggaagggaaacccncgtacccaccgtacgtaccgtacgaacgtcggaccgggtagtaacccgggtgggtaacgtcggacgggttaccctttaggtttaacgtttcggtaccggtaagggtttcggtaaggggtaccgttaaacgtttagtttacgggtaacctaagttttcgttaacggggtttccgtaccggggtaaccgggtaggaacccgttagggacccgtttacggtacccgttccgttacgggtaccgtaacggtcccggtaagttcccggtaacccggttccccgttacgggtacccttacgggttccttaccccgggtttcccctacccgtccgtttaaccgg

SEQ ID NO: 227753 - DNA, 682 bp, Homo sapiens
  misc_feature: GYAE6OF02GERXJ.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttatgggatgatgtgaagtactacagtccatatttcaagagctcactatcaccaaggacacttaccaaaacagtgtcctgacaatcgaaccaacgtgaacgcctagaccggacaccggccacatattatgtgcaacaccgacgctaacgtacccgaccagcgtagggaaactccggaactaacgttcggttacccgaccccggtggggacccgaacggggtaacccttgtacccgcccgttcctcctacacgtccctacccaaccgaaccgggccctaacggtcccggttcccttacccccgtggacccctaccccgtacccttacccgaaacgtaccgacctacccgtcgggttaccgggggcctaaccggaccgggtccccgggtccccgtaccgggggtccttccgggtcccgttacggggtaacccgtaaccgggtacccttttaaccccggg

SEQ ID NO: 227754 - DNA, 789 bp, Homo sapiens
  misc_feature: GYAE6OF02JF9DG.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctgggtcgaaacccacacagaccctcacgctgacctgcagcttctctggtattttcactcagtagtactggagaggcttggtgggcttcggggtcctcaccgccccgaaggaacggcctggagtcggcttgcacttctatttagtgggaatgtagtgtaggaacgtactacgtacgtcctaagttactttacgaaaggtcggtccttacgtaacttactaccgaaccaaacggacctaaccttaacccgaaaaaccgtaggttacggtacctacggaactaacgtacgaaccctaaggtacgaaaccggtccgtggacccggtaacacccgggaccaaacgttataagtttacttaggttacgaccctaaccgtaacccgaccggtaccttaaccgtaccccgacgtaacggtaccgttacggggtaaaacctccgggtaaacgttaaccggtttcggggttaacccccggtaaccccgggttcgggggtaaaccccggttaacccgggttaaccccgttttaccggaaccccggtttaccccgtacccgtttccccgttaacccggtaccggtaccccgttaaccccggaaccccggggttacccgggttacccccgtaacccgggg

SEQ ID NO: 227755 - DNA, 756 bp, Homo sapiens
  misc_feature: GYAE6OF02HH38A.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagcttctctggtattttcactcagtagtacgtggagaggctggtgggcgtgggtccgtcacggcccccgaagggaacggcccgtagggacgtcggtccgttgcctacttccgtaagttttacggttaggggtattaggtacgttggtacgtaaagttaccgtacgtaacgttacctaatttacgtttacgaaaggtacggtactacgtaacttacgacctaaaccggaacggtaacctaaccttaaaccgaaaaaccgtaggtacggtacctagaactaactacgaaccgtaaacgtagaacgccgtacggaccgaccgaccggactaacgtattacgttagttcgtactaccgaaccaccggtacctaccgttacgacccgtacgaacggtacgttaacgggaaccttaccgtaaaccgtaacggttccgggttaacccggtaccccgggtacggggtacccgtaaccggggtttaccctacggttccctaacccggttcctcccgtacctacccggaccccttaaccggaacccgtacgggtcccccttaccgg

SEQ ID NO: 227756 - DNA, 834 bp, Homo sapiens
  misc_feature: GYAE6OF02I9ORN.47.53.E09.1.454.CMB.1.raw
  modified_base (244)..(244): a, c, t, g, unknown or other
  misc_feature (244)..(244): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcgaggccacccgtcgattcgtcaggtcggccccaggacgacggaccggccgagggtacttacgttggtcggcgggtancccgtaggtcggttaggaagaaaggtaaggtgaccaactacggtacggtaaaccaaccgagtacgtacggaccgtacggacccgtaccggtccccgtggtcggtcggttacggttaccggttactaggttacggtagtaggtacgttacggtcccgggtaccgtcccgttacgggtacggtccccgtacccggagtccgtacgttcgtccggtcgtacctacgtaacggttaccggacgggaacccgtaccgtaccccgtaccgtaccggtacccgtacggacggtaccggacggggtaccgggtacgggtccgggggtaatccggggttaaaggttccgttaagttttacggtttccgggtaaggtaggggttcggttaaaggtaccgttaagttttacggttggtacgtttagttacgggttagggtttccgggtaacgggaccggggacgttaaccgaccgtggttaccccgggttaccctcggggttaaccgaccggtccggtaaccggtacgggtacccctccccggttaccgtaaccggttaccttccccggttccgttaccccccggtctcccccgggttacg

SEQ ID NO: 227757 - DNA, 744 bp, Homo sapiens
  misc_feature: GYAE6OF02IK16P.47.53.E09.1.454.CMB.1.raw
  modified_base (308)..(308): a, c, t, g, unknown or other
  misc_feature (308)..(308): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcacccctcgatgtcagtcggccccaggacagaccggccaggattacttgtgcgggagccagtgttggagaaagagtgtacacgtgtaccaacagatgccaggccacggcccctgtcgcgtggtcgtctagtgatnagtagtcgacccggcccttcgtgggtacctcccggagcgtacttccgtcgtggacctaccgtaaggttccgtacggggtaaccacccgggtcccacccgtaccggaccgttccgacggaccgtacggggtccgaaccggggtcggggagttagggaacggtaccgttattagtttttcggtacgtaacggggtttggtagggtaagttaacgtttaaggttttcggttagtaacgtttagttagggttttaccgggttacgggtccggggtaaacgggtacccgtaaacggtccgtaccggttaccccgggtttacccgtaccgggttacccgaacggtcccccggtaaaggtccccgttacccgccccccgggtttacggtacccgtacccgttcccggtttcccggttacccccccgttccccgttacccccgg

SEQ ID NO: 227758 - DNA, 519 bp, Homo sapiens
  misc_feature: GYAE6OF02I5IT1.47.53.E09.1.454.CMB.1.raw
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagagctggtgggctgggtcctcacgcccccaggaacggccctggacgtggcttgcactctatttagtgggatgatggtagaagtactacagtcctattattacaagtggctcactanccacagactactacaaaacagtcgtcanacatcacaacgtgagcctagcgacncgcanatattatgncacaccgcnctactacgaccagccgtaggactgaacacgtcggtccgaccgtgggccgacggtactcgtactccgtctcctcgacgccctacaccgacgccctacg

SEQ ID NO: 227759 - DNA, 752 bp, Homo sapiens
  misc_feature: GYAE6OF02HP41F.47.53.E09.1.454.CMB.1.raw
  modified_base (119)..(119): a, c, t, g, unknown or other
  misc_feature (119)..(119): n is a, c, g, or t
  modified_base (503)..(503): a, c, t, g, unknown or other
  misc_feature (503)..(503): n is a, c, g, or t
tcagagctcacgtacacgaccggtgctcgatttagagagagtgtgttgggtttgggggactcctgtcgccccaccatggacacactttgctccacgctcctgctgctgaccatcccttnagtgggtcttcgtcccagatcacttgaaggagtcgtggtccgacgcgtggtacgaacccacacacgaccctcgacgctcgacctgcgtacgtcttctcgttggttacttttccactcgtaaggttagtacgtgggacgaggtcgttggcgggtcgtacgggtccctcgacccggaccccgaggaaccggtccgtagggcggtcggtcgtacgaccgtacgtacgttacgtttaggtaggagttgtacgttagtaggtaacgttacgtaacgtcgttacctagttaattacggtaaggaggtacctactaactactaaccgaaccgaacgtaacctaaaccgttaaacctaaaaaccgtcgggttaccgtacgtagaaacgtaanaccgtaaacgacgtaaggacgaccgtcggacgtaccgacgtacacgtaattacgttagtacggtacgacgaccgtaaccgcgtactaaccgtacccgacgtacgtacgaacgggtaaccacggtacgtaacggtccgttaccccggaccgggtaccgggaccggtaaccgttacccggttcgtaacccgtcccgttaccgtcccgtaacgtcccgtacccgtaccgaaccgtcccggtacgttacccgg

SEQ ID NO: 227760 - DNA, 842 bp, Homo sapiens
  misc_feature: GYAE6OF02GAQ1W.47.53.E09.1.454.CMB.1.raw
  modified_base (116)..(116): a, c, t, g, unknown or other
  misc_feature (116)..(116): n is a, c, g, or t
tcagagctcacgtacacgaccggtgctcgatttagagagagtgtgttgggttgggggactcctgtgcccaccatggacgacactttgctccacgctcctgctgctgaccatccttnatgggtctgtcccagatcacttgaggagtctggtccgacgctggtcgaaacccacacagaccctcacgtctgacctgcacgtcttctctaggtattttccacgttcgagtagtacctggagaggtctggtgggtcgtacgggttccgtccaccggtcccccaagggaaccggcctggagtcggtcttgacgtacctcttaatttacgttggggattacggtacgttacggtaacggtaacgttaaccggttacctaacgttacccgtaagtttaacgttttaaccggaaacggtacggtaccttaccggtaaacccttacgtaacccggaaaccgtaaacggtaacccttaacctttaaaaccccaaaaaaaccggttacggttaccggggttaaccctaaggtaaacccgtaaacggtttaaccgtaaacccgttaacggtaaacggtaaaccgtccccggtttagggaacccgggttaaaccggacccgggtaaccctaactaaacggtttaactttaacggttcgttacgggaaccctaaccggtaacccgggtacctaccttaacggtaccccgaactacggacccggttaggaaaccgttccgaaacttaccggtacccgttacccgaacccggttcggggaacccgtacgggtaaccccttcgacccgtacccttcgtaccctacggaccgtccctacccgaccgtaccggcccgtaccg

SEQ ID NO: 227761 - DNA, 783 bp, Homo sapiens
  misc_feature: GYAE6OF02GRI1N.47.53.E09.1.454.CMB.1.raw
  modified_base (152)..(152): a, c, t, g, unknown or other
  misc_feature (152)..(152): n is a, c, g, or t
  modified_base (180)..(180): a, c, t, g, unknown or other
  misc_feature (180)..(180): n is a, c, g, or t
  modified_base (336)..(336): a, c, t, g, unknown or other
  misc_feature (336)..(336): n is a, c, g, or t
  modified_base (502)..(502): a, c, t, g, unknown or other
  misc_feature (502)..(502): n is a, c, g, or t
tcagagctcacgtacacgaccggtgctcgatttagagagagtgtgttgggtttggggggactcctgtgcccaccactggacacactttgctccgacgctcctgcctggctgaccatcccttacgatgggtctgtccagatcaccttgacggngtctggtccgacgctggtagaaacccanacagaccctcacgctgacctgccagcttctctggtacttttcacttcgagttagtactggaagaggtctggtcgggcgtcggggtccgtcaccgcccccgaagggtaaacggccccgtgggagtcggtcttgccactctattttacgtgggattgntgtagtaacgtatacacgtctaattacttacgaaggtacgctactactctaaccaaccgaaacgtaacctaaccttaaaccaaaaacgtacggtaccggttactaacgtaaacctaagacggtaaacccgtaacggttaacggacgccgtacggaccgggaaaccnccgggaacccaacgtaatttacttaacggttcggtacgaccaaacccggtacccgaccgttacctaccggtacccgacccgtaaggtaccggttaaacggggtaacgtaacccgaaacggttacccgtttacccggggtacccgggtaccccggggttacggggaaccccggtacggggttaaccccgttaccggttaccccgtacccggtttaccctcccggtacctcccggggtaccccctacccgggaaacccgtaccgggtacccccttaccccggg

SEQ ID NO: 227762 - DNA, 803 bp, Homo sapiens
  misc_feature: GYAE6OF02H3YY1.47.53.E09.1.454.CMB.1.raw
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
tcagagctcacgtacacgaccggtgctcgatttagagagagtgtgttgggtttgggggagtctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaaggtattacttgtcggcggagccagtggttggagaaagagtgtacactaggtaccaanagtntacgccgacggccacggtcccctggtcgtcgtcggttcgtctagtggatgaatacggtcgacccggtccctggttacgggacctccccggagtaccggttactttccgtacggttcggtacctaccggtaaacggttccggtaacggggaaccaacccggtcccctaacccggttacgaacccggttcgacggaccggtacggggtaccggtaccggggtacggggtaatcggggtaaccgggttacctttaaggttttacgttttttacggtcggttaacgggggtttacgggtagggggttaaacgtttaaccggttttaagggttttcgggttaacttagtttttacgggttacgggttttcggtttaccggggacggggttaaccgggaacccgtaaaggtccgttacggtacccgtttacccgggtcggtacccgaacccggtccccggtaacggtcccggtacccgtcccccggttaggtccctacccgtttcccggtacccgtttcccccgtacccttcccg

SEQ ID NO: 227763 - DNA, 775 bp, Homo sapiens
  misc_feature: GYAE6OF02IA9R9.47.53.E09.1.454.CMB.1.raw
tcagagctcacgtacacgaccggtgctcgatttagagagagtgtgttgggtttggggctgggcctaaggaagcagcactgggtggtgcctcagccatggcctggaccgttctcctcctcggcctcctctctcactgcacaggctctgtgacgtccgacgagctgattcaggccaccctcgatgtcagtcggccccaggaccgaggaccggccaggtacttacgttggtcggcggggacaccgtaggttcggttaggaaggaaaagtaagtagtactacgtggttaaccaacagatcggaccaggacccacggcccctggtcgtcgttcggtcgtcttagtgtactgtaacgtggtaccggacccgtcctcggtcggggtacctccccggtagacgttcgttctccggtcgtacctccggaaagttcggtacgggaaaccgacccgtaccccacccgtacggtaccgtccacggcggtacggggtccggtacgggtacgggggtacgtcggtacgggttcgttaagtttacgttttggacggttaggggttgtacggggtataacggttttaagttttcgggtactagtttaggtcggttttaggacgggggttacgggacgggtaaaccacggtacggttcgttacccgggtccgtccgggtacgacccgggtacccgaacgggtcccgttacccccggttcccccggtaccgggtttacccgaccgtttccccggttacccttttccccctaccccggtttcccttaacccggg

SEQ ID NO: 227764 - DNA, 567 bp, Homo sapiens
  misc_feature: GYAE6OF02GBZ0V.47.53.E09.1.454.CMB.1.raw
  modified_base (337)..(337): a, c, t, g, unknown or other
  misc_feature (337)..(337): n is a, c, g, or t
  modified_base (378)..(378): a, c, t, g, unknown or other
  misc_feature (378)..(378): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (531)..(531): a, c, t, g, unknown or other
  misc_feature (531)..(531): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctggtgggcgtgggtccgtcacgcccccgaggaaacggccctggagtggcttgcactctatttattgggatgatgtgaagtactacagtccatatttcgaagngctcactatcacagacactacaaaacagtcgtctagacaancgacaacgtgaagcctagcggacacgccanatattattgntcacgaccacgactactccgaccagcgtagggaactcgaacacgttcggtacccgtacccgtggggacccgtaccgggtaaccctttcgaccgtacccgttcctcccgttacncggtacccctccggaacccgtacgggcccctaccgg

SEQ ID NO: 227765 - DNA, 549 bp, Homo sapiens
  misc_feature: GYAE6OF02GZ4NM.47.53.E09.1.454.CMB.1.raw
  modified_base (306)..(306): a, c, t, g, unknown or other
  misc_feature (306)..(306): n is a, c, g, or t
  modified_base (438)..(438): a, c, t, g, unknown or other
  misc_feature (438)..(438): n is a, c, g, or t
  modified_base (483)..(483): a, c, t, g, unknown or other
  misc_feature (483)..(483): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctgtgggctgggtccgtcacgcccccaggaaacggccctggagtggcttgcactctatttattgggatgatgtagaagtactacagtccattattcaagagctcactatcacaagacactaccaaaacagtgtctnacaatgaaccaacgtgaacgcctgacgacacggccacatattatgtgacacaccgacgctactaccgcagcgtagggaactcgactaacgtggttacccgacccgtggggacccacgggtacccttgtaccnccgtcctcctcacgcctccaccgacggcccagtccgtcctcccgngcccaccctccacagcnccncctcgtcgggcacgcgccgccgtggctcgccgtggacacgtactcg

SEQ ID NO: 227766 - DNA, 728 bp, Homo sapiens
  misc_feature: GYAE6OF02INDI0.47.53.E09.1.454.CMB.1.raw
tcagagctcacgtacacgaccggtgctcgatttagagagagtgtgttggggtttggggctgggcctaaggaagcagcactggtggtgcctcagccatggcctggaccgttctcctcctcggccctcctctctcactgcacaggctctgtgaccgtccgacgagctgattcaggccaccctgatgtcagtcggccccaggacagacggccaaggtattacttgtggacgggacgcctaggttcgttaggaagaaaacgtaagttagtaaccacgttacggtaaccaaacgagaagtcgaccacggaccaccggtcccctggtacgccttggtccgtcttaagtgtatgtagtacgtccgaccggtccctcgtgggacctcccggagtcgtacttctcgcgtccgtaacgtagtcgtagggaaccacgggtccccaaccgttcgacccgtacacggccgtacggggtccggaacggtcggggaatcggacggttacgttagttacgttttgacgtaggttcggtaggtacttaacgttaagttttcgacttaagttagttacggtttgggtccggtacgggtaacgggtaacctaacggtaccgtacgggttaaccccgttccggtacgtaaccggtaccggaacccgtaccgggtccttaccccgggtccccgacgttaccgtccctttccggtaccccgtttacccccgtacccgttccgtaacccgg

SEQ ID NO: 227767 - DNA, 793 bp, Homo sapiens
  misc_feature: GYAE6OF02F3HUF.47.53.E09.1.454.CMB.1.raw
  modified_base (491)..(491): a, c, t, g, unknown or other
  misc_feature (491)..(491): n is a, c, g, or t
tcagagctcacgtacacgaccggtgctcgatttagagagagtgtgttgggtttgggggtacgtcctgtgccccaccatggacacactttgctccacgctcctgctgctgacactccttcatgggtcttgtcccagatcaccttgaaggagtcgtggtcccgacgccgtaggtagaaaccccacacacgaccctcacgctgacctgcagtcttctctggtattttccactcgtagtacgtactgggagacggctggtgggtccgttgggtacccgtcgaccgcccccgaacgggaaacggcccgtgggtacggcggtcgttacgcgtacctcgtagttttagtagggtatggtagtagttaggaaagttacctaagtacgtacgtactttattacgaaggtacggtcctaacttacgtaactaccgtaaaccgaaacggtaaccctaccctttaaaacccgaaaaacggtaaacggttacgtaccggtttanaaaccgttaagtaacgtaacccgtaacggtacggtaagaccggttacggacggtacgaaccgcccaagtacttaacggttaattgggacctccgtaaccgaacccgtacgtaaccgttaacccgtaaccggttaccgacggaccggttaaacgggaaacttccggaaaacccgacggttaccggtttacccggacccgggttcgggaacccgtaaccggggtaccccgttagacccgttaccggtcccttacccgtcggtacccgttcggaccccctaaccggaccgggtacccctaccggg

SEQ ID NO: 227768 - DNA, 696 bp, Homo sapiens
  misc_feature: GYAE6OF02HCTVN.47.53.E09.1.454.CMB.1.raw
  modified_base (261)..(261): a, c, t, g, unknown or other
  misc_feature (261)..(261): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggattacttgtgcgggagccagtgttggaagaaagaagtgacactggtaccaanagatcgccaggccacggcccctgtcgcgtggtcgtctagtgatgagtaacggtcgacccggtcccgtcgtcgggactcccccggagccgtattctcgtacgcctaccgtaagtcgtagggaaccaccgggccctaacccgtggacccgtcgaggtccgacggggtaccgtacgggtcggggaagtcggaacgggtcgttaagtttagttttggtacgtagggttaggtagggaagttaaccgtttaagttttcggtacttagttagtttaggtttcggtttacggggtcgggaacgggtaaccgtaggtaccgttacggacccgttccgttaccggtaccgtaccggtaccccgaaggtcccggtacccgtcccccgttccggtaccgttacccgttccgttcccgttcccccggtaccccttcccgttacccgg

SEQ ID NO: 227769 - DNA, 761 bp, Homo sapiens
  misc_feature: GYAE6OF02F4OBN.47.53.E09.1.454.CMB.1.raw
  modified_base (235)..(235): a, c, t, g, unknown or other
  misc_feature (235)..(235): n is a, c, g, or t
  modified_base (500)..(500): a, c, t, g, unknown or other
  misc_feature (500)..(500): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgaccgtccgacgagctgattcgaggccaccctcgatgtcgagtcggcccaggacaggacggccaggtacttacgttgtggacgggacnccgaggttgtaggaacgaagtaagtgtaacgacgtaggtaaccaacgtagtactcggaccgtacggacccgtaccgggtccccttaggttacgacggttcggtccgttacttagtcggtaagtgtaacgtacgggtaccggaccccggtcccgttacggtaccgggtacccgtaccccggtagtaccgttaactttccgtaccggtacgggtacccttaaacggttaaccggttccgggtaacggaaacccgtccggtaaccccncccggttaaccggaccgttaccgacggtacggtacgggtaccggtacgggttagggaacgtcgggtacggtacggttttaagtttcgttttacggacggttaggtacggtacgggtattaccgtttaagtttccggattacgttagttcggttacgggtcgggacggtacggaccaaggtccggtacgaccgttcctcggtaccacgtccgacgtccgttacccgcccgttcgtactccgtccgtacctaccctctacgtc

SEQ ID NO: 227770 - DNA, 655 bp, Homo sapiens
  misc_feature: GYAE6OF02FVJOY.47.53.E09.1.454.CMB.1.raw
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
tcagagctcacgtacacgaccggtgctcgatttagagagagtgtgttgggtttgggggtcttgtcccagatcaccttgaaggagtctggtccgacgctggtgaaacccacacagaccctcacgctgacctgcagcttctctggattttcactcagtagtactggagaggctggtgggctgggtccgtcacgcccccaggaaggccctggagtggcttgcactcatttatgggatgatgtgaagtactacagtccatattcagagctcactatcaccaaggacacttaccaaaaccagtcgtcctagacaancgaccaacgtgaancctgcggacacggccacatattagttgcgacacaccgacgtctactacccgccagcgtagggaaatccgaactaacgtcggttaccgacccgtcggggaccctaacggggtaacccttggtaccaccgttcctaccctcaacgccctcccgaccgaccgggccctacgtcccggttacccttcccccggtcggccctaccccttcccgtaccctaacgaccgacccttacccgtccgggtcggggaccaaccggtacggcccggtaccccgttgggggacccttcggtccccggttacgggtacccgaaacgggttaccctttaacccgg

SEQ ID NO: 227771 - DNA, 808 bp, Homo sapiens
  misc_feature: GYAE6OF02GHP4Y.47.53.E09.1.454.CMB.1.raw
  modified_base (186)..(186): a, c, t, g, unknown or other
  misc_feature (186)..(186): n is a, c, g, or t
  modified_base (239)..(239): a, c, t, g, unknown or other
  misc_feature (239)..(239): n is a, c, g, or t
  modified_base (551)..(551): a, c, t, g, unknown or other
  misc_feature (551)..(551): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtcgaaacccacacagaccctnacgctgacctgcagctttctcgtaggtattttcactaccaatagtactggagnggctgtgggctgggtcctcacgccccaaggaacgccgtggacgtggcttgctactctagtttagtggtatgagtggtagtaacggtactaacgagttacctaattaacttttgaaaggtaggtcttctaaacttaactaccaaccgtaaacggtactaaccccgtttaaaccaaaaaaccgttagtacggttacccgttaagaaccgttaaagtacggtaaccctaaaccggttaaacggaaacggtaccggttacggaaccggaacccgaaccggggaccctaaacggtaactttaacgtttacgtttagnggtaacccaaaccgtaacccgtaacgtaccgttaccttaaacccggaacccgtaacggttaccgtaaaccggggttaaaccttacgggaaaccctaaaccggttaacccgggttaacccggaccccggttacgggggacccgtaaccgggttaaaccccgttccgggttaacccgtacccccggttcttaccccgaaccgtcccggttaaccccgtccccggtaaaccccggacccggggttaccctaacccccggg

SEQ ID NO: 227772 - DNA, 809 bp, Homo sapiens
  misc_feature: GYAE6OF02IB7DV.47.53.E09.1.454.CMB.1.raw
  modified_base (232)..(232): a, c, t, g, unknown or other
  misc_feature (232)..(232): n is a, c, g, or t
tcagagctcacgtacacgaccggtgctcgatttagagagagtgtgttgggtttggggctgggcctaaggaagcagcactggtggtgcctcagccatggcctggaccgttctctcctcggcctcctctctcactgcacaggctctggtgacgtccgagagctgattcgaggccacccttcgatgtcagtcggcccaggacaggaccggcaggtattacgttggtcggacgggnccagttggtacggaagtaaagagtcgtaacacgttagggtaaccaacgaagtaactcgaccgaggtacccgacggtcccccgtggttcggcgttacggtttccgtacttaagtcgtagttacgtagtacggtacggacccggtcccttacgggtcggtaaccgtccccggtaagtaccgttacttaccgttcggtcgtacctaaccgtaagttcggtaacgggaacccgtccgacccgtaaaccgtccggtaaccgtcgaaccggacggtacggggtaccggtacgggtacggggacgtacgggtacgttacggttaagtttaacgttttcggtacggtacgggtttacgggttagggaacgttaacgtttttaagtttacggtacgttaagttttcggttaagggtttccggttccgggggaacgggtaaccgggtaacgtaacggtaccggttacgtaacccgttccggttaccggtaacgacccggtaacccggaacggtccgtccccggtaacccctcggttaccctaccgttccgttaccccttaccccgttaccccttaccggttaacccg

SEQ ID NO: 227773 - DNA, 668 bp, Homo sapiens
  misc_feature: GYAE6OF02FVLVK.47.53.E09.1.454.CMB.1.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
tcagagctcacgtacacgaccggtgctcgatttagagagagtgtgttgggtttgggggagtctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacgccaggattactgtgcgggagccagtgttgggagaaagaagtgtacactggtaccaacaagatgccaggcccgaggccccctgtcgctgggtcgtctacngatgatagtgaccggtcctgtggactccccgagtcgattctcgacggtctaccagtcgtgggaaacncggaccaccgtcgaccgtctagccgagggtcacgggtcgggagtggacggacgtagttaagtttttgacgtagggtggtagggagtaactttaaggttttcggtacgtacgttagttcggtttggtttaccggggcggggtaaacggggtaacccgtaaagtccggtacgggtaacccttccgtccgggtacgtaacggaccccgtaacggggtcccttaccgggtcccccccgtttaacgggtcccttaaccgtccccgtttaccggttttaccccccaccccgtttacccccg

SEQ ID NO: 227774 - DNA, 635 bp, Homo sapiens
  misc_feature: GYAE6OF02FQ4WL.47.53.E09.1.454.CMB.1.raw
  modified_base (226)..(226): a, c, t, g, unknown or other
  misc_feature (226)..(226): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaggattacttgtgcggganccagtgttggagaaagagtgtacactggtaccaacagatgccaggccaggcccctgtcgcgtggtcgtctatgatgatagtgacccgcctcgtgggactcccccgagccgtatttcctcgtcggtcctccgaagtcgtaggggaaccaccggcccacccgttcgacccgtcacggcgagggtcggacggtcggggactcggacggtccgttagttagttttcgtcgtaggttggtagggtacgtacgttaagttttcggtactagttagttggtttacggtcggtacgggtacgggtaccgtaaggtccgtacggtaccgtccgtacggtccgacggtcccggaacggtcccgtccgtccccgtcgtccgtaccgttccgtacccgttccctaccccgtccttacccgg

SEQ ID NO: 227775 - DNA, 774 bp, Homo sapiens
  misc_feature: GYAE6OF02HUS5P.47.53.E09.1.454.CMB.1.raw
  modified_base (227)..(227): a, c, t, g, unknown or other
  misc_feature (227)..(227): n is a, c, g, or t
  modified_base (313)..(313): a, c, t, g, unknown or other
  misc_feature (313)..(313): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgacttcaggccacctcgatgtcaggtcgccccaggacagacggccaggtattacgtgtgcgggancgtaggtgttggaagaaaggagtagtacactggtaaccaagacgatcgcgacgccaaggcccctgtagcgtggtctcgtatagtangtatacgcgaccgtccctagtcggaccgtaccccggagtcgtaattccgtcgtcggtcttaaccgtaggttacggtacggggaaaccctccgggacctacccgtacggacccgtgacggacgacgggtacggacgggttacggggagttacgggaacgggtccgtttaacgtttacggttttacggtaccggttaagggtacgggttaacggggtaaacgttaacggttttaaacgtttcgggtaacttaaggttaacgtttgggtttaacgggttacccgggggtaagggtaaccggggtaacctaaacggtccggttaaccggttaaccccgggttaccggtaccgggtaccgtaacccggtacccggaacggtccccgtaaccggttccccccggtcgttacccggttacccgttccggtttacccccggtcccgttaccccgttcccttaacccggg

SEQ ID NO: 227776 - DNA, 694 bp, Homo sapiens
  misc_feature: GYAE6OF02HJN0N.47.53.E09.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcgaggccaccctcgatgtcagtcggccccaggacacgacggccagattactgtgcggacnccagtgtggaagaagagtntacacgtcgtaccaacagatcgcacggccgacggccccgtgtcgcgtcggtcgtctagtgatgtatagtcgacccggtcctggtcggacctcccgagcgtattcctcgtcgcctacgagtcgtacggacgaccgacctaccgtcgaccgtcgacgtacggtacggggtaccggacgggtacggggtatacgggacggttacgttaagtttagttttcggacggttggggttaggtacggggtaacgttaacgtttacggttttggtaccttaagttacggttttcggtttaccggggttcggggtaccgggtaacggggtaacccgtaacggtacggttcccgtaacccgttccgggtacggtccgacccggtaacgaccgggtcctcccggtccccgttccggtcctacccgttcgtaccccggttccccgacccttcccggttaccg

SEQ ID NO: 227777 - DNA, 640 bp, Homo sapiens
  misc_feature: GYAE6OF02I35M3.47.53.E09.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (252)..(252): a, c, t, g, unknown or other
  misc_feature (252)..(252): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtgcccaggacagacgcaggattactgngcgganccagtgtggagaaagagtgtacactggtaccaanagatgccaggccaggcccctgtcgctggtcgtctatcgatcgataggtcgaccgcctcgtgggactccccgagcgtacttctctggtcctaccgaacgtcgtacgggaaccaccggcctacccgtcgaccgttcgacgcgtagggtaccgacggtcgggatggacggtccgttattagttttcgacgtaggttggtagggacgtaacgtttaagttttcgggtactaagttagttaggtttacggttcgggacgggtacgggaacctaaggccgttacggacccgttccgtacggtccgacggtcccgtaaacggtcctaccggtcccccgttcggtaccttaccgttaccgttaccgttccccccgtacccgttccccttaacccgg

SEQ ID NO: 227778 - DNA, 898 bp, Homo sapiens
  misc_feature: GYAE6OF02FY81M.47.53.E09.1.454.CMB.1.raw
  modified_base (263)..(263): a, c, t, g, unknown or other
  misc_feature (263)..(263): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaccctcacgctgacctgcagcttctctggtattttcactcagtacgtactggagaggtctggtgggcgtcggggtccgtcnccggccccgaaggaacggcccgtaggagtggtcttcgactctctagtttagttcgggatgtacgttgtaggtaacgttaaccgtactacggttacctaagtttactttaacgaacggacggtcttaccgtacttaactaccaaaccggaacggtaaccctaaccttaaaacccgtaaaaaacccgtaggttaccggttaccctaacggtaaaccgtaaacgtaccggtaaacccgtaaacggtacgaaaccggtccgtacgggaaccgggtaaccgaacccgggtaacctaaaccgttaacttaacggtttaaacgtttcggtaaccgtacccgtaaccgaacccggtaaccgtaacccgtttaaccgaaccccgtaccggtacgtaaccggggtaaccggggtaaaaccttaccgggtaaaacccgtaccgggttttaccggggttaacccccgggtacccccgggttacggggggtacccccgtaaacgggggtttaaaccccccggtttaccggttaacccccgggttaacccggttaaccccgtttacccggttaccccgggtaacccggttaaccccctacccccgggtaaaccccggttacccccgggggtaaccccgttacccccggg

SEQ ID NO: 227779 - DNA, 580 bp, Homo sapiens
  misc_feature: GYAE6OF02I64F3.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacatggtaccaacagatgccaggccaggcccctgtgctggtcgtctatgatgataggtgacccggtccctgtcgggactccccgagcgtattcctctggctcgaagtctagggaacacggcccacctgaccgtcagcgagggtcgacggtcgggagtggaggtccgtaagttagtttttcgtacgtagggttggtgggagtacttaagttttggactattagttgttggttcggcgggtacggaccgtaagcgtcgacccgtcgtcggtcacggcccgaaggcctccgtccccgtacggtcctacttccgttcctccccgtaccctccttaccg

SEQ ID NO: 227780 - DNA, 656 bp, Homo sapiens
  misc_feature: GYAE6OF02GP9W0.47.53.E09.1.454.CMB.1.raw
  modified_base (387)..(387): a, c, t, g, unknown or other
  misc_feature (387)..(387): n is a, c, g, or t
tcagagctcacgtacacgaccggtgctcgatttagagagagtgtgttgggtttgggggagtctgggcctaaggaagcagcactggtggtgcctcagccatggcctggaccgttctcctcctcggcctcctctctcactgcacaggctctgtgacgtccgacgagctgattcaggccaccctcgattgtcagtcggccccaggacaggacggccaggattactgtggcgggagccagtgtaggagaagagtgacactggtaccaacagatgccgaggcccgacggccccgtgtcgtctggtcgtcctatgatgatagtcggacccggccctacgtcgggacgtccccggagccgtattctcgtcggtctacctagtcgtacgggaacnccggacccacccgtacgtaccgtacacggtacgacgggtccggtacgggtacgggagtggacggtacgttagttacttttggcgtagggtggttagggacgttaagttaggttttagtcgtagttagttggtttacggttcgggtacgggtacgggaccgtacggtacgtacgaccgttccgtacggtcgaaccggacccgaacggccgttcccggccccgttcggtaccgtacccttccgttaccggttcccccgtcccgttaccccg

SEQ ID NO: 227781 - DNA, 774 bp, Homo sapiens
  misc_feature: GYAE6OF02F0UGY.47.53.E09.1.454.CMB.1.raw
  modified_base (710)..(710): a, c, t, g, unknown or other
  misc_feature (710)..(710): n is a, c, g, or t
tcagagctcacgtacacgaccggtgctcgatttagagagagtgtggttggggtttggggggtcttgtcccagatccaccttgaaggagtctggtccgacgctggtagaaacccacacacgaccctcacgctgacctgcacgtcttctcgtggtacttttcacctcgtagttagtacgtggagaggtcgtggtgggcgtcgggtccgtcacgcccgaggaacggccgtggagtggtctcgctactctagtttagtggtatgtagtgtacgtaacgtactacgacgtaccgtattattacgaagacgtcctactactactaccaaccgtaacgacctaaccttaaccgaaaaacgtacggtacgtacctagtaacgtaagtaaccgaaccgtaacggtacgaacgtccgtacggaccggaccgtaccggtacctacgtaattagttacgtacgtacaccaacgtacccgaacgtactaacgaccgcgtaacggtacggtaacgggaaactcgtaaccgtaacggttaccggtaacccgtcccggtacgggtaccgtaaccggtacccttcgtacccaccgttcctacccgtacgaccgtcccgtaaccgaacccggtaccggtacccgtacggttcccggttccccttacccgtccgtaccctcccgtaccctaacgaacgccgttaccgtacccgtcgggtaccgggtccncggacccggtccgtaccggtacggtccgtcggtaccgtacggtaaccgtacgttaccgttaccg

SEQ ID NO: 227782 - DNA, 628 bp, Homo sapiens
  misc_feature: GYAE6OF02GGAE9.47.53.E09.1.454.CMB.1.raw
  modified_base (226)..(226): a, c, t, g, unknown or other
  misc_feature (226)..(226): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctagattcaggcaccctgactgtcagtcggcccaggacagacggccaggtattacttgtgcgggancagtgtggagaaagagtgtacacgtggtaaccaacagactcgaccaggccacggccctaggtgctggtcgtctatcgatgagtagacgaccgcctcgtacgggacctaccggagctagttcctgtcggctactaaggtcgcggaacctacggccctaccgcgtaccgtcgagcgacgggtacgacgggtcgggataggacggacgttagttacgttttggacgtcggttaggtgggtaacgtagttaagtttgtacgtagttgttaggttaggtgggtacgggtacggaaccgtagtacgtgtacccgtcgtacggactaccggaccaacggtccgtcccgtaccccggttacggtcctaccgttaccgttcccgttaccccgtacccgttaccttacccgg

SEQ ID NO: 227783 - DNA, 756 bp, Homo sapiens
  misc_feature: GYAE6OF02G1FR1.47.53.E09.1.454.CMB.1.raw
  modified_base (224)..(224): a, c, t, g, unknown or other
  misc_feature (224)..(224): n is a, c, g, or t
tcagagctcacgtacacgaccggtgctcgatttagagagagtgtgttgggtttgggagtctgggcctaaggaagcagcactggtggtgcctcagccatggcctggaccgttctcctcctcggcctcctctctcactgcacaggctctgtgacgtccgacgagctgattcaggcaccctgatgtcagtggccccaggacagacggccaggattactgtgcggganccagtgttaggagaaaagagtgtacactggtaaccaacgagaatcgaccaggccaaggcccctgcgcgtaggtcgtactagtcgagtcgtaagtggtcggacccggtccctcgtacggggaccttccccggaagccgtactttccgtacgttcgggcctaccgtaaagttccggtacgggaactacccgggaccctacccgtacgaccgtacgacgacgtacgggtacggtacgggtcgggtaagtacgggacgtaccggtttagtttagtttttagcggttaagggttcggttaggggtaacgttaacgtttaaaggtttttcggtacttaacgttagtttcggtttacgggttcgggtaacgggtaaccggggttaaccctaaacggttccgttaaccggaacccgggtttcccgttacgggtaaccgtaaccgggtaaccccgtaacgggtcccgttaccccggaccccggttccggttaccctacccggtttccgttacccgtttacccccggtaccctttaccccgg

SEQ ID NO: 227784 - DNA, 638 bp, Homo sapiens
  misc_feature: GYAE6OF02FTF5G.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacacgtggtaccaacagatgccaggccaggcccctgtcgctggtccgtctatgatgatagtgaccggccctgtcgggactcccgagcgattcgtctggctccgaagtcgtagggaacaccggcccacccgtcgtaccgtcgacgcgacgggtcgacgtcgggatggacggcgttagttacgttttgtacgtagggtggtgggagtacttaagttttgggtactagttattggtttacggttcgggtacgggtaacgggtaccgaaacggtcgttacggtacccgttcgtccggtaccgtaacggaccccggtaaacggcccgttcccggtacccccgttccggtccgtaacccgttcccgttaccggttcccccgtaccccgttccccg

SEQ ID NO: 227785 - DNA, 856 bp, Homo sapiens
  misc_feature: GYAE6OF02HOB1L.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctcgtggtattttcactcagtagtactggagaggctggtgggcgtgggtccgtcacgccccccgaagggaaacggcccgtgggtacgtgggtacgttcgctactccgtatttagttagggtatgtaagtggtagtaacgttactacgtacgtacctattaacttacgaaggtacggtaccttactaacttaacctaccgaaaccgtaaacgtaacctaaaccgttaaaacccgtaaaaaaccgtaacggttaccggtaccgtaacgtaaacgtaacgtaccggaaccgtaacggtaacggaaccgtccgtacggaccggaaccgaccggtaacctaactaattaagtttacggttacgtacgaccaccgtaaccgtaccgtaccgtaccgtacccgacgacggtacgtaacggtaaccgtaccgtaaccgtaccggttccgggtacccggtacccgggtaccgggtacccggtaaccgggttacccgttaccggtacccgtacccgtccgttcccgtccgtacccgtacccgtacccgtaacccggtacccggtacccgtaccggttacccggttccccgttccccgtaccgtacccctacccgtacccgtaaccgaaccgtaccgaccgtacccgtccgggtaccgggtccgaccggtaccggtcccggtccgtcggtaccgtccggtacccgtacggtacgtacggtaccctaccg

SEQ ID NO: 227786 - DNA, 624 bp, Homo sapiens
  misc_feature: GYAE6OF02F2QOD.47.53.E09.1.454.CMB.1.raw
  modified_base (344)..(344): a, c, t, g, unknown or other
  misc_feature (344)..(344): n is a, c, g, or t
  modified_base (472)..(472): a, c, t, g, unknown or other
  misc_feature (472)..(472): n is a, c, g, or t
tcagagctcacgtacacgaccggtgctcgatttagagagagtgtgttgggtttgggctgggcctaaggaagcagcactggtggtgcctcagccatggcctggaccgttctcctcctcggcctcctctctcactgcacaggctctgtgacgtccgagagctgattcaggccaccctcgatgtcaggtgccccaggacagacgccaggacttccctggtgagaaacaacattggaagtaagagtgtacagttcggtaccaacagacggccaggaccaggccccctgtgctggtcgtctaatgatgatagtcgaccgtccgtcgtggactcccgagcgtattctcgngtacctcgacgtcgtacgggactaccggccaccgtgtacccgtcgagcgacggggtcgacgggtcgggatcggaggtccgtagtttaagttttgacgtggtggtaggtagtacttaagtttgaacgtnttaattcggttacgtcggtacgggacgggaacctacggtccttacggcccgttaccgttccggttaccacggtacccgtacggccttccgccccgtaccggtccgtaacgttcccgtccgttcccccgcccttcccttacgtacccggtacg

SEQ ID NO: 227787 - DNA, 650 bp, Homo sapiens
  misc_feature: GYAE6OF02GY3DX.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggccccaggacagacggccaggacttacttgtgcgggagccagtgttggagaaagagtgtacactggtaccaacagatgccaggccacggcccctgtgctggtagtctactgatgagtagtacgacccggcctcgtgggactccccggagcgtattctcgtcggtctaccaagtcgtacgggaaccaccgggaccacccgtcggaacccgtcgacggaccgagggtaccggacggtcggggatcggacggtccgttaattagttttcgacgtagggtgtagggacgttagttaagtttggtactagttagttgtttggttcgggacgggtacgggaaccgtagtccgtacgaccgttccgtaccggtacgaaccggccgtaacggtcccgtaccggtccccccgttacgggttaccctaccgttcccgttacccgtttacccccgtaccccttcccgttaccg

SEQ ID NO: 227788 - DNA, 659 bp, Homo sapiens
  misc_feature: GYAE6OF02HA3WY.47.53.E09.1.454.CMB.1.raw
  modified_base (438)..(438): a, c, t, g, unknown or other
  misc_feature (438)..(438): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtattttcactcagtagtactggagaggctgtgggctggggtccgtcacgccccaggaaaggcccgtggagtggcttgcactcatttattgggatgactgtagaagtactacagtccatactttcaagaggctcactatacaaccaaggactaacttaaccaaaaacgtaagtagtacctagaactaatacgaacccaacgtagaacgcctaggaccggacacggaccaanatattacttgagtacctaccgaaccgtcgacctaacgtaccgaccgaagtacgtagggtaaactaccggaaacctaaaccggttacgggttaccgtaccccgggtcggggtacccggtaaccggggttaaaccccgttggttaaccctaccccggtaccgtacccgtaccgtaccggtccccgttaacccgtaacccggtaacgggtaccccttaaccggg

SEQ ID NO: 227789 - DNA, 576 bp, Homo sapiens
  misc_feature: GYAE6OF02J1RQI.47.53.E09.1.454.CMB.1.raw
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggtatttcactcagtagtactggagaggctggtgggcgtgggtccgtcaccgaccccgagggaaacggcccgtagggagtggtcgttcgctactctatttaggttagggatgagtgagtaacgtactacagtcctattattacgagtgcgtacatactcgaacaagtaccactaaccaaaactagtcgtctanacaatcgaacaagtanaacgcgtcgacgacgacgactacgtatatacttgtagcacgaaccgcactactaccgacacgacgtaggaacgtacgaactacgtcgtacgacccgtcggggcctacggaccctacgtccgaccttaccgtcctcacgcctaccaccgaccgtcctaccgg

SEQ ID NO: 227790 - DNA, 687 bp, Homo sapiens
  misc_feature: GYAE6OF02F56FK.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacagacggccaggattacgttgtgcgggagcctaggtgttaggaagaaagagtagtacacgtggtaaccaacagatcgccgaggccgacggcccctgtcgcgtggtcgtctagtgagtagataggtcgaccgtccttcggtcgggacctccccgagcgtacttcgttcgtcgtcctacgtaacggttcgtacgggaaccaccggtacccacccctacggaccgtaccgaacggcgacgggttcggacgggtgggacgtacgggtacggttccgttaatttgttttacggtacggtagggttcggtagggtacgttacgtttaatttggttactagttagttggttcggttacgggacgggtaggtaccgtaacggtcgtacggtacccgttccgtcggtacgacccggtaccggaccgtacccggtcccggtcccccgttacgtcccttccgttccgttccccgttaccccttcccgtaccccttaccgg

SEQ ID NO: 227791 - DNA, 761 bp, Homo sapiens
  misc_feature: GYAE6OF02J1OWA.47.53.E09.1.454.CMB.1.raw
tcagagctcacgtacacgaccggtgctcgatttagagagagtgtgttgggtttgggggacgtcctgtgccccaccatggacacactttgctccacgctcctgctgctgaccatccttcatgggtcttgtcccagatcaccttagaaggagtctggtccgacgctggtacgaaacccacacacgaccctcacgctgacctgcagcttctcgtaggtatttcacgttcagttacgtactggagacggctcggtgggcgtgggtccgtacgaccgtaccccgaaggtaaacggcccgtaggaagtcggtacgttcggacctacgtcgttactttaacggttgggtacgtagagttagtacggtaaagtacgtaacgtagttacctaagttaacgtttacgaacgtacggtcctaacgaccgttataaccaaccgtaaaggtacctaaacccttaaacccgaaaaacgttacgtacggttacctaacgtaacgaacgtacgtaaaccgtaacggtaacgaaccgtcgtagggtaaccggacttaacggacgtaacctaacgtaattaacgttacttacggtacaacccgtaacacccggttaacgacgttacgaaaccccgtccgaggttaccgtaacgggttaaaccgccgtaaacgtaaccgttccggttacccggacccggtagggtaccgaaacccgggtacttccgtaaccgtaccttccgtacctaccggactaccccgccttaaccggacggtacccc

SEQ ID NO: 227792 - DNA, 692 bp, Homo sapiens
  misc_feature: GYAE6OF02GIG2Z.47.53.E09.1.454.CMB.1.raw
  modified_base (360)..(360): a, c, t, g, unknown or other
  misc_feature (360)..(360): n is a, c, g, or t
tcagagctcacgtacacgaccggtgctcgatttagagagagtgtgttgggttgggggactcctgtgcccaccatggacacactttgctccacgctcctgctgctgaccatccttcatgggtcttgtcccagatcaccttgaaggagtctggtccgacgctggtacgaaacccacacagaccctacacgtctgacctgcacgcttctcgtggtattttcactcgagttagtactggagaggtctaggtgggctgggtccgtcaccgccccaaggaacggtcccgtaggagtacggcttgcacgttctatttagtgggtactgtactgtagtaacgtactaactacgtctattattcgaagngtctacactactacaaccgtacgtaactacttaaccaaaacgtacgtacgtacctgaacatacgactacgagacgtctcggacgacgaccgaccaatacgtacttagttcggtcgaactaccgaaccggtacaccgtaaaccgtacccggacccgtacggtaccgtaagggtaactaccggaaacttaccggttacgggtaccccgtaacccggaccggggtacccgtaacccggggttaaccccgttacggtacccgtaccccgtttcctacccgttaccgacccgtacccccgttaacccggacccggtaacccgggtccctaccccggg

SEQ ID NO: 227793 - DNA, 846 bp, Homo sapiens
  misc_feature: GYAE6OF02IKM1I.47.53.E09.1.454.CMB.1.raw
  modified_base (386)..(386): a, c, t, g, unknown or other
  misc_feature (386)..(386): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatccaccttgaaggagtctggtccgacgccgtggtcgaaaaccccacacgacgacccctcaccgctcgacctgcagtcttctctggtacttttcactcagttagtactggagaggcgtggtggcgtcgggtccgtacgaccggcccccgaagggaaacggtcccgtagggtacgtggtactggacctacgttactagttttagtgggatcgtattgagtacgtaactcagtacctattacgttaacgaacgnggtcttacgactacgacctaacgaaacggactaacttaaacgaaaaaccgtagtcggtaaccctaggaacctaagtaccgtaaacacggtacgtaaacgtcccgtacggaccggaaccaccggtaaccctaaagtaacgtttaacgtttaacggttacggttaccgaaacccgttaacccgtaaaccccggtacggtaccccttaacgttaacccccgggacggttaaaccgaaccgggttaacgggtaaaccttaacccggaaacccgtaaaccgggttttccccgggtaaccccgggaaccccgggttaccgggggtaaaccccggttacccgggggttaaacccttttacccggtaccgtaaccccggggttttacccctaccccggttaccggttaacccggtacccccttaacccgggaaaccccggtacccggggtaccccctttaacccgggg

SEQ ID NO: 227794 - DNA, 833 bp, Homo sapiens
  misc_feature: GYAE6OF02HXNH2.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtacgaaacccacacacgaaccctcaccgctgacctgcagtcttctactggtattttcactcagtagtactggagaggctggtgggctgggtccgtcacgccccgaggaacgccgtggagtggtcttgctactctagtttagtgggatgtagtaggtagaacgttactacgtacgtacctattacgtttacgaaggtcggtcctacgtaacttactaccaaaccgtaaacggtacctaaacccttaaaacccgaaaaaaccgtacggttaccggttaccttaacggtaaaccgtaaacgtaccgtaaacccgtaaacggtaccggaaacggtaccccgttagggaaccccgggaaccggaaacccgggaccctaaaccgttaagtttaaacgttttaacgttacggttaccggaaccctaacccggaaccccggtacgtacccgttaaacgaaccccggaccgtacggtaccggttaaacggggaaaccttaccggaaaccgtaacggttccgggttaccccggtaaccccgggttacgggggtaccccggtaaccggggttaaccctttcccgggttaacccttaccccgggttccttaccccgtacgtaaccccgttacccccgtacccggtaaaccccggtaaccggggtcccccttaaccccggg

SEQ ID NO: 227795 - DNA, 806 bp, Homo sapiens
  misc_feature: GYAE6OF02HJWMF.47.53.E09.1.454.CMB.1.raw
  modified_base (240)..(240): a, c, t, g, unknown or other
  misc_feature (240)..(240): n is a, c, g, or t
  modified_base (294)..(294): a, c, t, g, unknown or other
  misc_feature (294)..(294): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgaccgtccgacgagctgtatcgaggccacccctgactgtcagtcggccccaggacaggaccggccacggtattacgttgtcggcgggacncgtagtggttagggaaagaaaggagtacgtacacgtacggtaaccaacgaagtnagccgaaggccgaccgtccctcggtgcgtggtacgtctagtagattcggattacggtccgacccgggtccttcggtaccgggtacctaccccggagtcttacgttcctccgaacggttcctaacgtaacggttcgaacggtacccaccgggtccctacccggacgaccgttacgacggaccggtacgggtaccggtaacgggtacgggggtaacgtacgggacgggttacccgttaaggtttttacggttttcggtaacggttacggggttaggggttacggtaaacggtttaaacgtttacgtttttaggtaccgttaagtttaacggttgggttttccgggttaaccggggtaaccggggtaaaccgggttaaaccggcggttaaccgttaccgggtccggttccccggtagtacccggtacgtacccggtaacggtcccggtacccccgttcccggtacccggttaccacccgtttaccgttcccgttaccccccgtaccttacccggg

SEQ ID NO: 227796 - DNA, 699 bp, Homo sapiens
  misc_feature: GYAE6OF02GWKOT.47.53.E09.1.454.CMB.1.raw
  modified_base (382)..(382): a, c, t, g, unknown or other
  misc_feature (382)..(382): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgacacaggctctgtgacgtccgacgagctgattcaggcctaccctgatgtcagtcggcccaggacaggacggccaggtattacttgtggcgggacgccaggtgttggagaaagagtgtacacgtggtaccaacagactgaccaggaccacggcccctaggtcgcgtcggtcgttactagtcgatgaataggtcgaccgcctgtaggcctccccggagcgtattcctgtgcctacaagtcgtacggacncggccctaccgtacgtaccgtcgaacgcggtacgggtcgacgggtcggggtatacgggacggtcgtttaagtttcgttttacggcggtaagggtttcgggtacgggtaacttaaacgtttagttttacggtaccgtaagtttaccggtttggtttaccggttcgggacggggtaacggtaaccgtcggtaccgttacgggacccgttacggtaccgtacgtaccggaacccgtaccgggacttccccggtaccccgttacgggtaccctcctttacccggttacccctaccccgttaccccgttacccttacccggg

SEQ ID NO: 227797 - DNA, 675 bp, Homo sapiens
  misc_feature: GYAE6OF02F3MBF.47.53.E09.1.454.CMB.1.raw
  modified_base (148)..(148): a, c, t, g, unknown or other
  misc_feature (148)..(148): n is a, c, g, or t
  modified_base (240)..(240): a, c, t, g, unknown or other
  misc_feature (240)..(240): n is a, c, g, or t
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (331)..(331): a, c, t, g, unknown or other
  misc_feature (331)..(331): n is a, c, g, or t
tcagagctcacgtacacgaccggtgctcgatttagagagagtgtgttgggtttgggggactcctgtgccccaccatggacacactttgctccacgctcctgctgctgaccatcccttcagtgggtcttcgtcccagatcacttgaagngtctggtccgagctggtacgaaacccacacacgaccctcacgctgacctgcagcttctcgtaggttacttttcacttcaagtgtactggagnggtctggtggccgtgggtaccncaccgccccgaaggtaaccgccgtggagtggctnctctcgtatttgtggatgattggtagaatactacncgtactagttactacgagtacgctactactacacactaacgacctaacctaaaaccgaaaaaccgtaggtaccgtacctaaggtactaaactcgaaaccgtacgtaacggacgtaccgtaggaccgaccgtaaccgaccgtaactaattactttaagtcgtcaccaaacccgtacctaaccgtacgtaacctacccgaccgtacggtaccggtaaggtaaccgaacccgttaacgtaacggttccgggttaccccggcccggtagggtaaccgacggttaacctggttacctaaccgtcccttaccgtctcccgaccgttacccaccgaccgggtaacgccccg

SEQ ID NO: 227798 - DNA, 937 bp, Homo sapiens
  misc_feature: GYAE6OF02F146I.47.53.E09.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
tcagagctcacgtacacgaccggtgctcgatttagagagagtgtgttgggtttggggagtctggcctaaggaagcagcactggtggtgcctcagccatggcctggacccgttctcctcctcggcctcctacctcgtccactgcacaggcctctgtgacgtccgacgagctgattcaggccacctcgatgtcagtcgcccaggacngacggccaggattactgngcggncagtgtgganaagagtcgtacacgtacggtaccaacgagatcgacctaggccccgagtccccctggtacgtcgtacggtccggtattacgtagtatgtagttacggtccgacccggtcccgtacgtcgggtaacctcccggagtaccgtacttctccgtgtcccacgtaacgttcggtacggaacctaccggacccttaaccgtaccggtaacccgtacggccgggtaccggggtaccgggtaccggggtacggggtacgtacggggtacccgggttaccggtttaacgtttacgtttttaccggtaaccgggttagggggtttacgggtacggggttaaacggtttaaaccgttttaaccgggtttttacggtacgtttaaaccggtttaaaggttttccgggtttttaacggggtttcccggggggtaaacggggttaacccgggggtaaaccccgttaaaccggggttacccgggttaaacccgggttaccccccgggttttaacccggtacccgggggttttaacccaccccgggggttaaacccccgtaacccggggttccccgttaaccccccgggttaccccccccggtttaaccggggttacccccctttaaccccggttttaacccccgggttttaacccccgggttttcccccccccgggttacccccccctttttacccccggttaacccccccgggg

SEQ ID NO: 227799 - DNA, 847 bp, Homo sapiens
  misc_feature: GYAE6OF02IJKG2.47.53.E09.1.454.CMB.1.raw
  modified_base (343)..(343): a, c, t, g, unknown or other
  misc_feature (343)..(343): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggccaccctcgatgtcgagtcggccccaggacagacggccaggattacttgtgcggagcagtgtggaagaagtagtgtacacgtcggtaccaacgagatcgccgaggcccacggccctggtcgcgtggtccgtctagtgagtgagtagcggaccgccctgtcggacctccgngtcgtcttcgtcgtcggtcctaccgtaaggtcggtacgggaaccaccggtaccccgtaaccccgtcggtaacccgaccgtaacggacccggtacggggggtaccgtaacccggggtacggggtacgtacggggtaacgggtacccggtttaacgttttacggtttttttacggaccggttaagggggtttacgggttagggggttaaaaccgtttaacggttttttaaacgggtttcgggtttaaccttaaggttttacggttttagggttttttaacggggtacccgggggtacggggttaaacccggggtaaccgtaaaccggtcccgtttaacccggggtaccccgttcccgggttaacccgggttacccgaaacccggggtaccccggtaaccgggtaaccccggtcccccggttaccccccccgggttccggttaaccccgttaccggtttcccccgggttttacccggtttccccccccgacccccgtttttccccgg

SEQ ID NO: 227800 - DNA, 792 bp, Homo sapiens
  misc_feature: GYAE6OF02FMLK5.47.53.E09.1.454.CMB.1.raw
  modified_base (723)..(723): a, c, t, g, unknown or other
  misc_feature (723)..(723): n is a, c, g, or t
tcagagctcacgtacacgaccggtgctcgatttagagagagtgtgttgggtttgggggactcctgtgccccaccatggacacactttgctccacgctcctgctgctgaccactccctttcagtgggtcttcgtcccagactcaaccttggaaaggagtcgtcggtaccggacgcgtggtacgaaacccaacacacgacccctcgacgcctagacctgacacgtcttcttcgttagttactttttccaacttcgaggttaagttacgtagggaggtcggtccgtgggtgggccggttcgggtccgtaccgaccggaccccgaagggaaccggtccggtagggtagtcggcttacgacctacttcgtttatttaacggtgggtagtagtaggttagtaacggtaacctaacttacgtacgtacgtaatttaacgttacgaacgtacgctactactacgtaaccaaaccggtaacgtaaccttaaaccctaaaacggtaaaaccgtacgttaccgtaacctaaggtaaaccctaacgggaacctaaaccggtacgtacgacgggtcctacggaacccgaccggtacgactattacgtagttcttaccgacgtaccgaacccgtacgtaccggtaccgaaccgttaccgacgtacggtacgtaacgtacgtacaacccggttcggtaacccggtccggtaccggtccggtaccgttaccgggtaccncccggtactacccgttaccgccgtaccgtaccctacccgtaccgaacccgggttcgacccgttacccgg

SEQ ID NO: 227801 - DNA, 914 bp, Homo sapiens
  misc_feature: GYAE6OF02I5X9Q.47.53.E09.1.454.CMB.1.raw
tcagagctcacgtacacgaccggtgctcgatttagagagagtgtgttgggtttggggggtcgttgtcccagatcaccttgaaggagtctggtccgacgctggtgaacccacacagaccctcacgctgacctgcagcttctctggtattttcactcagtacgtactggagaggcttggtgggctgggtccgtcacgccccaggaacggccctggagtggcttgcactcatttatgggctagatgtagagtactacagtccattacttcaagagctcactataccaccgaagtaccacttaacccgaaaaacaggtacggtacctagaactaactacggtaaccaaacggtacacgtaccgtacggccgaaccgaccggtaccctaagtaaccttaatttaacgtcgttaacgacctaacccgacccggtaacgtactaacgttaaccccggaccgtacgtaacggtaaccggtaaaacggtaccggtaaacccgtaaacggtttcccgggtttaaccccggtaacccccggttcgggggtaaccccggtaaaccgggggttaaacccctttaccggttaccccggttaacccggtttaccgttaaccccgttacccggaccggttaccccgtacccccgtaaaccggttaaacccggggccccgttaaaccgttttaccccgggggttacccccctttaccccccgggttacgggtaccccccttaaccccggtttaaccccgtacccggaaaaacggtacccgtaccccgtaccggtttaccccgggttaacgggggaaccctttaacccgggacgggtacccccggggttaccccgtttaccggggttaccccgtaccggttacccggttacggggtaacccccgttaccggttaacccccgttaaccccggg

SEQ ID NO: 227802 - DNA, 649 bp, Homo sapiens
  misc_feature: GYAE6OF02IMDXV.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgcgtggtagaaacccacacacgaccctcacgctgacctgcagtcttctctggtatttttcactcagtagtactggagaggcgtggtgggtcgtcggggtccgtccgacggcccccgaagggaaacggcccgtagggaggtcggtcttggcctacgtctaagtttttatggggtatggtattggtagtaactactacgacgttcctaattatttacgaagtagctacgactactacaaccgtaacgactaacctaacctaaaaacgagtcgtactagaacaatcgaactaagtagaacgtcgtagacggactaccgacataattaattagttgacacaaccgaccgaactctaacaccgctagacgtaaggaactccgaacgtaacgtcggttacccgacccggtacggaaccgtacgggtaaccctttcggaccgtacccgtcctaccgtccgaccgtccctaacccgaccgtaccggtcccttaccgg

SEQ ID NO: 227803 - DNA, 1087 bp, Homo sapiens
  misc_feature: GYAE6OF02HSHM9.47.53.E09.1.454.CMB.1.raw
tcagagctcacgtacacgaccggtgctcgatttagagagagtgtgttgggtttggggagtctgggcctaaggaagcagcactggtggtgcctcagccatggcctggaccgttctcctcctcggcctcctctcctcactgcacgaggctctgtgacgtccgacgagctgtattcgaggccaccccgtcgatgtacgagtccggaccccgaggacgacggaccggaccgaagggtacttaacgtttggtaggcggggtaacgacccgtaggttggttacggggaaggtaaaaggtaacgttcggtaacgtaacgttaccggttaaaccaaacgtaaggtactacggaccggaaccgggaccccgtaaccggtccccccgttggtacggtcccggttagggttacccgtttacgttaaggtacggacgtttaaggtaagttacgggtaccgggtaaccccggtccccgttacggttaccggggaccccttacccccgggaaggtacccggttaacctttccccggtaccggttaccgggtaaccccgttaccggtaaacggttaccgggttaaaccgggggaaacccgtaacccggggtccccccgttaaaccccggttcgggaaccccgggttaaccgtaacggggaacccgggttaacccgggggtacccgggtaaccggggggtttacccggggtaaacggttaccggggttaccgggggttaaaccttttacgggtttttaaaggttttttaccggttaccggggttaaggggttttaggggtaaccggggtttaaaccgttttaaacgggttttttaacggtttacggggttaacttttaagggttaaccggtttttcgggttttaccgggggttcggggtaaacccggggttaaccgggttaaacccggtacgggttaaccccgttaaccgggttccccggtttacccgtaccgggtaacccggtaaccccgtaccgggtaacccggttcccgccccccggttaaccccccggttcgggttaccccttaaccccgggttcccgttttaaccccccgttacccccggtaccccccgtttaacccg

SEQ ID NO: 227804 - DNA, 712 bp, Homo sapiens
  misc_feature: GYAE6OF02HI3FQ.47.53.E09.1.454.CMB.1.raw
tcagagctcacgtacacgaccggtgctcgatttagagagagtgtgttgggtttggggctgggcctaaggaagcagcactggtggtgcctcagccatggcctgaccgttctcctcctcggcctcctctctcactgcacaggctctgtgacgtccgacgagctgattcaggccaccctcgatgtcagtggccccaggacagacggccaggattacttgtgcgggagccagtgttggaagaaagaagtgtacactggtaccaaacgagatgccaggccaggccccctgtgcgttggtcgtcttatgatgatagtcgaccgccctgtgggactccccgagcgtacttctcgtcggtctaccgaaggtcgtacgggtaaaccgaccggccctaaccccgtggacccgtacacggtacgacggggtccggaaccggtcgggggagtacgggaacgggtccgttacgtttaagtttttcggtacgagggttgggttacgggaacgttaacgtttaagttttggtacttaattacgtttggtttacgggtttacgggacggggtaacgggtacccgtaaaggtaccgttacggtacccgttcccggtcgggtaccgtaacggcccgtaaacgggtccgtaccccgggtcccccgttaccggtacccgtacccgttcccgtttacccgggtttccccccgtccccgttccccgttacccgg

SEQ ID NO: 227805 - DNA, 788 bp, Homo sapiens
  misc_feature: GYAE6OF02FNWUF.47.53.E09.1.454.CMB.1.raw
  modified_base (649)..(649): a, c, t, g, unknown or other
  misc_feature (649)..(649): n is a, c, g, or t
tcagagctcacgtacacgaccggtgctcgatttagagagagtgtgttgggtttgggggggtcttgtcccagatcaccttgaaggagtctggtccgacgctggtgaaacccacacacgaccctcacgctgacctgcagtcttctcgtgggtatttcactcagttagtacgtggagaggtctggtgggcgtgggtccgtacgacgcccccgaagggaaacggccgtggtagtggtcttggcacttctagtttagttgggatgtatggtagtaacgtacgttacagtacctattactttagaggtacggtcctacgtacactaccgtaaccgaaggaaccttaacccttaaccgaaaaaccgtaggttaccggtacgtacgtaactaacgtacgtaaacccgtaaggtacgaaacgtcgtacgggaacggtacgacggtcccaatacgttacttagttcacgtaccaccgtaaccgacgtcgtaactccgacgcgtacgtaggtaactcccgtaatacggtccggtaccgaccccgggttaggggaccgttaaccggggtacccttaggtcccgtaccgttaccttacgaccgtcgtaccccgtactaacggaccgggttacccaggtttcccgttaccctcccgggttacnccccgttaccgtaaccctacggtaacgccgtaacctccggtaacggtccggggaaccaccggttaccgggacccgggttacgtaccggggtacctccgtaaccggtttacggaacccgttacgggtcgtttaaccccgg

SEQ ID NO: 227806 - DNA, 944 bp, Homo sapiens
  misc_feature: GYAE6OF02HH4I9.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtcgacgtccgacgtagctgtattcgaggcctacccgttcgatgtccaggtccggccccaaggacacggaccggtaccgagggtaactttaccgttgtcggccggggtagtcccgtaagggttcggttaaggaagaaaacggtaagttacgtacctacggttacggtaaccgaactaagtacgtccggaccgacggcccgtaaccggtccccgttagggttccgtccggttacgggttacccggttacgttagttacggaattacgggaagtttacgggttcccggtacccgggtccccttagggtaccgggtacccgttccccggacgtaccggtactttccgtcggttccggacctacccggtagtaccggtaacgggaaccgaccggtccccgtaaccgttccggacccggtttacggaaccggttaccgggtacggggttaacccgggtaccggggttacggggtaaccgggtacgggtaaccggttaccgggtttaacgttttaacggttttcggttaaccggttggggttacgggttacggggttaaacggtttaccgttttaaagggttttcggtaacggttaacgtttaggtttacggtttaccgggttaccgggtaacgggttaaccgggtaacggttaccggtacggttaccggtacccggtttccggtaccgggttccgaacccggtcccggtaaccggtcccggttacccccggtaccccggttccggtaccccgtttaccgttcccgtttaccccgtccccgtttacccgttccccgttaacccgg

SEQ ID NO: 227807 - DNA, 717 bp, Homo sapiens
  misc_feature: GYAE6OF02GEB94.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtcggcccaggacagacggccaggattacttgtgcgggagccagtgttggagaaagagtgtacactggtaccaacagatgccaggccaggcccctgtgctggtcgtctatgatgatagtcgaccggcccgtcgtcggactccccgagtcgtacgtttctcgtcggtcctaccgtaagttcgtacggggaaaccaccgggcccacccgttcgacccgttccgacggtacggacggggttacccgacgggtacggggtagtcgggtaaccgggtccgttttaaagtttacggtttttacgttacgggtcgggtttagggtcggggttaagttaaccgttttaaagttttcgggttacttaagttagtttcgggtttaggtttccggggtaacgggtaccgggaaccgtaaggtccgttaccgggtacccgttccgtaccggacgtacccggtacccggaacgttcccgtcccgtacccccggtcggttccgtaccgttcccgttcccgtttcccccgtaccccgttcgttacccg

SEQ ID NO: 227808 - DNA, 658 bp, Homo sapiens
  misc_feature: GYAE6OF02FXAKF.47.53.E09.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctcgatgtcagtcggccccaggacaggacggccaggattacgttgtgcggganccagtgttggaagaagaagtntacactaggtaccaacagatcgaccaggccacggcccctgtcgcttggtccgtctagtgatgataggtcgacccggtccctcggtcgggacctccccgagcgtacttcctcgtcgggcctaccgaagttcggtaacgggaaccaccggacccacccgtacgacccgtcgacggccgtacggggtccgtacgggtaggggacgtagggacggtaccgtttagtttacgttttcggagtagggttggtagggtaacttaacgtttaagttttcggatagttagttggtttacggttcgggacgggtacggtaccgtaagtcgtaccgtaccgttccgtacggtcaccgtaccgacggtccgtcccgtccccgtggtaccctcgttccgttccgtcccctcccgtcttcccg

SEQ ID NO: 227809 - DNA, 663 bp, Homo sapiens
  misc_feature: GYAE6OF02HR4CV.47.53.E09.1.454.CMB.1.raw
  modified_base (221)..(221): a, c, t, g, unknown or other
  misc_feature (221)..(221): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (427)..(427): a, c, t, g, unknown or other
  misc_feature (427)..(427): n is a, c, g, or t
tcagagctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggccaccctgatgtcagtcggccccaggacaggaccggcaggatttacgttgngcgggagccagttggttaggaagaaagaggtgtacacgtggtaaccaacagatgaccgaggccgacgcccctggtcgcgtggtcgtctagtgatgatagtcggacccggcctcgtcggctcccgngcgtattcncgtcgctccgagttcgcggaacaccggccacccgtggacccgtcgacgcgacgggtaccggacgggtcgggngtacggcggtacgttagttacgtttttcggtaggtagggttggtagggtagtaacgtttaagtttggtacttattagttcggttcggttaccggggagggtacgggtaaccgtaaggtccgacgttacccggtctccggttacgaaccggcccgtaacggtcccgttacccggtcccccgttcggtaccctaccgttcccgtttcccggttcccccgtccccttcccgttacccgg

SEQ ID NO: 227810 - DNA, 866 bp, Homo sapiens
  misc_feature: GYAE6OF02G26G7.47.53.E09.1.454.CMB.1.raw
tcagagctcacgtacacgaccggtgctcgatttagagagagtgtgttgggtttggggctgggcctaaggaagcagcactggtggtgcctcagccatggcctggaccgttctcctcctcggccttcctctctcactgcacaggctctgtgacgtccgacgagctgattcgaggcaccctcgatcgtacagtcggccccaggacacggacggaccaggtacttacgttggtacggcgggagtacccgagggttcgttagggtaagaaacggaagttacggtactaccgttagggtaaccccaacgtaggtaacttcggacccgacgggacctacccgggtacccccgtgttaccggcgttacggtccgttcgttacgtgtaacgtgtaacggtacggttacggaccccgggtccggttaccgtccgggtaccgtcccccgggacggtaccgtaccgtttccgttcgtcgtaccctaaccgtacgttcggtacggaacccgaccggtacccacccgtacggtaccgtcgacggacgtacgggtccggtacggtacgggtacggtacggacggttaccgtttagtttacgttttcggtacggttacgggttgggttaacgggttaacgttaacgtttttaacggtttacggttaccgttaagtttacgttacgggttttacggttacggggtaccgggtaacgggtaaccgttacggttaccggttaccgggttacccgttacccggttaccggttacccggaacggttacccggtaccggttaccggtaccccgttccccggtttaacggttcccgttacccgtcccggtttaccccgggtccccggtttaccccgtcccttaacccgg

SEQ ID NO: 227811 - DNA, 765 bp, Homo sapiens
  misc_feature: GYAE6OF02JLTD5.47.53.E09.1.454.CMB.1.raw
  modified_base (138)..(138): a, c, t, g, unknown or other
  misc_feature (138)..(138): n is a, c, g, or t
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
tcagagctcacgtacacgaccggtgctcgatttagagagagtgtgttgggtttggggctgggcctaaggaagcagcactggtggtgcctcagccatggctggaccgttctcctcctcggcctcctctctcactgcacnggctctgtgacgtccgacgagctgattcgaggccaccctgatcgtcagtcggccccaggacagcggccaggtattcgtgcggcggancagtgtggaagaagagtnaacgacgtaggaaccaacgngtagtcgccgacgcccgaggtcccctaggtcgcgttacggtcgtactaggtgaagtggtagtacggtaccggcccggtcccgttggtccggggtaccctaccccggggtaggtaccgttacctttaccttcgggtccggtacctttacccgtaaagggtttcccggaaacggggaacctaccccgggaccctaccgtaccgggtaccctagggtaacgggttaccggggtaccggacgggtccgggtaaggtcggtacggttacgtttaacgttttcgtttacggacggtaaggggttggtaacgggttaacgttatttaacgtttgtacgtagttagttcggttacgggttaccgggcggttaaagggacccgtaagttccgtaccggtacccgttccgttaccggaccgaggtaccccgtaggttccctcccgggttaaccccgtcggttaccgtaccgttcccgttaccgttcccccgtaccgttcccgtaactccggg

SEQ ID NO: 227812 - DNA, 201 bp, Homo sapiens
  misc_feature: GYAE6OF02GI2GH.47.53.E09.1.454.CMB.1.raw
  modified_base (193)..(201): a, c, t, g, unknown or other
  misc_feature (193)..(201): n is a, c, g, or t
tcagagctcacgtacacgaccggtgctcgatttagagagagtgtgttgggtttgggagactaattttggtcatatgttgttcggcggagggaccaagctgaccgtcctcggtcagcccaaggctgccccctcggtcactctgttccccaccctcctctacgtgagctctgagcgggctggcaaggcgcatagnnnnnnnnn

SEQ ID NO: 227813 - DNA, 683 bp, Homo sapiens
  misc_feature: GYAE6OF02I10Z2.47.53.E09.1.454.CMB.1.raw
  modified_base (225)..(225): a, c, t, g, unknown or other
  misc_feature (225)..(225): n is a, c, g, or t
  modified_base (310)..(310): a, c, t, g, unknown or other
  misc_feature (310)..(310): n is a, c, g, or t
  modified_base (423)..(423): a, c, t, g, unknown or other
  misc_feature (423)..(423): n is a, c, g, or t
tcagagctcacgtacacgaccggtgctcgatttagagagagtgtgttgggtttggggctgggcctaaggaagcagcactggtggtgcctcaagccatggcctggaccgttctcctcctcggcctcctctctcactgcacaggctctgtgacgtccgacgagctgattcaggcacctgatgtcagtcggacccaggacagacggccaggattacttgtcgcggganccgagttcgttggaagaaaaggagtgtacacgtggtacctaacagaatcgaccaggccacggccccctagtcgctggtcgtactntgtatgatagtcgacccggtccctacgtcgggtactccccgagccgtaattcgcgtcgtcctaccgtaaggtccgtagggtaaccgaccggtaccacccgtacggacccgttnaacggtcgaacgggtaccggacggtacggggattacggacggtcgtagtttagttttcggtacgtagggtgtagggagtaaccgttagtttaggctagtacgttggttacgtcggtacgggacgggtaaccgtaagtccgttaacgacccgttcgtaccggttaccgtacggtacccggaaggttcccgtaccggtcccccgttacggtcccgttaacgtcccggttacccgttcccccgttaccgtccccgttaaccgg

SEQ ID NO: 227814 - DNA, 929 bp, Homo sapiens
  misc_feature: GYAE6OF02JEZQC.47.53.E09.1.454.CMB.1.raw
tcagagctcacgtacacgaccggtgctcgatttagagagagtgtgttgggtttgggggtcttgtccagatcaccttgaaggagtctggtccgacgctggtgaaacccacacagaccctcacgctgacctgcagcttctctgtatttcactcagtagtactggagacgtctggtgggctcgggtccgtcgacgacccccgaagggaacggcccgtggagtcggcttgcctacgtctatttagttgggatgatgtgtaagtactacagtacctattattacgaagtacggtccttactacctaataccaacccgtaaaggtacctaacctaacctaaaaaccgtacgttacgggttaccctaaggtaacctaaacgtaccggaaaccctaaacggttaacggaaaccgacccgttacggaacgggtaaaccctaccggggaacccctaaacgtaacgtttaacgttttacgtcgggtaacgaccctaaaaccggtaacccgaaccggtaccttaacgtaaccccggaacccggttaacgacccggtttaaggggaaaacctccggtaaaccgtaacggtttaccgggttaccggaacccccggttacggggaacccgtaacgggttaaacccgttcggttaacccgtaccgggttccttaacccggtactacccggtaccctaccccgttaaaccggaaacccggtcccgttaaccggttccccgggttacccctttacccccgggttaccggtaccccgtttaaccccgttccccggtaaacccggtaaaccgtaacccgggttccctaacccgggttccgtaccccgggggtaccaaacccggttccgggaaccccggttccggtacccggggttccgtaccgggttaccccgccgggttaaacccggtacggttaacccgttacccgg

SEQ ID NO: 227815 - DNA, 799 bp, Homo sapiens
  misc_feature: GYAE6OF02HPIDG.47.53.E09.1.454.CMB.1.raw
  modified_base (216)..(216): a, c, t, g, unknown or other
  misc_feature (216)..(216): n is a, c, g, or t
  modified_base (263)..(263): a, c, t, g, unknown or other
  misc_feature (263)..(263): n is a, c, g, or t
  modified_base (668)..(668): a, c, t, g, unknown or other
  misc_feature (668)..(668): n is a, c, g, or t
tcagagctcacgtacacgaccggtgctcgatttagagagagtgtgttgggtttggggagtctgggcctaaggaagcagcactggtggtgcctcagccatggcctggaccgttctcctcctcggcccttcctctctcactgcacgaggctctgtgaccgtccgacgagctgtatcgagccacccgtcgtatcggtcaggtccggaccccgaggaacncggaccggccgtaggttaactttacgtttcggtcgggaccgggtacnccgttaagggttggttagggaaagtaaaacggtaaggttacgttaccgaacgttacgggtaaacccaacgtaacgtacgtcgaccgaccgggtacccgtacccggtcccccgttaagggtcctaccgggttcggttaccgggttacgtaagttaggttacggttacggtaacgttaccgggtccgtaccccggttcccggttggtaccgggttaaccccgtcccggtgtacgttcttccgttcgtaacgttaacccgtcttacgtacggacggtaccgaaccgtcccaaccggcgactccgaaggtccgacgggttacgaccgggtggacgtcgtaacggttacgtttgtttacgttttcggaacggttgggtgggtacggtaagttccgtttaagttccggtanagtttcgtagtacggtggaacggtacgacttcgcgtacgtacccgtcgtagtcccgtaacggccgtagtccgttaccccgccggtttaccaccggttccttacggttacccctccccgttcccgtttacgg

SEQ ID NO: 227816 - DNA, 742 bp, Homo sapiens
  misc_feature: GYAE6OF02GKXX3.47.53.E09.1.454.CMB.1.raw
  modified_base (389)..(389): a, c, t, g, unknown or other
  misc_feature (389)..(389): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctgggtcgaaacccacacacgaccctcacgctgacctgcagcttctctggtattttcactcagtagtactggagaggctggtgggcttgggtccgtcacgcccccgaggaaacggcccgtggagtggcttgcactctatttagttgggatgatgtagaagtactacagtcctaatattcaagagctcactactcaacaagactactaaccaaaaacagtcgtacctanaacaatacgaaccaacgtagaacgtccgtcgacggaaccgacgggacccaaactaacgttaactttaactttggtacgtaccgtaaccgaacccggaaccggtaccttaaacgttaaccccgaccgtaaacgggaccgtaacggggtaaaaccttaccgggtaaaacctaaaccggttacgggtttaaccccgggtaacccccgggttacggggggtaaccccggtaaccggggggttaaacccccgtttagggtaacccccggttaaacccgttacccgttaccccgttacctacccgggtaccccctaaccccggtaaacccggtacccgggtacccccgttaaacccggg

SEQ ID NO: 227817 - DNA, 640 bp, Homo sapiens
  misc_feature: GYAE6OF02GHF5O.47.53.E09.1.454.CMB.1.raw
tcagagctcacgtacacgaccggtgctcgatttagagagagtgtgttgggtttgggggggtcttgtcccagatcacccttgaaggagtctggtccgacgctggtgaaacccacacagaccctcacgctgacctgcagcttctctggattttcactcagtagtactggagaggtctggtgggcgtgggtccgtcacgcccccaaggaaacggccctggagtggcttgcactcatttacttggggatggatggtgaagtactacagtaccattatttacaagagctacactatacaccaaggacctaccttaccaaaaaccaggtacgtcctgaacaagtcgaccaacggtagagtccgtgaccggtacaccggcaacgattattatgtgaccacaccgacactactacccgccagcgtaggaatcgaactaacgcggttccgaccccggttcgggaccgacggtacccgttgtaccacccgttctacccgcacgtcctacccaccgacggaccctacgtcccgtccgttccccgtgccctaccccgtcctaccgtaacgcgaccctaccgtcggtacgggccacggtacgccggtcccggtagccgtacgtccgtacggtaccgtaacggtccttaaccgg

SEQ ID NO: 227818 - DNA, 761 bp, Homo sapiens
  misc_feature: GYAE6OF02JKJ1N.47.53.E09.1.454.CMB.1.raw
  modified_base (330)..(330): a, c, t, g, unknown or other
  misc_feature (330)..(330): n is a, c, g, or t
tcagagctcacgtacacgaccggtgctcgatttagagagagtgtgttgggtttgggctgggcctaaggaagcagcactggtggtgcctcagccatggcctggaccttcgtcctcctccgccgtcctcctctcactgcacagcgtctgtgtacgtaccgaccgacgtctgtattcacggccgaccctcgtagtgtcgacgtcggcccgacgacgacgacggaccgagtattacgttgtggcgggacgccgtaggtggttaggaagaaagagtacgtacacaggtaccaacagatcgccgacgccgacgcccgtgtgcgtggtcgtctagtncgtagtatacggtccggacccggtcccgtcgtagggacccgtccccgcgtagtccttcgtcgtcgacgtacctaggtacgcggtaaccgtacccggccctaaccctccgggtccgtaccgtaggaccggtcgggtaccgggtacggtcggggtacgtacggtacgggtacgttacgtttaacgttttcggtacggtacgggttcgggtacggttaacgttacgtttaacgttttaggttaacggtacgtttacggttcgggttttacggttacgggtaaccgggtaacgggtaccgtaaccggtcgtacccggtccgttacccggttccggtacggaacccgtcccgggtaaccggttccggccccgttacccggttcccggtccttaccgtcccggtttacccgtccccggttacccttacccgttccgg

SEQ ID NO: 227819 - DNA, 766 bp, Homo sapiens
  misc_feature: GYAE6OF02GBBOG.47.53.E09.1.454.CMB.1.raw
tcagagctcacgtacacgaccggtgctcgatttagagagagtgtgttgggtttggggggtcttgtcccagatcaccttgaaggagtctggtccgacgctggtgaaacccacacagaccctcacgctgacctgcagcttctctggattttcactcagtagtactggagaggctgtgggctgggtccgtcacgcccccaggaaacggccctggagtggcttgcactctatttatgggatgatgtgtaagtactacagtccaattctttacaagacggtctctactataccaaccgaaggactaacttaacccaaaaaccgaagttcggtaccctagtacaattcgaaccaacgttagaacgccgtacgacgacgaccggtaccacgtaattaactttattacggtcgacccgtaaccgaaccccggtacgaccttaacgtaaccccgtacccgaggaacccggttacggggaaaaaccccggaaccgttaacggttaccgggtttaacccggtacccccgggtacgggggtaaccccggtaaccgggttaaaccccgttacggtcccgtaccccggtccctacccgttaccgacgtcccctacccgaacccgtaaccggacccgtacgttccggtccccttacccgtcccggccctacccttcccgtacccgtacgtaccgcctaacccgtcggtacggggcctaccggacggcccggccgtcggtaccgtcggccgttgggacctacggtaccgttaccttacccgg

SEQ ID NO: 227820 - DNA, 712 bp, Homo sapiens
  misc_feature: GYAE6OF02I4H7O.47.53.E09.1.454.CMB.1.raw
  modified_base (239)..(239): a, c, t, g, unknown or other
  misc_feature (239)..(239): n is a, c, g, or t
tcagagctcacgtacacgaccggtgctcgatttagagagagtgtgttgggtttgggggactcctgtgccccaccatggacacactttgctccacgctcctgctgctgaccatcccttcatgggtcttgtccagatcaccttgaaggagtctggtccgacgctggtacgaaacccacacacgaccctcacgctagacctgcagtcttctctaggtacttttcactcagtagtactggagnggcgtggtcggcgtcggtccgcaccgacccgaaggaaccggccgtggacgtgtcgtcgctactcttagtttaggttagggatcggtagtggttaacgaacgttaaccgtacctagtaccttaatttacttacgaacgtacggtctactcgtaactacaacgaacgaacctaactaaactaaacgtacgtacgtactacactaacgtacgaaccgtaagacgtacgacgtacggaccggacgaccgacctactaactagttacgttagccgtaccgtacacccggtactaaccgtaacgtacccgtaccgtacgacggtaacggtaacgtaccgttaaacgtaccggttacgttcccggacccgggtaccggggtaacccgtaccgggtaacccgttacgtacccgtaaccgttcccgtaaccggtccgacccgttacccggtaccctaaccggtaccggtacccctacccggg

SEQ ID NO: 227821 - DNA, 1070 bp, Homo sapiens
  misc_feature: GYAE6OF02G58HG.47.53.E09.1.454.CMB.1.raw
  modified_base (303)..(303): a, c, t, g, unknown or other
  misc_feature (303)..(303): n is a, c, g, or t
tcagagctcacgtacacgaccggtgctcgatttagagagagtgtgttgggtttgggggtcttgtcccagatcaccttgaaggagtctggtccgacgctggtgaaacccacaacagaccctcacgctgacctgcagcttctactggtattttcactcagtagtactggagaggctggtgggcttggggtcctcgacgaccccgaaggaaacggcccgtgggagtggtcttacgctactctagtttagtcggatggaacgtgtagtaagttactacgtacgtacctagttactttacgaaagggnggtaccttacgtaaaccttacgtaacctaacccgaaaaacggtaccctaaaccgttaaaacccctaaaaaaaccggttaacggttaggtccccgttaaggaacctaaacggtaacccggaacccttaaaggggtaacctaaccgggtaccccgtaccggggacccgtaaacccggaccccggggtaacccgtaaccttaaacgttttaacgtttttaaaccgggttcgtccggggttaaaccccaaacccgggttaacccggtaacccggtttaacgtaaacccggtcccccggtaaacgtaacgggttaccggttaaacggggtaaaactacccgggttaaaaccgtaaacccgggttttaccccggggtttacccgggttaacccccgggtaaccgggggtaccccggggtttaaacccggggtaaaccccggtttaccggtaaccccgggttaacccccgtttcccgttaaaccccgttccggtaaccccgtacccccggttaaaccccgtaaaccggaaccccggggttaaccccctaccgggtttaccccgggtttacccccgtttaccccgggttaccccggaccccgtttaaccccccgtttaccgtacccgtaaaccgggtacccgtacccggttaccccggttcggggtaccgggttcccgaccggtttaacccggggcccgggttcgggtacccgggttcgggtccggttccccggtaacgggtttaacccggttaaccggtcccttttaaacccgg

SEQ ID NO: 227822 - DNA, 787 bp, Homo sapiens
  misc_feature: GYAE6OF02I1XAO.47.53.E09.1.454.CMB.1.raw
tcagagctcacgtacacgaccggtgctcgatttagagagagtgtgttgggtttgggggactcctgtgccccaccatggacacactttgctccacgctcctgctgctgaccactcccttcatgggtcttcgtcccagatcaccttgaacggagtctggtccgacgctggtacgaaacccacacacgaccctcacgctcgacctgacacgtcttctcgtggtacttttcactcagttacgtactgggacgaggtcgtggtcgggtcgtcgggtcccgtcgaccggaccccgaaggaaaccggtcccgtggaggtcggcttcggcctactcttagtttacgtagggtattggagttaggtagtaacgtacctaacgtacgtacctaagtttacgttacgaacggtacggtacctactaacgtactaccaaaccgaacggtaacctaaacgttaaacccaaaaccgtacggttacggtacctaacgaacaacgtaccgaaccgtaacgtacgaacgtccgacggaccggaacgaccggtacctaacttaacttagttacgttacgtacgaaccaacccgaccgtaccgtaccgttaaccgacccggtaccacggtacgtaagggtaacctaccgtaaccgtaaccgtccgggttacccggaccccggttacgggggaaccctaacccggggtaaccccgtttccggtaccccgtaacccggttcccgttaccgtaccctaaccggtacccccgtaacccggaaccccggtacccgggacccttaccccggg

SEQ ID NO: 227823 - DNA, 204 bp, Homo sapiens
  misc_feature: GYAE6OF02GDDBP.45.61.F06.1.454.CMB.1.raw
  modified_base (201)..(204): a, c, t, g, unknown or other
  misc_feature (201)..(204): n is a, c, g, or t
tcagacgcgatcgacacgaccggtgctcgatttagctacgctctaagggaaagggaggtgtgtcacaagatttgggctctgggcaccgtgggcacggggaggtgtgtcacaagatttgggctctgggcacagcggccctgggctgcctggtcaaggactacttcctcgatcgcgtctgagcgggctggcaaggcgcatagnnnn

SEQ ID NO: 227824 - DNA, 695 bp, Homo sapiens
  misc_feature: GYAE6OF02FNNDY.45.61.F06.1.454.CMB.1.raw
  modified_base (282)..(282): a, c, t, g, unknown or other
  misc_feature (282)..(282): n is a, c, g, or t
tcagacgcgatcgacacgaccggtgctcgatttagctacgctctaaggaaagggaggcgtagggtccagccggggggtctctggagactctcctgcggctgcctcgtcggattcaccttcacgtggcttactgctctccacgtggtccgcgagggccaggcaagggtctggagtcgggtgggagccgtcctcgaaaggactggacgtactaaaacatatttcgctacgactccggtagtggcgccgattccaccatctccgaggaaacaagtccccgggaanaccctacattcctacctactatagtaaatccctgaagtaacccggagggaaccaccggtacttgtttattctgtagccagaggtcgaaggtctggtcgtggggacgtaacgtcaactcccgtacgaaattactaacttacgtacgtagtcggaaccgtccgtaggggactaaaaggggtccctacgggtccgtccgtacctcctccgacgtccttaccgtaccgaacgggtacccctacgtaccggttaccgtttcccccgtacggtacctaccctccctaccgaacgtacgaccgtaccgttccggtcggggtcctaccgacggccggtcccgtcgggacgtcgtccgtacggtacgtaacggtaaccttaccgttccgtcgtacgtcgcgtccgtcgacgtcggtcgtcgg

SEQ ID NO: 227825 - DNA, 160 bp, Homo sapiens
  misc_feature: GYAE6OF02IFKTH.45.61.F06.1.454.CMB.1.raw
  modified_base (159)..(160): a, c, t, g, unknown or other
  misc_feature (159)..(160): n is a, c, g, or t
tcagacgcgatcgacacgaccggtgctcgatttagctacgctctaagggaaagggggaggtgtgtcacaagatttgggctctgggcacagcggccctgggctgcctggtcaaggactacttcctcgatcgcgtctgagcgggctggcaaggcgcatagnn

SEQ ID NO: 227826 - DNA, 518 bp, Homo sapiens
  misc_feature: GYAE6OF01C5SM0.23.21.B10.1.454.CMB.1.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
tcagacgcgagtatcacgaccggtgctcgatttagtgtcgtcgcaagagaggaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgattgttgggacttttaatatggtctcgtggtaccaatacctccaggcaaacgccccaaatcatacttangaggcactaagcgcctcgagggtttctagtcgcttctctggctcaagtctggacaacacggcctccctgaccatctctcggcctccagcctgacgacgagctgattattattgctgctcatatgcagatagtagttactttggaggttcgggacgggggacaagggtgtaccgtcgtaggtcagcccaaggctcgcccctggcactcgtcgttcccc

SEQ ID NO: 227827 - DNA, 540 bp, Homo sapiens
  misc_feature: GYAE6OF01CMHD3.23.21.B10.1.454.CMB.1.raw
  modified_base (230)..(230): a, c, t, g, unknown or other
  misc_feature (230)..(230): n is a, c, g, or t
  modified_base (374)..(374): a, c, t, g, unknown or other
  misc_feature (374)..(374): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtcgtcgtggtacaatacctccaggcaaacgccccaaatcatactttatgaggcactaagcggcctcgtagggtttctagtcgcttctctggctccaagtctggacaacacggccctccngaccattctctcgcctccagcctgacgacgaggctagtattattattgtctgctacatatgacaagtatagtagttacgtttgtagggttcggacgggggactagggtgaccggtcggtacggtcgacgcccgaaggctcgtcccctcggccactcgtcgtccccg

SEQ ID NO: 227828 - DNA, 528 bp, Homo sapiens
  misc_feature: GYAE6OF01CITFL.23.21.B10.1.454.CMB.1.raw
tcagacgcgagtatcacgaccggtgctcgatttagtgtcgtcgcaagagaggagggggggtcacaagaggcagcgctctcgggacgtctccaccatggcctgtgctctgctgctcctcactctctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaacgcccccaaactcatactttatgaggcaactaagcggccctcgagggtttctagtcgcttctctggctcaagtctggcaacacggcctcctgaccatctctgcctcacgcctgacgacgaggctgattattatgctgctcatatgcagatagtagttactttggtaggttcgggcgggggacaagggtgaccggtcgtaggtcgacgacccgaacggtctcggccccctggtcctcgtccgtcccg

SEQ ID NO: 227829 - DNA, 579 bp, Homo sapiens
  misc_feature: GYAE6OF01CWK8M.23.21.B10.1.454.CMB.1.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggacttttaatatggtctcgtggtaccaatacctccaggcaaacgccccaaatcatactttangaggcactaagcgcctgagggttctagtcgcttctctggctccaagtctggcaacacggcctccctgaccatcctctcgcctccagcctgacgacgagctagtattattattgctgtctacatatgacagtattagttagttacgtttggaagggttccgggacgggggtaactaagggtcggtaaccggtcggttacgggtacgacggtccccgaaagggtcccgtaccggtccccccgttacggtacctacccgttccgttccgttacccccg

SEQ ID NO: 227830 - DNA, 589 bp, Homo sapiens
  misc_feature: GYAE6OF01DT2A2.23.21.B10.1.454.CMB.1.raw
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactcggaacccgnagtgattggttggtacttttaatatggtctcgtgtaccaatacctccaggacaacgacccccaaatcatactttanggaggcactaagccggcctcgagggtttctagtcgcttctctggctcagtctggacaacacggtcctccctagaccatcctcgtcgcctccagcctagaccgacgaggctagatttattattcgctgtcttacaattatgactagtagttagttagttacgtttggacggggttccgggacgggggaacctaagggtcgtaccggttcggtacggtcacggtcccaagggtccctacccggtcccccgttacggtacctaccgttccgttccgttaccccccg

SEQ ID NO: 227831 - DNA, 568 bp, Homo sapiens
  misc_feature: GYAE6OF01D9SZC.23.21.B10.1.454.CMB.1.raw
  modified_base (251)..(251): a, c, t, g, unknown or other
  misc_feature (251)..(251): n is a, c, g, or t
tcagacgcgagtatcacgaccggtgctcgatttagtgtcgtcgcaagagggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttanatggtctcgtggtaccaatacctccaggcaaagcccccaaatcatactttatgagggcactaagcggccctgagggtttctagtcgcttctctggctccaagtctggcaacacggcctccctgaccatctctcggccctccacgtcctgacgacgaggctagtattattattgctgctcatatgcaagtatagtagttactttggtagggttccgggcgggggtaactaagggtcgtaccggtacggttaggtcgaaggcccgtaaggcctccggccccccgtggtacccaccttccgttccgttcccctacccccg

SEQ ID NO: 227832 - DNA, 738 bp, Homo sapiens
  misc_feature: GYAE6OF01C67UC.23.21.B10.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcacgtcggaacccnagtgagttggttaggtaacttttaatatcggttcttcggtcggtaaccaattaccctccgaggacaaaccgacccctaaactctaatttacctttaagcggaacgggcctaacgtaacggtccggtacccttacgtacggggtttctacgtccgtccttcgttcgtacggtacctaccgtaaggttcgtacgggaacccaaacgtaccggtccccttacccgtacggaacccttacttcccgtcgtaccgggtcccctaccgaaccgtccgtacggaaccgtacggtacggtctagtatttattacgtttcgacctcggtacttacgaagttcgtcggtaacctaagtaacgtttaagtaacggtttacgtttacgggtaacggggttaccggggacgggggtaactacggggttacgaccggttacggtacgggtaccgacggacccgtacggtaccgttcccgtaccccggtcgtaccgtcccgttcgttcccggttacccccg

SEQ ID NO: 227833 - DNA, 663 bp, Homo sapiens
  misc_feature: GYAE6OF01C9K6B.23.21.B10.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgtagttggttaggttacttttaagtagttcggttcgtcggtacgtaacctaactacccgtaccgacgaccaaaccgacccctaaactactaacttacttagtacggacggactaacgtacggccgtaccgtacggtacgggttctacgtcgtcttctcgtcgtactacgtacgtcgtacgaccaacgtaccgtccctaccgtacacctactccgtcgtccgtcctaccgacgtccgacgacggacgacgtctagttattacgttacgtcgtctcgtactactatacgtcgacgtaagtagttaagttacgttacgttaggtacgggttacggggacggggtaacgtacggtacgtacggtacggtacggtacgacggtaccgacggtccgtacccgtaccccgttacgacctccgttccgtcccgtccc

SEQ ID NO: 227834 - DNA, 722 bp, Homo sapiens
  misc_feature: GYAE6OF01ECDTR.23.21.B10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgccctccgtgtctgggtctcctggacagtcgatccaccgtctcctgcacgtcggaaccccgnagtgattggttagggtacttttaatatggtctcgtagtaccaatacctccaggacaaacgccccaaatcattacttagtaggacggcacgtaacggccgcccttgtacgggtttctaggtcgtccttctcgtcggtcctaccgaagttcgtaggacctaaaccgtccggtccctcccgtagaacctacttccgtaccgtcggtacccctccgacgtcccgttaggacccgtacggaggtccttaggtaacttttaagtttacgttcgtaccgttcgtaccttacgtaacgttacgtcgtacgtaacgttaagttaacggttagttttaaccggtttgggtacgggggtttacccggggacgggggtaaacctaggggtccgtaaccggttcggtaccgggtaccgaccggtccccggtaaacggtcccgttaccccgggtacccccgtaggttaccctaccgttcccgttcccggttaaccccccc

SEQ ID NO: 227835 - DNA, 695 bp, Homo sapiens
  misc_feature: GYAE6OF01DBVG8.23.21.B10.1.454.CMB.1.raw
  modified_base (233)..(233): a, c, t, g, unknown or other
  misc_feature (233)..(233): n is a, c, g, or t
  modified_base (319)..(319): a, c, t, g, unknown or other
  misc_feature (319)..(319): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccncagtgagtggtttagggtacttttaaatagtggtctcgtggtaaccaatacctccaggaccaaacgccccaaactctatactttangagacactaagccggtcctgtagggtttctagtcgtcttctcgtcggctacctagtctggaccaacgcgtccctcctgacctactcctcgtcggcccctcgacgtccgtacgaaccgaccggtaaggtccttaaggttaacttttaacgttcgttcggtccgttacggtccttaaccgtaattagttcgaaccgtaaggttaagtttaaggtttaacgttaacggtttttggaacggggtttccgggggaaccgggggtaaccacggggttaccgtaaccgggtacggttacgggtaccgaacggtccccggtaaggtccccttacccgggtccccccgttaggtaccctaccgttcccggttcccgttccccccg

SEQ ID NO: 227836 - DNA, 537 bp, Homo sapiens
  misc_feature: GYAE6OF01C88D7.23.21.B10.1.454.CMB.1.raw
  modified_base (231)..(231): a, c, t, g, unknown or other
  misc_feature (231)..(231): n is a, c, g, or t
  modified_base (326)..(326): a, c, t, g, unknown or other
  misc_feature (326)..(326): n is a, c, g, or t
  modified_base (436)..(436): a, c, t, g, unknown or other
  misc_feature (436)..(436): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggtacttttaatatggtctcgtggtaccaatacctccaggcaaacgccccaaatcaatactttatgaggcactaagccgccctnaggggtttctagtcgtcttctctggctcaagtctggcaacgaccggcctccctcgaaccatctctcggccctccagcctgacgacgagctgattatattgctgctcatangcagatagtagtagttgacgggttcgggacggggacaagggtcgaccgtgtacggcacggcccgaggtcctcgtccccgtgtccacttcgtccgttccccg

SEQ ID NO: 227837 - DNA, 626 bp, Homo sapiens
  misc_feature: GYAE6OF01DZH5C.23.21.B10.1.454.CMB.1.raw
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
  modified_base (438)..(438): a, c, t, g, unknown or other
  misc_feature (438)..(438): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaatatggtctcgtgtaccaatacctccaggcaaacgcccccaaatcatacttangaggcactagcgcctgtagggtttctagtcgcttctctggctccaagtctggcaacgacggcctccctgaccatctcgtcgccctaccagtcctaggaccgacggtaggcttagtaatttattattgccttgacctnatagtgactaagtattaggttagttacgtttgggacgggtttcggggacgggggtaacctaagggttccggtaacccggttcgggtaacgggttacccaaccgggtacccccgtaaagggtccccttacccgggtcccccccgttacgggtaccctacccgtttccggttacccgtttaccccccccg

SEQ ID NO: 227838 - DNA, 678 bp, Homo sapiens
  misc_feature: GYAE6OF01DA2F0.23.21.B10.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgnagtgattggttagggtactttttaatatggtctcggtaggtaaccaataccctccgaggacaaacgcccccaaatctaatactttatgaggcacgtaagccgtcctgtagggtttctagtcgtcttctcgtcggctacgaagtcgtcggacaaccgacggcccttaccgcgaccctatcctcgtcggccctccgacgtcccgtagaacccgtaggacggtcttagtaatttagttacgttcgaccttgtaccttactaatagttacgactaaggtattaaggttacgtttaacgtttggggtaacggggtttccgggggaccgggggtaacctaacgggtcggtaacccgggttacggtacggtaccgaaccggtaccccggaagggtccctacccggtccccccggttaggttaccctaccgttccgttcccgtttacccccccg

SEQ ID NO: 227839 - DNA, 660 bp, Homo sapiens
  misc_feature: GYAE6OF01D4E1Z.23.21.B10.1.454.CMB.1.raw
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttaggacttttaatatgtctcgtgtaccaactacctccaggaccaaacgacccccaaactcacttacttatagacggacacgtaacgccggcctcgtaggggtttctagtcgtcttctcgtgctacaagtctcggacaacgacgtcctccctgaccatctctcggcctccgacgcctagacgacgagctgtaatttattacttgacttcgactactatagtcgactaagtagttaacggtttaaggtttaccgttttggggtaaccggggtttccgggggaaccggggggtaaccgtaaggggttccggtaaccggttacgggttaacggtacccgaaccgggtacccgtaacgggtcccgttacccgggtccccccggttacggttacccgtacccgttccgtccccggtttccccccg

SEQ ID NO: 227840 - DNA, 703 bp, Homo sapiens
  misc_feature: GYAE6OF01DB8AY.23.21.B10.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaccccgnagtgagttggtttaggtaactttttaatagttcggttcttcggtacggttaacccaacttaccctaccgacggaccaaaaccgaccccctaaacttctaactttactttacgaggacgggtacctaacgtaacggcccggtcccgttaggttacggggtttctacgtcgttccttctcgtcggtcctaccgtagtcgtacggaacctaacgaccggtccctcccgtacgaaccctacttcctcgtccggccccttaccgacgtacccgtacggaacgtacggtacggtcgttaagttaactttattagttccgacttcgtcctataagtactcgactagttatttacggttagttacgtttggacgggttcggggaccgggtaactagggtccgtacggtcggttacgccgacggccctaggcccgtacccggtccccgttagaccgtaccttccgttcccgttacccc

SEQ ID NO: 227841 - DNA, 582 bp, Homo sapiens
  misc_feature: GYAE6OF01CCPVM.23.21.B10.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (401)..(401): a, c, t, g, unknown or other
  misc_feature (401)..(401): n is a, c, g, or t
tcagacgcgagtatcacgaccggtgctcgatttagtgtcgtcgcaagaaagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccncagtgatggttggacttttaantggtctcgtggtaccaatcctccaggcaaacgccccaatcatactttatgaggcactagcgccctcgagggtttcagtcgcttctctggctcaagtctggcaacgacggtcctccctgaaccatctctcggcctcacgcctgacgacgnggctgtattattatgctgctacatatgcaagtactagttagttacgtttggacgggtttccggggacgggggtaaccgtaggggtcgtacccgggtaggttacgggtcaacgggccccgtaagggtccctccggtccccccgttaggtccctacgttccttccggttccccctaacccccg

SEQ ID NO: 227842 - DNA, 631 bp, Homo sapiens
  misc_feature: GYAE6OF01D0M18.23.21.B10.1.454.CMB.1.raw
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatggttggacttttaatatggtctcgtgtaccaatacctccagacaacgccccaatcatacttangaggcacgtagcgcctgagggtttctagtcgcttctctcggctaccgaagtctaggaccaaccgaccggtcccttccctagaccctattcctcgtcggtccctccgagtccgtacgaaccgtacggacggtccttaggtaactttacttagttcgacttcgcttacattacgtcgactaagtagttaagttaacgtttagtttcgggtacggggttaccggggaccggggtaaccgtaagggtcgtaccgggttacggtacggtaccacggtcccgaaggtccctacccggtacccccgtcggtaccctaccgttccgtcccgttacccccg

SEQ ID NO: 227843 - DNA, 540 bp, Homo sapiens
  misc_feature: GYAE6OF01EW6T2.23.21.B10.1.454.CMB.1.raw
  modified_base (231)..(231): a, c, t, g, unknown or other
  misc_feature (231)..(231): n is a, c, g, or t
  modified_base (324)..(324): a, c, t, g, unknown or other
  misc_feature (324)..(324): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggactttttaatatggtctcgtggtaccaatacctccaggcaaacgccccaaactcatactttatgaggcactaagcggcctnaggggtttctagtcgcttctctggctcaagtctggcaacgacggcctccctgaccatctctcggtcctccagcctgacgacggagctagtattattattgctgctcatatgcagatagtagttactttggaggttcgggcggggacgaaggtcgacggtcgtaggtcgacgcccgaaggcctcggtccccctggtacctacgtcctcggtcccccg

SEQ ID NO: 227844 - DNA, 689 bp, Homo sapiens
  misc_feature: GYAE6OF01CGL15.23.21.B10.1.454.CMB.1.raw
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgtctcctgcacgtcggaacccnagtgatggttaggtacttttaatgtggtctcgtgtaccaatcctccagacaacgcccaatctatacttangaggcacgtaacgcgcctcgtagggtttcacgtcgtcttcgtcgtcggtacctacgtaacggttcgtacgggtaccaaaccgtaccggtccccttacccgtaggaaccctagttcccgtccgttccggtaccccttacccgagtccccgtacggaacccggtacggtacggtaccttagtaactttaactttagttccgtactgtaccttacctaagttatcggacctaagttacgttaaggttacgtttaccgtttgggtaacggggtttccggggaaccggggtacgtaacgggtcgtacccggtcgggttaaacggcgaaccggtacccgaacgggtccctcccggtccccgtcgtacctcccgttccgtccgttaccccccg

SEQ ID NO: 227845 - DNA, 702 bp, Homo sapiens
  misc_feature: GYAE6OF01BHLJL.23.21.B10.1.454.CMB.1.raw
  modified_base (311)..(311): a, c, t, g, unknown or other
  misc_feature (311)..(311): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgttctcctgcactggaacccgcagtgatggttggtaacttttaatagttggtctcgtaggtaccaatacctccagacaaacgcccccaaactcaatacttangaggcacgtaacgccgcctgtacgggtttctacgtcgtcttctcgtcggcttaccaagtctaggaccaacgtaccggccctccctgaccctatcctccgtcggccctccgacgtcccgtgaaccggtacgaggccttagtaactttaacttagttcgcttcgtaccttactaattaagtcgtactaaaggttacgttaacggtttaaaggttcgtttttacggggaacggggtttcccggggggaccgggggtaaaccgttaaagggtccgggtaacccggttacggttacggggtaccaaccgggtacccccgaaggggtccccttccccgggtaccccccggttacgggttaccctaaccgtttccccgttccccgggttaaccccccc

SEQ ID NO: 227846 - DNA, 700 bp, Homo sapiens
  misc_feature: GYAE6OF01ETM1V.23.21.B10.1.454.CMB.1.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (358)..(358): a, c, t, g, unknown or other
  misc_feature (358)..(358): n is a, c, g, or t
tcagacgcgagtatcacgaccggtgctcgattttagtgtcgtcgcaagaggtaggaggggggggtcacaagaggcacgcgctctcgggacgtctccaccatggcctgggctctgctgctcctcactctcctcactcaggacacgacgggtcctgggcccagtcctgccctgactcagcctgcctcgtgtcctgggtctcctggacagtcgatcaccgttctcctgcactggaacccnagtgatgttaggacttttaangtgtctcgtcgtaccactcctccgagcaaacgccccaaatcattacttatggtacggctacgtaacgccggtacctcgtagggtttcctacgtcgcttcnctcgctacagtctacggacaaaccgccggtccctacccgtacgtaccctagttcccttcgtccggtccctaccgtacgtccggtcgaacccggacggcggtacttagtaactttactttagttcgctttcgctactagtcgtcgacgtacgtattacggttacgttacgttggaccggggtttacggggacggggtaaaccggtagggttacccggtacccggtttacggtacccgggttacctaaccgggtccccggtaaccgggtacccgttcccccgggttaacccccgttcgggtttaacccctaccccgtttcccgttacccccgggttaccccccg

SEQ ID NO: 227847 - DNA, 607 bp, Homo sapiens
  misc_feature: GYAE6OF01DB1OZ.23.21.B10.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaanatggtctcgtgtaccaatcctccaggcaaacgccccaaatcaatactttangagcacgtaagccggccctgtacggggtttctacgtcgtcttctcgtcggcctacgaagtctggacaacgacggtcctcccgagaacccattcctcgtcgcctccagcctagacgacgaggctagtattagttatgctgctacatactcgacagtacgttaagttagttacgtttggtacgggttcgggaccgggggtaactaacgggtcggtaccggttacggtacggtacgacggtacccggtaacggtcccgttacccggtccccgttacggtaccctaacccgttccgttcccggttcccccg

SEQ ID NO: 227848 - DNA, 531 bp, Homo sapiens
  misc_feature: GYAE6OF01E1PLM.23.21.B10.1.454.CMB.1.raw
  modified_base (345)..(345): a, c, t, g, unknown or other
  misc_feature (345)..(345): n is a, c, g, or t
tcagacgcgagtatcacgaccggtgctcgatttagtgtcgtcgcaagagaggaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaatatggtctcgtggtaccaatacctccaggcaaacgcccccaaactcatactttatgagggcacgtaagcggccctcaggggtttctagtcgcttcnctggctcaagtctggcaacacggcctccctgaccatctctcgcctccagcctgacgacgaggctgattattattgctgctcatatgcagatagtagttactttgaggttcgggcgggggacagggtgaccggtcggtagtcacggcccgaacggcctcgcccccgtggtccacttcctcgttcccc

SEQ ID NO: 227849 - DNA, 557 bp, Homo sapiens
  misc_feature: GYAE6OF01CGNN3.23.21.B10.1.454.CMB.1.raw
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (431)..(431): a, c, t, g, unknown or other
  misc_feature (431)..(431): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgnagtgatggttggtacttttaatatggtctcgtggtaccaatacctccaggcaaacgcccccaaatcatacttangaggcactaagcgcctgagggtttcagtcgtcttctctggcctcaagtctgcaacgaccgccctccngaccntctctcggcctcgacgcctagacgacgagctgattatagttgctgctctatangcagtatagttagtacgtttaggagggttccgggacggggaccgtaaggtcgtaccggttggtacggtaccacggcccgaaggccttccggcccccttaggtcccaccttccgttccgtacccccc

SEQ ID NO: 227850 - DNA, 712 bp, Homo sapiens
  misc_feature: GYAE6OF01CJQQ9.23.21.B10.1.454.CMB.1.raw
  modified_base (133)..(133): a, c, t, g, unknown or other
  misc_feature (133)..(133): n is a, c, g, or t
  modified_base (241)..(241): a, c, t, g, unknown or other
  misc_feature (241)..(241): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (397)..(397): a, c, t, g, unknown or other
  misc_feature (397)..(397): n is a, c, g, or t
tcagacgcgagtatcacgaccggtgctcgatttagtgtcgtcgcaagtagtaggagggggggggtcacaagaggcagcgcgtctcgggacgtctccaccatggcctgggctctgctgtctcctcactctcctnactcaggacacagggtccgtgggcccagtctgccctgactcagcctgcctccgtgtcgtgggtctccgtggacagtcgactccaccgtctcctgcacgtcggaacccncagtgtagttgtaggtaactttaatatggtctacgtgtaaccatacctccagacaacgccccaancatacttangaggcactagcgcctcgtcgggtttctaggtccgtcttcgtctcggcctacgtagtcgtggaccaaccgcggccctccgtanaccctatccctcgtcggtcccttaccgacgtcccgtacggaccggacggtacggcgttagtaatttacgtttacgttgaccgtttcggtaccttacgtagttacgtacggactaaggttaacgtttagggtttaccgtttacggtttacgggtaccggggttccggggaaccggggggtaaccgtaacggggttcggtaaaccggggttacggtaaccgggttaccgtaaccgggtcccggtaaacggtcccggttacccggtaccccccggttacggtaccccgtaccgtttcccgtttcccgttacccccccg

SEQ ID NO: 227851 - DNA, 712 bp, Homo sapiens
  misc_feature: GYAE6OF01BQQKT.23.21.B10.1.454.CMB.1.raw
  modified_base (232)..(232): a, c, t, g, unknown or other
  misc_feature (232)..(232): n is a, c, g, or t
  modified_base (478)..(478): a, c, t, g, unknown or other
  misc_feature (478)..(478): n is a, c, g, or t
  modified_base (508)..(508): a, c, t, g, unknown or other
  misc_feature (508)..(508): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgtctcctgcactggaacccgnaggtgatggttagggtaacttttaagtagttggtctcggtggtacccaataccctcccaggacaaacgcccccaaaactctaatactttagtggacgggacctaacgtaacggccggtccctacgtagggtttcgttacgtacgtcgttcttctcgtcgtcctacgtacgtcgtacgaacgtaccgaccgtccctccgtaccaactcctcgtccgtccgtaccctacgacctcgacgaacgacggngtctagttacttattagtctactcgtcctntatacgtcgaacgtagtaagtacggttaactttacgggttagggttaccgggggtaccgggggaaccgggtaaacggtaaccgggttccggtaaccgggttaacgggttaccggaccgtaacccgggtaaccggtaacggttcccccgtcccccggttacccggtaccggtaccttcccgtttcccggttcccctaaccccccg

SEQ ID NO: 227852 - DNA, 521 bp, Homo sapiens
  misc_feature: GYAE6OF01BGP5A.23.21.B10.1.454.CMB.1.raw
  modified_base (230)..(230): a, c, t, g, unknown or other
  misc_feature (230)..(230): n is a, c, g, or t
  modified_base (357)..(357): a, c, t, g, unknown or other
  misc_feature (357)..(357): n is a, c, g, or t
  modified_base (425)..(425): a, c, t, g, unknown or other
  misc_feature (425)..(425): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttaatatggtctcgtggtaccaatacctccaggacaaacgcccccaaatcatactttatgaggcactaagcgcctgagggtttcagtcgcttctctggctcagtctgcaacncgcctcctgaccatctctcggcctcgacgcctagacgacgaggctgtaattattatgcttgctcatangcagatagtagttattgaggttcgggacgggactaggtcgaccggtgtacggtcaggcccgaagtcgtccgtcccctcgtactcgtctcgtacccc

SEQ ID NO: 227853 - DNA, 785 bp, Homo sapiens
  misc_feature: GYAE6OF01BM6Z0.23.21.B10.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgagggtcctgggcccagtctcgccctgactcagcctgcctccgtgtctggtctcctggacagtcgatcaccgttctctgcacgtcggaacccgnagtgagttggttagggtaacttttaatgttggttctcggtacggtaacctaacttaccctaccgaacggacctaaaaccgaccccctaaaactcctaacttacctttagacggacgggactaacgtaacgccggtacccgttggtacggggttttctacgttcgtacctttcgtcgtcggtacctacccgtaacggtccgtacgacccgtaccgaccgtcccttaccgtactacctcttccgtcgtcccgtcccgtacgtaccgtaccgacggaaccgacggtaccgtatacgttaacgtttacttcgtcgttacgtcctagttactacgttacgtcgtaagtaacggtttaacgttaaggtttaccggtttaggtttacggggtaaccgggggtacgggggtaaacccgggtaacgggttacgggttacccgggttaacgggttaccgggtaccgttaaccgggacccggtaaccccggtcggtaccccggtacccccgttacccgggtcccgttaccggttaccccgttcggttaccccccgttaccccc

SEQ ID NO: 227854 - DNA, 599 bp, Homo sapiens
  misc_feature: GYAE6OF01BYPIX.23.21.B10.1.454.CMB.1.raw
  modified_base (232)..(232): a, c, t, g, unknown or other
  misc_feature (232)..(232): n is a, c, g, or t
  modified_base (305)..(305): a, c, t, g, unknown or other
  misc_feature (305)..(305): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatccaccgtctcctgcactcggaaccccnagtgatggttaggtacttttaatatggtctcgtagtaccaatacctccagacaacgaccccaatcatacttangaggacactaacgcgtcctcgtagggttctacgtcgtcttctcgtcgctacagtctggaccaacgccgtcctcctagaccacttctcgtcgccctcacgtccgtagacgacgngtctagtatttattntgtctcgctctatangctagtagtagtagtttagttaggagggttcgggacgggggtacctaagggttacgaccgggttacggtacggtacccgacggtacccgacggtcccgtacccggtcccccggttacggtaccctacccttccggttcccggtaccccccg

SEQ ID NO: 227855 - DNA, 733 bp, Homo sapiens
  misc_feature: GYAE6OF01E3FOQ.23.21.B10.1.454.CMB.1.raw
  modified_base (233)..(233): a, c, t, g, unknown or other
  misc_feature (233)..(233): n is a, c, g, or t
  modified_base (311)..(311): a, c, t, g, unknown or other
  misc_feature (311)..(311): n is a, c, g, or t
tcagacgcgagtatcacgaccggtgctcgatttagtgtcgtcgcaagagaggagggggggggtcacaagaggcagcgctctcgggacgtcctccaccatggcctgggctctgctgctcctcactctcctcactcaggacacagggtcctgggcccagtctgccctgactcagcctgcctccgtgtctggtctcctggacagtcgatccaccgtctcctgcactcggaacccgnagtgatggttaggtacttttaatatggtctcgtgtaaccaactacctccagacaaccgaccccaaactctatacttangaggcacgtagccgcctgtagggtttctagtcgtcttcctcgtcggcctacgaagttccgtacggaccaaaccgtcccggtccccttacccgtacgtaacccgtacttaccgtccgtccggtccctacccgtaccgtcccgtacggaaccggaccggtaggtccgttagttaactttacgtttaagttcgtaccgttcgtaccttactaattacgtacgtaccgtaagttaacgttagggtttaacgtttaccgttttagggtaaccgggggttaccgggggtaaccgggggtaaccggttacgggtacccgggtaaccggttaccggggttacggtacccggaacggtaccccggtaccggtcccgtaccccggtcccccgttcggtaccctacccgtttcccgtccccggttccccccgg

SEQ ID NO: 227856 - DNA, 563 bp, Homo sapiens
  misc_feature: GYAE6OF01EDZPH.23.21.B10.1.454.CMB.1.raw
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattggttaggtacttttaatatggtctcgtgtaccaatacctccagcaaacgccccaaactcatacttagtgacggcacgtaacgccgaccctgtagggtttctagtcgtcttctctcggctacgaagtctggacaacgccggccctccctgaccatctcgtcgccctccncgcctcgacgacgagctagtattattntgctgctcatngcagtacttagtagttacgttggacgggttcgggcgggtaacgagggtcgaccggttcggtacggtcacggccaacggtctacccgtccccgttggtaccacgttcgtccgttccccc

SEQ ID NO: 227857 - DNA, 747 bp, Homo sapiens
  misc_feature: GYAE6OF01AKL89.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgcagtgagttggtttagggtaactttttaagtagttggtccttacggtacggtaaccctaaacttacccctacccgaaggaccaaaaccgacccccccctaaaactctaatttaccttttagcggaacggtaccaacgtaacggcccggtaccccttacggtacggggttttacctacggttccgtcctttcgtcgtcggccttaccgtaagttccgtagggaccctaaccgtacccggtccccttacccgtacgaccctacttcccgtcgtccgggcccttaccgacgtccctaggaccgacgtacggtctagtatttacttagttcgctgtcctactatagtcgacgtaagtacgttagttacgttaacgtttgggtaacgggttccggggaccgggggtaactacgggttaccggtaccggttaccggtacggtaccgaacccggtcccgtaacgggtcccgtcccggtcccccggttaggtacctacccgttcccgttccggttcccccccg

SEQ ID NO: 227858 - DNA, 557 bp, Homo sapiens
  misc_feature: GYAE6OF01C06WT.23.21.B10.1.454.CMB.1.raw
  modified_base (230)..(230): a, c, t, g, unknown or other
  misc_feature (230)..(230): n is a, c, g, or t
  modified_base (368)..(368): a, c, t, g, unknown or other
  misc_feature (368)..(368): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtctcgtggtaccaatacctccaggcaaacgcccccaaactcatactttatgaggcactaagcggccctcgtaggggtttctagtcgcttctctggctccgaagtctggcaacncggccctccctgaccctatctctggactccagcctgacgacgaggctagatttattattgctgtctctatatgacgagtattagtagttacgtttgtagggttcgggcgggggtaaccaagggtcgtaccggtcggtacggtcacggcccaaggctccgcccccttcggtccacctcgtcgttcccccg

SEQ ID NO: 227859 - DNA, 795 bp, Homo sapiens
  misc_feature: GYAE6OF01DHBE5.23.21.B10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgactccaccgtctcctgcacgtcggaacccnagtgagttggttaggtacttttaatgtcggttctcggttaggtaacctaaacttacccgtcccgaaggaccctaaaaccggaccccccctaaaacttcctaaacgttttaccgttttaagcggggaacggggtacctaaccgttaaacgggcccggtaccccgttacgggttaacgggggttttcctaacggttcccgttcctttcgttccgtcggtccttacccgtaaacggttccgtacgggaacctaaacccggccggtccccttaccccgtacggtaaccctacgttcccgtccgtccggtccctacccgacgtccccgtaggacccggacggacgtcttaggttactttattacgttcgtcttacgtcctactaattcgagtaccagtaacgttagtttacgttacggtttgggtaacggggtttccgggggaaccggggttaactaacggggttacgtacccggttagggttaccggtaccgacgggtccccgtaacgggtccctaccccgggtccccgttacggtaccctcgttcccgtcccggttacccccc

SEQ ID NO: 227860 - DNA, 546 bp, Homo sapiens
  misc_feature: GYAE6OF01D4RDF.23.21.B10.1.454.CMB.1.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (377)..(377): a, c, t, g, unknown or other
  misc_feature (377)..(377): n is a, c, g, or t
  modified_base (435)..(435): a, c, t, g, unknown or other
  misc_feature (435)..(435): n is a, c, g, or t
tcagacgcgagtatcacgaccggtgctcgatttagtgtcgtcgcaaagagaggagggggggggtcacaagaggcagcgctctcgggacgtctccaccatggcctgggctctgctgctcctcactctcctcactcaggacacagggtcctgggcccagtctgccctgactcagcctgccctccgtgtctgggtctcctggacagtcgatcaccgtctcctgcactggaacccgnagtgatgttggacttttaanatggtctcgtgtaccaatacctccaggcaaacgcccccaaatcatacttatgagggcacgtaagccggccctcgtaggggtttctagtcgcttctctggctcaagtctggcaacgcggcctccngaccatctctcggccctccacgcctagacgacgagctgtattattatgctgctcatangacagtatagtagttacttggagggttcgggacggggacaaggtcgaccggttcggtaggtcacggcccgaaggcctccgtccccctcggtacctctccgtccgttccccc

SEQ ID NO: 227861 - DNA, 673 bp, Homo sapiens
  misc_feature: GYAE6OF01CQ8GG.23.21.B10.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
  modified_base (492)..(492): a, c, t, g, unknown or other
  misc_feature (492)..(492): n is a, c, g, or t
tcagacgcgagtatcacgaccggtgctcgatttagtgtcgtcgcaagagaggagggggggtcacaagaggcagcgctctcgggacgtctccaccatggcctgggctctgctgctcctcactctcctcactcaggacacagggtcctgggcccagtcctgccctgactcagcctgcctccgtgtctgggtctcctggacagtcgatcaccgtctcctgcctactggaacccnagtgatgttggacttttaantggtctcgtagtaccaatacctaccgagacaaaccgccccaaatctaactactttangaggtcacgtaagcgacccttgtacgggtttctagtcgtcttcgtactggctaccgaagttcctagggacctaacgaccggtcccttacccgtagaaccctacttcccgtcgttccggacccttccgacggtccgtacggaacggaccggtagtccgtagtaatttacgtttagttacgtcgtntacgttctaattacgtcgactaacggtatttaaggtacgtttaccgtttgggtaaaccggggttcgggaacgggggtaaccgtaaagggttcggaaccggttcgggtaacggttaccgaacggcccgtaaggtcccgtaccggtccccgttcggtacctacgttcccgtaccggttacccc

SEQ ID NO: 227862 - DNA, 825 bp, Homo sapiens
  misc_feature: GYAE6OF01BZQS1.23.21.B10.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccgtctctgcactcggaacccnagtgagtgttggtaacttttatatggtctgtagtacaatacctccagacaacgccccaaatcattacttatgaggacacgtaagccgtcctgtacgggttctacgtcgtccttctcgtcggcctacgtaagtccgtacggacctaaccggccggtccccttaccctacggaaccctagttccgtaccgtcggtcccctacccgtacgtacccgtacggaacccgggtaacggtacgggtacttaacggttaatttaacgttttacggttccggtaccgtttacggtaccctttaacgtaagtttacgttacggtaaccgtaaggttaacgtttaaacgggttttaacggtttaccgttttaacgggggttaaccggggggttacccggggggtaacccgggggggtaaaccgttaacggggggtttaacccggtaacccggggtttaacccggggttaacgggttacccccggaacgggttacccccgggaaacgggttcccccggtttaacccccggggtaccccccccgtttacgggtaacccccttacccgggttttacccccggttccccgggtttaacccccccccgg

SEQ ID NO: 227863 - DNA, 589 bp, Homo sapiens
  misc_feature: GYAE6OF01C3IG5.23.21.B10.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggacttttaatatggtctcgtggtaccaataccctccaggacaaacgcccccaaactcaatactttatgaggcactaagccgcctgagggttctagtcgcttctctggcctaccgaagtcgtggacaacgacggccctccctgaccatctcgtcggccctcagtccctgaccgacggagtctagtaattattattgcttgctcatatgactaagattagtagtttacgttagggtaggttcggggacgggggtaacctaagggtcgtacccggttcggtaggtaccacggaccccgaagggtccctccggtcccccctagggtacccacttccgtccgttccccccgg

SEQ ID NO: 227864 - DNA, 747 bp, Homo sapiens
  misc_feature: GYAE6OF01CYB1Q.23.21.B10.1.454.CMB.1.raw
  modified_base (236)..(236): a, c, t, g, unknown or other
  misc_feature (236)..(236): n is a, c, g, or t
  modified_base (321)..(321): a, c, t, g, unknown or other
  misc_feature (321)..(321): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgagggtcctgggcccagtctgccctgactcagcctgccctcgtgtcgtgggtctccgtggacagtcgatccaccgtctcctgcacgtcggaacccgntagtgagttggttagggtaacttttaagtatggtctcgtggtaaccaatcctccaggacaaaccgccccaaatcaatactttagngacggacaacgtaaggccgtcctagtacgggtttctacggtctacttctcgtggtacctccgtaagtctaggacctaaccgaccggtccctacccgtgaacccctacgttcctccggtccgtcccgtaccgacgtacccgtacggaaccggaacgtaccggtctacggtatttacgttagttacggcttcgaccttaagtagttaacgacggtaccgtaaaggtaggttaaggtttaacggttttaacggttacggggttaacggggttacccgggggtaaccgggggtaaaccggtaaacggggttaccgggtaacccgggttacggtacgggttaccgaaccggtacccggtaaaccgggtccccgtacccggtccccccgttacggttacccctaccgttccccgtacccggtttaccccccg

SEQ ID NO: 227865 - DNA, 790 bp, Homo sapiens
  misc_feature: GYAE6OF01CY7TU.23.21.B10.1.454.CMB.1.raw
  modified_base (237)..(237): a, c, t, g, unknown or other
  misc_feature (237)..(237): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctcgggcccagtctcgccctgactcagcctgcctccgtgtcgtgggtcctcgtggacagtcgatccaccgtctcctgcactcggaacccgnagtgagtggttgggtaacttttaatatgtatcgtcggtagtaacctaactacctaccgaggaccaaaccgacccccaaaactctaactttaactttagtgacggcctaagtacggaccggtcccgtggtacgggtttctacggtccgtctttccgtcgtcggtaccttaccgaaagtttcgaaccggtaccaaccggaccggtccccttccccgtaacgaccctacttcccgtccgtaccgggtcccttacccgaccgtacccgtacggaacccggtaaccggtaacgggtacttaacggttaactttttaacgtttagttaccggtaccgttcgtaacccttactaacgttaacggtaccgtaacgtaacgtaaagtttacggttaacgtttacggtttaacggggtacgggggttacccggggaccgggggttaaacgtaaccggggtacggttaaccgggtacggttaaccgggtacgacccggtaacccggtaacggtccgttaccccggtcccggttacccggtacccgtccgttaccgttcccccgg

SEQ ID NO: 227866 - DNA, 699 bp, Homo sapiens
  misc_feature: GYAE6OF01CRGOT.23.21.B10.1.454.CMB.1.raw
  modified_base (315)..(315): a, c, t, g, unknown or other
  misc_feature (315)..(315): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccgtctcctgcactcggaacccgcagtgattggttgggtacttttaatagtggtctcgtggtaccaataccctccaggacaaacgcccccaaactcattactttanggaggcacgtaacgccggccctcggtagggtttcagtcgtcttctctggcctacaagtcgtcggaccacgaccggtccctccctagacccactcctccgtcggccccttaccgacgtcccgtagaaccggacggacggtacttagtaactttattacgttgtacctcgtaccttactaacttagtcgtacgtaagtagtttaacggttaagtttaccggttttagggtaccggggtttacgggaaccgggggggtaaccctaagggggtacccgtaccggggttacggttacgggtaccgtaacccggccccgtaacgggtcccgtacccggtacccccccggttacggtcccgtacccttcccgttacccggtttaccccccc

SEQ ID NO: 227867 - DNA, 748 bp, Homo sapiens
  misc_feature: GYAE6OF01CIQ4Z.23.21.B10.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactcggaacccgnagtgatggttggtacttttatatggtctcgtgtaccaatacctccgagacaaacgcccccaaactctacttactttatggacggacacgtaacggccggcccgttacgtacgggggtttctacggttccgtcttcgtcgttcggtccttaccgtaaagttccgttacggacctaaacccgacccggtcccctacccgtacgtaacccctactttccctccgttccgggtccctacccgtacgtcccgtacggaaccgggtacggaacggttcgttagtaattttacgtttacgttcgcttacgtccttacgtagttacgtcggacgtaagttaacgttaaggtttacgttaccgttttagggtacgggggtttaccggggaccgggggtaaccgtaagggtaccggtaccgggttaccgggtacggtaccgacccgggtaacccggtaacggtccccgttaccccgggtacccccgttacggtaccgttacccgtttccggttcccgttccccccgg

SEQ ID NO: 227868 - DNA, 596 bp, Homo sapiens
  misc_feature: GYAE6OF01DHC6Y.23.21.B10.1.454.CMB.1.raw
  modified_base (232)..(232): a, c, t, g, unknown or other
  misc_feature (232)..(232): n is a, c, g, or t
  modified_base (421)..(421): a, c, t, g, unknown or other
  misc_feature (421)..(421): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgcccctgactcagcctgcctccgtgtctgggtctcctggacagtcgatcaccgtctcctgcactcggaacccncagtgatggttgggtactttaatatggtctcgtggtaccaatacctccaggaccaaagcccccaaatcatacttatgaggcacgtaacgcggcctcgtaggggtttctagtcgtcttctactggcctccgtaaagtccgttcggacaaccgaccggtccctaccctcgacctactctctcggcctaccncgcctgaccgaggaggctcgtaatttattacttgacctgctcatatcgactagacttagtagttactttgggacggttcgggacgggggacctaagggtcgtaacggtcggtaacgtccgtaggacccgaaggtccgtacccgccccttacggcacgttccgtccgttcccccgg

SEQ ID NO: 227869 - DNA, 689 bp, Homo sapiens
  misc_feature: GYAE6OF01CYW37.23.21.B10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacacgggtcctgggcccagtctcgccctgactcagcctgcctccgtgtcgtgggtcctccgtggacagtcgatcaccgtctcctgcacgtcggaaccgnagtcgtagtggttggtaacttttaatattcggtctcggttggtaacctaactacctaccgaggtacaaaacgccccctaaaactctaattaactttagcgacgggacaacgtaacgcggtcctcgtaagggtttctagtcgtacttctcgtcggctaccgaagttccgtaggacaaccgtccggtaccctccgtcgaccctactctcgtcgtccctaccgcgtaccgtagaaccgacggtacgctagttacgtttattacttcgtacgtgtaccgttatattaacgtcgaacgtagtaaattacgttaacggtttacgtttcgggtacggggtttcggggaacggggggtacctaagggtcgggtaaccggtcgggtaacggtcgtaccggaccgtaacggtccgttcccgtccccgttacggtccctacgttcccgttcccggttacccccg

SEQ ID NO: 227870 - DNA, 950 bp, Homo sapiens
  misc_feature: GYAE6OF01DFJ5W.23.21.B10.1.454.CMB.1.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctcgccctgactcacgcctcgcctccgtgtcgtgggtcctctggacnggtcgatcaccgtctcctgcacgtaccggaaccncgagtgagttcggttaggtacttttaangttcggtcttacggtacgtaaccctaactaccctccgaaggaaccaaaaccgtaccccctaaaacttctaacgttaccttttaagacgggaacggtacgtaaacgttaaccggcccggtacccgttacgggttaagggttttaccgtacgttccgtcctttaccgtcggtccggtaccctacggtaacggttccgtacgggaaaccaacccgtaccggtccccttacccgtacgtaaccccttaacgtccccgttcggtaccccgggtaccccttaccgaccggtaccccggttaacggaaccgggtaccgggtaacggtccgttaaggtttaaacgtttttaacttacggtttcggtaaccgttcggttaaccgtttaactaaccggtttagttaacggtaacttaaacgggttaacgtttaacgggttttaaccggggttttaaccggttttaacgggggttaaccggggggttacccggggggttaaacccgggggggttaaacgtaaaccgggggttacccgggttaaccggggtttaaccgggttaaccggggtttaccccggaaaaccccggggtcccggtacccgggggttaccccgtaacccccggttccccccggggtttaacgttaaaccccggttcccttttaccccgggtaccccccggttttaaccccccg

SEQ ID NO: 227871 - DNA, 805 bp, Homo sapiens
  misc_feature: GYAE6OF01C7G9B.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctcgggcccagtctcgccctgactcagcctgcctccgtgtcgtgggtcctccgtggaccagtcgatcctaccgtctcctgccacgtcggaacccgcgtagtgagttgggttacggtaactttttaagtagttggttccgttcggtacggtaacctaacgttaccctaccgaaggaccaaacccgaccccctaaactacctaacgttacctttagtaggacggacctaacgtaacggcccggtacccgttacggttacgggtttcctacggtccgtccttacgtccgtacgtcctaccgtaacgttccgtacggaccaaaccgtacccggtccctcccgtacgaacccttacgttccgttaccgttacccggtccctacccgtaccggtcccgtaccgggtaaacccgtaccgggtacggtacccgttaggttaaacttttacgtttacgttacgtccgttcgtacgttactaacgttgtacgacgtaagtagttaacggttacgtttacgttacgggtacggggttaccggggaccgggggtaaccgtaaggtacccgggtacggtacggttaacggtaccggacggtcccgaaccgggtcccgtaccccggtccccggttaccgtaccggtacccttcccggttcccggttccccccg

SEQ ID NO: 227872 - DNA, 659 bp, Homo sapiens
  misc_feature: GYAE6OF01CK2O9.23.21.B10.1.454.CMB.1.raw
  modified_base (128)..(128): a, c, t, g, unknown or other
  misc_feature (128)..(128): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (475)..(475): a, c, t, g, unknown or other
  misc_feature (475)..(475): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctnactcaggacacagggtcctgggcccagtctgccctgactcagcctgcccttccgtgtcgtgggtctccgtaggacagtcgatccaccgtctccngcacgtacggaacccgnagtgagttggttaggtacttttaaatgtgtctcgtagtaccaatcccaccaggacaaaccgccccaaatcattacttngagcaacgtagccgtacctgtagggttctagtcgtcttctcgcgtcctacgaagtcgtcggacaccgtaccgtccctaccgcgtaactactccgttcgtccggtaccctaccgacgccgtaggaaccggacgacggtctagttaatttaacgtttcgngttcctagcttaccgtattacgtcgaactaggttaacgttacggttacgtttacttgggggtacgggttcgggaacggggtaccgtagggtaccgtaccggttggtacggaccacccggtacccggacgggtcccttacccgggccccgttaggttaccctaccgtccgttccccgtaaccccc

SEQ ID NO: 227873 - DNA, 794 bp, Homo sapiens
  misc_feature: GYAE6OF01CTDND.23.21.B10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtcgtgggtcctccgtggacagtcgatccaccgtctcctgcacgtcggaacccnagtgagttggttgggtaacttttaatagttcggtcgttcgtacggtaacctaactacctccgacggaccaaaaccgaccccctaaactctaacttaactttagcggacggaccaacgtaacggccggtccgttacgtacggggttttactacggttccgtactttcgtcgtcggtcctaccgtaaggtcgtacggactaaccggtaccggtccctcccgtacgaccctcttccgtcgtcgtaccctccgacgtcccgtacggaacggacggtacgtcgttagtacttttattacgttcgtacgtcgtcttaacgtaacgttacgtcgtaacgtaaggttaacgtttaaacgggtttacgttttaaccgggtttaggggtaccgggggtttaccggggggaaccggggggttaacctaaacggggggttaccggtaccgggtttacggggttaaaccggtccggtaaacccgggtacccggtaccggggtaccccgttaccccgggtcccccggtttacggtcccgttaacccgtttcccgttacccccggttaccccc

SEQ ID NO: 227874 - DNA, 817 bp, Homo sapiens
  misc_feature: GYAE6OF01CHCKB.23.21.B10.1.454.CMB.1.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
tcagacgcgagtatcacgaccggtgctcgatttagtgtcgtcgcaagagggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgnagtgattggttagggtacttttaantggtctcgtgtaccaatacctccaggcaaacgccccaaatcatacttangaggcactagccgacctgtagggtttctagtcgtcttctctcggctaccgaagtcgtacggaccaaacgccggtccctccccgtagaccctattcccgttcgtccggtcccctccgaaccgtcccgtacggaccggacggacggtcttagttaactttagtttacgttcgtaccgttcgtaccttaccgtaatttacgtaccggtaacctaagggttaacgtttaacggtttaaccgggttttaacgtttttacggggggtaaccggggggtttttacccgggggggacccgggggggttaaaaccccgttaagggggtttacccgggtaaaccccggggtttacggggttaaccgggttacccggtaaacccgggtaacccccgggttaaacggggtaccccccggttacccccgggttcccccccccggtttaacggggtttacccccttaaacccccggttttcccggttttaccccccgtttaaccccccccgttacccccccgg

SEQ ID NO: 227875 - DNA, 686 bp, Homo sapiens
  misc_feature: GYAE6OF01EF54S.23.21.B10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcacgtcggaacccgnagtgattggttgggtaacttttaatagtggtctcgtcggtaaccaataccctccaggacaaaaccgccccaaactcaattactttatggacggtacaacgtaacggccggtaccctagtacggggtttactacggtcgtactttctcgtcggtctaccaagttcgtggtacaaaccgtaccgggccctacccgtacgaaccctactcccgtcgtccgggtcccttacccggacgttccccgtagaacccggtacggacggtaccttagtaacttttaattacgttgtacttcgctactaatacgtcgaacaggttaaattaggttacttacggtttgggacgggttcggggacccggggtaactaggggtcgacggtttcgggtacgttacgaccggtacccgaagtccgtcccgtcccccggttacgccgtaccttccgtcggtcccccg

SEQ ID NO: 227876 - DNA, 785 bp, Homo sapiens
  misc_feature: GYAE6OF01AG9H3.23.21.B10.1.454.CMB.1.raw
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
tcagacgcgagtatcacgaccggtgctcgatttagtgtcgtcgcaagagaggagggggggggtaacaagaggcagcgctctcgggacgtctccaccatggcctgggctctgctgctcctcactctcctcactcgaggacacgagggtcctgggcccagtctgccctgactcagcctgcctcgtgtctgggtctcctggacagtcgatcacccgtctcctagccacgtcggaacccnagtgattggttggtaacttttaantgtcgtcgtgtaccaatacctccgagaccaaacgaccccaaatctactactttagtcgacggactaacggtaacggtccggtccccttaggtaacggggttttcctacggttccgtccgttcgtcgtcggtcctaccgtaacgttcgtcggaacctaacccgacccggtcccttaccccgtagtaaccctacgttccgtccgtaccgggtcccctacccgacggttaccgtaccggaacggaacccggtaggtaccttaggttaaactttacgttacgttcgtaccgtccgtacttacgtaagttacgtacgtaacgtaacgttaacggttaacggtttacggttttaacgggtttacggggtacgggggtttacccgggggaaccggggggtaaccggttaacggtccggggtaacccggttaacgggttacggtcccggaacggtacccgggtccggtaaccgttccccgtacccccggttcggtacccttacgtttccccgtcccggtttccccaacccccg

SEQ ID NO: 227877 - DNA, 1107 bp, Homo sapiens
  misc_feature: GYAE6OF01EHXG0.23.21.B10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgactcagcctgcctccgtgtcgtggtctcgtggacagtcgactcaccgtctcctgcacgtacggaacccncgagtgtagttggtttacgggttaactttttaagtagttcgggttccttaccggttacggtaaaccctaaacgttaccccgttacccgaacgggaacccaaaacccggtaccccccctaaaacttcctaaacttttaaccgttttaacggtacgggtaaccggggtaacctaaacccggttaaaccgggcccgggttacccccgtttacgggtttaaccgggggttttttaccgtaacgggtttcccggttccttttccggtaccggttaccgggtaccccgtttaacccggtaaacgggtttcccggtacgggtaaccccgtaaaacccgggtaccccgggtccccctttaccccggtaaccgtaaccccgtactttcccgttaccggttaccccgggtaccccttacccggaacccggttccgtaaccgggtaacccgggtaaccggtaacgggttccgttaagggttttaactttacgttttaaccggttccggtacccgtttcggtacccgtttaacgttaattaccggttacggaaccctttaagggttaaacgttttaacgggttttaaccgggtttttaaccgggttttacgggggttaacccgggggggtttacccggggggggtaaccgggggggttaaaccccgttaaaccggggggttacccggggttaaaccccgggggtttaaccggggtttaacggggtaaccccccgggttaaacccgggtaccccccgggttaaaaccggggtttcccccgggttaaccccccggggtttacccccccccgggtttacgggttaacccccggtttaacccccggtttttccccgggttaccccccgggtttaaccccccccccgg

SEQ ID NO: 227878 - DNA, 623 bp, Homo sapiens
  misc_feature: GYAE6OF01DTYPS.23.21.B10.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggacttttaatagtggtctcgtgtaccaatacctccaggacaaacgccccaaatcatactttangacggcacgtaagccgcctagagggtttctagtccgcttctcgtcggctaccgaagtctagggaccaaccgcggtacccttcccacggaccctagttcctacgtcggaccctccacgtccctaggaccgacgagtcgtagtaactttattagttcgacttcgtacctcgtaattcgtagtcaagtacttaggttacgttacgtttggtacggggttcgggaccgggggtaactaaggggtccgtaacggtcgggtacggtcgacgccggtaacgccgtcccgcccccgttggtaccctccttcgttccgtaccccccg

SEQ ID NO: 227879 - DNA, 832 bp, Homo sapiens
  misc_feature: GYAE6OF01DZZDC.23.21.B10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgaggtcctgggcccagttctgccctgactcagcctgcctccgtgtctgggtctccgtggacagtcgatcaccgtctcctgcctacgtcggacccgnacgtgtagttggttacggtacttttaagtagttggttccttcggttacggtaaccctaaccttacccgttcccgaagggacccaaaaccggaccccccaaactttctaactttaccgttttagtacgggaacggtacctaacgtaaccggtccgggtacccgttacgggttacgggtttacctacggtccgttccgtttccgtcgtcggtcctaaccgaaagttccgtacggaccaaaccgtcccggtccctacccgtacgaccctaacttccgtaccgtccggtaccctacccgacgtacccgtgaaacccggtacgtacggtcttaaggtacttttagttacgttccgacgttcggtccctagtactagtacgaaccggtaagttaacgttaacgtttcggtttaacggtttacggggtaccggggttaccggggggtaaccggggtaaaccgtaggggttcccggttaaacccggggttacggttaccgggttaacccgaacccgggtaaccgttaaacggggttcccccgtccccggttaaccccggttcggttaccccgaaccgttttccggttccccccgttaccccccgg

SEQ ID NO: 227880 - DNA, 583 bp, Homo sapiens
  misc_feature: GYAE6OF01CMUQJ.23.21.B10.1.454.CMB.1.raw
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
  modified_base (460)..(460): a, c, t, g, unknown or other
  misc_feature (460)..(460): n is a, c, g, or t
  modified_base (547)..(547): a, c, t, g, unknown or other
  misc_feature (547)..(547): n is a, c, g, or t
tcagacgcgagtatcacgaccggtgctcgatttagtgtcgtcgcaagagaggagggggggggtcacaagaggcagcgctctcgggacgtctccgaccatggcctgggctctgctgctcctcactctcctcactcaggacacagggtcctgggcccagtctgccctgactcagcctgcctccgtgtctgggtctcctggacagtcgatcaccgtctcctgcacgtggaacccgtnagtgagtggttgggtacttttaatatggtactcgtggtaaccaatacctccaggacaaacgccccaaatcatacttagngaggcaactaagccgccctacgtagggtttctagtcgtcttctcgtggcctacgaagtctaggacaaccgacggccctcctgaaccagttctcgtcggccctcgacgccgtacgacgacgtagctagtatttattattgactcgctnatatgaacagtatagttagttacgtttggacgggttcgggacggggtactagggtcgaccggtggtagtcgaacgccgaaggtcccnccggtcccctacgtactcctcgttccgttacccccg

SEQ ID NO: 227881 - DNA, 703 bp, Homo sapiens
  misc_feature: GYAE6OF01BU0IB.23.21.B10.1.454.CMB.1.raw
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccgtctcctgcacgtcggaacccgnagtnagttggttacggtaacttttaatacgttcggtcttcggtacgtaaccaacgttaccctaccaggaccaaaccgaccccctaaatctaactactttagcggtacggctaacgtaacgccgcctgtacgggtttctacgtcgtcttctcgtcggcctacgaacgtcgtacggaccgtaaaccgtacggtccccttaccgtacggaacccttaacgtccttccgtaccggtaccctcccgacgtccgttacgggaacccgacggtaacggtccgtaagttactttaagtttacgtcgtaccttgaccttagtaatatcggactaagttaacgttacgtaacggtttacgtttcgggaacgggttcggggaaccgggtaacgtaacggtcggtaaccggtggtaacggtacgacgacccggtaacgcccgtccgtcccgtcggttaccaccgttctcccgttaacccc

SEQ ID NO: 227882 - DNA, 731 bp, Homo sapiens
  misc_feature: GYAE6OF01CRA8V.23.21.B10.1.454.CMB.1.raw
  modified_base (129)..(129): a, c, t, g, unknown or other
  misc_feature (129)..(129): n is a, c, g, or t
  modified_base (241)..(241): a, c, t, g, unknown or other
  misc_feature (241)..(241): n is a, c, g, or t
  modified_base (353)..(353): a, c, t, g, unknown or other
  misc_feature (353)..(353): n is a, c, g, or t
  modified_base (458)..(458): a, c, t, g, unknown or other
  misc_feature (458)..(458): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctnactcgaggacacgagggtcctgggcccagtcctgccctgactcagcctgcctcgtgtcgtggtctcctaggacagtcgacttcacccgtctcctgaccactcgggaacccgnaagtgattggttagggtaactttttaatgtcgggtctacggttacggtaaccaaacttacccgtaccgaaggacaaaacccgacccccaaaattacctaagttaactttagnggacggactacgtaacgccgtcctagtacgggttctagtcgtacttcgtcgtacggcttaaccgagtcgtggaaccaccgtaccggtcccctacctagaaccctnttccgtccgtccggtccctaccgtaccggcccgttaacggacccggaacggtacggtaccgttagttaaacgtttaacgtttagtcgtacgttcgaccttactaagttactacggtactaaggttacgttaagttacggtttagttcgggtacgggttacggggaccggggtaacgtaacgggtccggtacggtcggtacggtaccgacggtacccgtaacgtcccgacccggtccccgttagtacccgtaccttccggtccccgttaccccg

SEQ ID NO: 227883 - DNA, 626 bp, Homo sapiens
  misc_feature: GYAE6OF01DZBNI.23.21.B10.1.454.CMB.1.raw
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
tcagacgcgagtatcacgaccggtgctcgatttagtgtcgtcgcaagagaggagggggggggtcacaagaggcagcgctctcgggacgtctccaccatggcttgggctctgctgctcctcactctcctcactcaggacacagggtcctgggcccagtctgccctgactcagcctgcctccgtgtctgggtctcctggacagtcgatcaccgtctcctgcactcggaacccnagtnagttggttggacttttaatatggtctcgtggtaccaatcctccaggacaaacgcccccaaatcattactttancgaggcacgtaagcgccctcgtagggtttctagtcgcttctcgtgctcaagtctgcacncgcctccngacatctctcggccctcacgcctagaccgaggacggtccttagtaactttattaactttcgtactcgtccttnaattagtanacaagtagttagttaagtttaccgtttagggtacgggttcgggggaaccggggtacctaaggggtccggtaacggttaccggttacggtccgtaacggccccgtaaagggtcccctacccggtaccccccggttcggtaccctaaccgttccgttcccggttccccccg

SEQ ID NO: 227884 - DNA, 891 bp, Homo sapiens
  misc_feature: GYAE6OF01E56D1.23.21.B10.1.454.CMB.1.raw
  modified_base (253)..(253): a, c, t, g, unknown or other
  misc_feature (253)..(253): n is a, c, g, or t
tcagacgcgagtatcacgaccggtgctcgatttagtgtcgtcgcaagaggaggagggggggggtcacaagaggcagcgctcgtcgggacgtctccaccatggcctgggctctgctgctcctcactctcctcactcaggacacgacgggtccgtcgggcccagtcctcgccctgactcacgcctcgcctccgtgtcgtcgggtctccgtggacagtcgactcctaccgtcctcctcgccacgtacggaacccgngtagtgtagtttaggtttaggttaacttttaagtacggttcggttaccgttaccggttaaccggtaaaccctaaccttaccccgtacccggaaaccggaacctaaaaccccgaacccctaaaacttacgtaacgtttaacggttaagacgggaccggtaacctaaccggtaccggtcccggtcccgttagggttacggtttcctacggttccttccttccgtcggtaccggtacctacgtaacggtcgtaaccgacccgacccgtacccgtcccttaccgtactaaccgtctccgtaccggtccctaccgtacccgtacggtccgtaacggtaaccggtacgtagtttacgtagtttaacttcgttacgtcgtcctacgttacctaagtacgtacggtaacgtaacggtaaaggtttaccggttttaacggggtttaaccgggtttacgggggtttaccggggttaacggggggtacccgggggggtaacgggttaaaccggtaccggggttccgggtaacccgggttaacggaccggttacccgaaccccggtacccgggttacccgccccggtttaccccccggtaccggtttacccgtaccccgtcccgttttaccccgtcccccgttaaccccg

SEQ ID NO: 227885 - DNA, 708 bp, Homo sapiens
  misc_feature: GYAE6OF01DTNU2.23.21.B10.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagacgcgagtatcacgaccggtgctcgatttagtgtcgtcgcaagagaggaggggggggtcacaagaggcagcgctctcgggactctccaccatggcctgggctctgctgctcctcactctcctcactcaggacacagggtcctgggcccagtctgccctgactcagcctgccttccgtgtctgggtctcctggacngtcgatcaccgtctcctgcactcggacccnagtgatggttggacttttaatatgtctcgtggtaccaatcctccagcaaacgccccaaactcaattaccttatggaggcacgtaagccggtcctgtaagggtttcacgttccgtcttctcgtcggctccaagtctcggacaaaccgtccggccctccgtgaccattcctcgtcggcccttccacgtccgtcggacgacgtaggactggttaactttagtttagttcgtccgttacgtacccttgttaaccttaggttcgaaccgtaagttacggttaacgttaacggttttaacgttttagggtaccggggggttttacccggggaccggggggttaaacctaaaggggttccgggttaaccccgggttacgggttaaccgggtcggtaaacccggtaccccggaaacgggttcccctacccgggttcccccccgttaagggtccccgttaaccttcccgttacccggttaaccccccc

SEQ ID NO: 227886 - DNA, 666 bp, Homo sapiens
  misc_feature: GYAE6OF01C9PE7.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttagggtacttttaatatggtctcgtgtaccaatacctccagacaaacgaccccaactctactacttatgaggcacgtagcgcctcgtagggtttctagtcgtcttctcgtcggtcctccgtaagtcgtggaccaacgaccggtccctcctagaccctattcctcgtcggccctaccgacgtccgtacggaccgacggacggtacttagtaacgttttatttacgtttcgtccgttcgtcttactattaacgttcgactaaggtaattaggttacgtttacgtttagggtacggggttccggggaaccggggggtaccgtaaggggtccggtaccgggttacggtacgggtacgaaccggtcccggaaacgggtccgtacccggtccccgttaccggtcctaccgttcccgttccgttaccccccg

SEQ ID NO: 227887 - DNA, 778 bp, Homo sapiens
  misc_feature: GYAE6OF01EEJUB.23.21.B10.1.454.CMB.1.raw
  modified_base (555)..(555): a, c, t, g, unknown or other
  misc_feature (555)..(555): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgtagttggtttagggtaactttttaatagttggtccttcggttacggtaaccaacttaccctacccgaggaccaaaccgaccccccaaacttctaatttactttacgtaggtaacgggactaacgtaacggccggtacccttaggttacggggttttactacggttcgtcctttcgtccgtcggcctaccgtaagttcccgtagggacccaaccgtaccggtccccttacccgtacgtacctacttccgtccgtcggtcccctaccgtacgtcccgtagaaccgggtacgacggtacgttagtaatttatttacgttcnccgtacgttaccttctaatcgtagaaccgtaaggttaacgttaagttaccggtttacgtttacggggtaacggggtttccggggaaccgggggtaacggtaacgggttccgggtaaccggttagggtaccggtacgtaccggtaaccccggtaacgggtcccgttccccgggtacccccgtaccgggtttcccacccgtttccgttccccgttaacccccccg

SEQ ID NO: 227888 - DNA, 835 bp, Homo sapiens
  misc_feature: GYAE6OF01B36AR.23.21.B10.1.454.CMB.1.raw
  modified_base (236)..(236): a, c, t, g, unknown or other
  misc_feature (236)..(236): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatccaccgtctcctgcctacgtcggaacccgnagtgagttggttagggtaactttttaatagttggttccgttcggttacggtaaccctaaacgttaccccttcccgaagggtacccaaaacccggacccccccctaaaaacttacccgtaaacttttaaccgttttaacgtacgggtaacggggtaaccctaaacccggttaaacgggtccccggtaccccgttacgggttaaccgggggtttttaccttaacggtccggttcccttttcgttccgttacgggtacccttaccgtaaacggttccggtaccggtacccaaaacccgtcccggtccccttaccccgttagaacccctacttccgttcgtccggtccctccgacgccgtacgaccggtaacgtacggtcttagtacgtttatttacgttacgcgttcgtccttacgtattacgtcgtacgtaaagttacgttaggtttaacggtttacggtttagggtaccgggggttaccggggaacggggtaaccgttacgggtccggttaaccggtacggttacggaccgtacggcccgggtaacgtcctccccgggtaccccgtcggtaaccctccgttccgttcccggttacccccg

SEQ ID NO: 227889 - DNA, 1044 bp, Homo sapiens
  misc_feature: GYAE6OF01CVJRV.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctcgggcccagtctcgccctgactcacgcctcgctccgtgtcgtggtctccgtggacagtcgatccaccgtctccgtgacctacgtaccggaaccccgacgtggttagtacgtttgggtttacggggtttaaactttttttaaaagttacggtttcggttaccgtttaccgggtttaaccgggttaaaacccctaaaaccgttttaaccccccgtaacccgtaacggggaaaaccccctaaaaaccccggtaacccccccttaaaaaccttaccttaaaaccgttttaaacctttttaggtaacggggaccggtaaccctaaacccggttaaacgggtcccggtaacccccggtttaccgggtttaacgggggttttacccttaaccgggttccgtttcccgtttccgttacgggttaccggtaaccgtttacccgtaaaacgggttccgttaccgggaaccccttaaaccggaaccccggttccccttaccccggtacgtaaaccccttacgttccccgtaccgtcccgggtacccctacccggtacgtaccggttaccggaaccggtaacggtaccgtacggttaacgttaacgttttaacgtttaccgttccgtaccggttccttaaccgtttaacccgaagttttaccgtacggtaacgtttaaacgttaagggttttaagttttaaccgggttttaacgggtttacggggttaaccggggggttaccgggggaaccggggggttaaaccggttaaacgggttcccggggttaaaccgggttccggtaacgggttacccgaacccgggtaccgtaacccggggtccccgtaccccgggttcccccgttaccggttaccctttcccggttccccggttccccggtttcccccccg

SEQ ID NO: 227890 - DNA, 637 bp, Homo sapiens
  misc_feature: GYAE6OF01D9FB8.23.21.B10.1.454.CMB.1.raw
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgattggtggtacttttaatntggtctcgtgtaccaatacctccaggcaaacgccccaatcatacttangaggcactagccgcctgagggttcagtcgtcttcnctcgctcaagtctgacaacgcgcctccagaccatcctcgtcggcctcgacgtcgtacgacgacgtacgctagtaatttacgttagttcgccttagtactactaattgtacgtaccgtaagtaacgtttaaggttaacgtttacggtttagggtacggggtttaccggggaccgggggtaacctaacgggttccggtacccgggttacggttacgggtacccaaccgggtacccgaaacggtcccgtacccggtaccccccgttacggtaccctaccgttcccgttccgttacccccccg

SEQ ID NO: 227891 - DNA, 790 bp, Homo sapiens
  misc_feature: GYAE6OF01DPQ1Q.23.21.B10.1.454.CMB.1.raw
  modified_base (255)..(255): a, c, t, g, unknown or other
  misc_feature (255)..(255): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacgggtcctcgggcccagtctcgccctgactcacgcctcgccttccgtgtcgtcgggtcctccgtaggacagtcgactccaccgtcctccgtcgacctacgtaccggaacccgngtaggtgtagttggttacggttaacttttaagcgttcggtcgttacggtaacgtaaccaaacttcccgtaccgaacggaacctaaaccgaccccctaaatctaatttacttagacggacggactaacgtaacggcccggtaccgttacgggtaacgggtttctacggttccgtcttacgtcgtacggtacctaacgtaacggtctacggaacctaacccggtccggtccctacccgacgtacctacgttccgtaccgtaccgtccctaccgacgtaccggtacgaaaccggtaacggcgtaacgtttaacgtaattttaacgttcggtacctcgtacgtaccttacgtaagttacgtacgtacggtaaacgttacgtttaaaggttacgtttacgggtttacggggtaacggggtaccgggggtaaccgggtaaacgttcggtaaccgggtacggtacgggtacgtacggaccgtccggtaacgtcccgtacccggtacccgtcggtacctccgttcccgttcccgtaacccccg

SEQ ID NO: 227892 - DNA, 660 bp, Homo sapiens
  misc_feature: GYAE6OF01BR7ZU.23.21.B10.1.454.CMB.1.raw
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
  modified_base (389)..(389): a, c, t, g, unknown or other
  misc_feature (389)..(389): n is a, c, g, or t
  modified_base (434)..(434): a, c, t, g, unknown or other
  misc_feature (434)..(434): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtcgtggtctccgtggacagtcgatccaccgtctcctgcacgtcggaacccnagtgatggttggtactttagtatgtctcgtgtacaatcctccagacaacgccccaaatcattacttagngaggctacgtaacgcggtaccctgtacgggtttctagtcctcttcgtcgtgtcctccgaagtctcggaccaacgtccgccctcccngacctgtcctcgtcgccctcacgcctagacgacgagctatatttnttagttgcgttgccttagtactacgtagtaccgaaggttaacgtaacggtttacgtttacgtttagggtaccggggtttaccgggggaaccggggttaaaccgtaaggggttccgtaacccgggtttcgggtaccggtacgtacccggtacccgtaacgggtcccctaacccgggtcccccgttacggtacccacccggtttcccgttacgttacccccccccccg

SEQ ID NO: 227893 - DNA, 627 bp, Homo sapiens
  misc_feature: GYAE6OF01CMM3C.23.21.B10.1.454.CMB.1.raw
  modified_base (234)..(234): a, c, t, g, unknown or other
  misc_feature (234)..(234): n is a, c, g, or t
  modified_base (509)..(509): a, c, t, g, unknown or other
  misc_feature (509)..(509): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgnagtgagtcggttggtaacttttaatagtcggttctcggtagtaaccctaatacccctaccgacggaccaaaccgaccccctaaactctaacttactttagcggaacgggcaacgtaacgccggtcccttgtacgggtttctacgtcgtctcgtcgtcggacctacctaagtcgtcggaccgtaaccgccgtccctccgtacgacctactcctccgtcggtcctccgacgccgtacgacgacgacgtctagtattactatcgctcgctactatagncgaacgtagttagttgttacgttagggtacggtacggggcgggtaactaggtcggacgtacggtcgacaccggcgtacgcgttcccgcccggttacgacctcgttccgtcccgtcccg

SEQ ID NO: 227894 - DNA, 546 bp, Homo sapiens
  misc_feature: GYAE6OF01D2T6X.23.21.B10.1.454.CMB.1.raw
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcactggaacccgnagtgatggttggacttttaanatggtctcgtgtaccaatacctccaggcaaacgccccaaatcatacttangaggcactagcgcctgtagggttcagtcgtcttctcgtgctccgagtctggcaacncgcctccngaccatctcgcgcctccacgcctgacgacgngctgattattatgctgtctnatangcagtatagtagttacgtttggacgggttcgggacggggtactaagggtcgtaccggttacggtcggtacacggtcccgaacggtcctacccgtccccgtacggtccaccgttccgtccgtccccc

SEQ ID NO: 227895 - DNA, 759 bp, Homo sapiens
  misc_feature: GYAE6OF01AJHPR.23.21.B10.1.454.CMB.1.raw
  modified_base (236)..(236): a, c, t, g, unknown or other
  misc_feature (236)..(236): n is a, c, g, or t
  modified_base (288)..(288): a, c, t, g, unknown or other
  misc_feature (288)..(288): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgacgggtcctgggcccagtctgccctgactcagcctgcctccgtgtctgggtctccgtggacagtcgatccaccgtctcctgcacgtcggaacccgnagtgattggtttggtaactttttaatatggtcttcggtggtaccaatacccnccaggcaaacgcccccaaatcattactttatgaggcactaagccggccctgtacgggttctagtcgcttctctggcctccaagtctggacacgacggccctccctgacccatccgtccgtcggtccctccgacgtccgtacgaccgtacgacggtctggttaactttagtttagtttacggccgttcggtccttaccctaacttacgttacggtaccgtaaggtaacggttaacggtttaaggtttaaccggttttagggtaaccggggggtttaccggggtaacccggggggggtaaccgttaaaccgggggttacccgggttaacccggggtttacccggggttaaccgggttacccgggtaacccggtaccccggtaaaacccggggttccccgttaaccccggggtccccccccgtttacgggttacccctaccccggtttcccgttccccggtttaaccccccccg

SEQ ID NO: 227896 - DNA, 707 bp, Homo sapiens
  misc_feature: GYAE6OF01B4U17.23.21.B10.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccnagtgagtggttaggtacttttaatagttggtcttcggtacggtaacctaactaccctccgaaggtaccaaaccgaccccctaaatctaacttaactttagcggaacgggacctaacgtaacgggccggtacccttacggttaacggggttttcctacggttccgtccgttttaccgtcgtcggtcctaccgtaaacggttcgtacggaccaaccgcccggtccctacccgtacgacctattcccgtcgtccggtccctaccgacgtccgtacggacgacggagtctagtatttagttagtgtcgtcgtctacgtaatagtcgactaagttagttacggtttaagttaggtttcgggacgggttcggggaaccggggtaacgtaagggtccggtacggttacggtacggtacgaccggccggacggtccgtcccggtccccgttacggttacctccgttccgttcccgttcccccg

SEQ ID NO: 227897 - DNA, 578 bp, Homo sapiens
  misc_feature: GYAE6OF01COA20.23.21.B10.1.454.CMB.1.raw
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (393)..(394): a, c, t, g, unknown or other
  misc_feature (393)..(394): n is a, c, g, or t
  modified_base (437)..(437): a, c, t, g, unknown or other
  misc_feature (437)..(437): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactggaaccccgnagtgattggttggtacttttaangtggtctcgtggtaccaataccctaccagacaaacgcccccaaatcaattactttangaggcacgtaagcgtccctgagggtttcagtcgtcttcgctggctacagtcngcaacncgcctctnacntcncngcctcnncctgacgcgagctgtattattattcgctcgtctactataacgngacctaaggtaataacggttacgttagtttggtacggggttcgggaaccggggtacgtacgggtgtaccggttaggtcggtacgacggccgtaccggaccgtcccggtcccctcggtacctacgtccgttcgttccccccg

SEQ ID NO: 227898 - DNA, 889 bp, Homo sapiens
  misc_feature: GYAE6OF01EFJEA.23.21.B10.1.454.CMB.1.raw
  modified_base (255)..(255): a, c, t, g, unknown or other
  misc_feature (255)..(255): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacgggtcctgggctcagtccgtcgccctgacctcgacgtcctcgtccctccggttgtcgtcgggtcctcgtggacagtcagtccaccgtctccgtgactacgtacggaacccgngagtgtagttggttacggttaacttttaagcgttcggtcttacggtacgtaacctaacgtacccgtccgaacgaccaaacccgacccctaaactctaactttactttagacggacggtacctaacggtacggtcccggtacccttgggttacgggttttacctacggttccctcgtttccgtacgtcggtaccctacggtaagttccgtacgaccgaaccgtccgttaccctcccgtaacgtacctactccgttaccgtccggacccttaccaaccggtcccgtaacgggaacccgtacggtaccggtacgtttaacgtaacgttttacgttacgtccgttacgttaccctattaccgtaacgttaacgtacggtaaccttaagggtttaaccgtttaagggtttaaccgttttcgggtttaaccgggggttaccggggttaaccggggggtaacccgggtaaaccgggtttaaaccggggtacccgggtttaaaacccggttcgggttaaaaccggaaccccgggttaccccggtaaaccggggttaaccccgtttcccccgggttaaaccccccggttccccggtttaaaccgttcccccgttaaccgggtttcccccggtttaccccccgg

SEQ ID NO: 227899 - DNA, 752 bp, Homo sapiens
  misc_feature: GYAE6OF01DVPO2.23.21.B10.1.454.CMB.1.raw
  modified_base (539)..(539): a, c, t, g, unknown or other
  misc_feature (539)..(539): n is a, c, g, or t
  modified_base (563)..(563): a, c, t, g, unknown or other
  misc_feature (563)..(563): n is a, c, g, or t
tcagacgcgagtatcacgaccggtgctcgatttagtgtcgtcgcaagaggaggggggggtcacaagaggcagcgctctcgggacgtctccaccatggcctgggctctgctgctcctcactctcctcactcaggacacagggtcctgggcccagtctgccctgactcagcctcgcctcgtgtcgtgggtctccgtggacaggtcgactcacccgtctcctgccgacgtcggaacccgtgagtgtagttggttaggttaacttttaagtcgtggttccgtcgtacggtaacctaactaccctccgaacggaccgaaaccgaccccaaactactaacttactttagaggtacggacctaacgtaacggcccggtacccgtacgggttacgggttttaccacggttccgttcgttccgtcgtcgtaccttacgtacgtcgtacggaccgaacccgtccggtccctcccgtacgtacctacgtccgttaccgtcgtaccctaccgacgtccgtacggaacgccgtaggtactacgttaagtttntttaacgtcgtcgttcgaccttanacgttagtccgaacgtagtaacgttacgttagtttacgggtttacgggtacggggttccggggtacggggtaaccggtaacgggtaccgggtacgggttacgggtacgggtaccggtaccgacccgggttcgaccccgtccgtcccccggttacgtccgtacccgttcctcccgttaccccgtaccccg

SEQ ID NO: 227900 - DNA, 706 bp, Homo sapiens
  misc_feature: GYAE6OF01D87PD.23.21.B10.1.454.CMB.1.raw
  modified_base (252)..(252): a, c, t, g, unknown or other
  misc_feature (252)..(252): n is a, c, g, or t
  modified_base (459)..(459): a, c, t, g, unknown or other
  misc_feature (459)..(459): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcgaggacacgagggtcctcgggcccaggtctcgccctgacctcgacgtcctcgcctccgtgtcgtggtcctccgtggacagtcgactccaccgtctccgtgactaccgtacggaacccgngtaggtgtagttaggttacggttaactttttaagtgttcggttcgtacggtacgtaacctaactacccgtaccgacggaccaaacccgtacccctaaatctaattacgttacgtagacgactaacgacgtccgtaccgttggtacgggtttcagtcgtcttctcgtcgctacgacgtcgcgacacgccgtcctactacactagtccnccgtaccgtcctaccgtacgcctacgggaacggtacgtaccgtattaacgtaatttacgttcgtctacgtcgtactacgtatacgtacgaacgtaagtaacgtttacggttaacgtttacggttggggacccggggttacggggaccgggtaaacgttacgggtccgtaaacgttcgggaaccgtacgaccggaccggtacgtcccgtaccccgtaccgtccgtactccttcccgtccggtaacccc

SEQ ID NO: 227901 - DNA, 883 bp, Homo sapiens
  misc_feature: GYAE6OF01DSAB6.23.21.B10.1.454.CMB.1.raw
  modified_base (243)..(243): a, c, t, g, unknown or other
  misc_feature (243)..(243): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctcgggcccagtctgccctgactcagcctgcccttccgtgtcgtgggtcctccgtggacagtcgaatccaccgtctcctgcctactcggaaccccgntaggtgagttgggtttacgggttaactttttaaagtacgttggttcctcggtacggtaacctaactacccgtccgaaggaccaaaccgaccccctaaactacgtaatttacttagcggacggtacaacgtaacgccggtcctaggttacgggttctacggtcgtccttcgttcgtcgtaccgtacctaaggttcctacgggacctaaaccgtccggtaccctacccgttaccgtaaccgtacgtttcccgttcccggttaccggtaccccttaccccgtaggtaccccggttacggaaacccgggtaacggaaccgggtttaccgttaacggtttaaattttaccggtttaaggttaccggttccgttacgtaccctttaacgtaagttttaacccgagggtaacctaagggtttaaacgttaaacgggttacgttttaacggtttacgggggttaacgggttacccggggggtaaacgggggtaccggttaaccgggttaccggtaaccgggttacccgggttaccgggtttaacggaacccgggttcccgtaaaccgggtcccggttaacccccgggtcccccggtttaggttaacccccgttacccgtttcccggttacccccgtttacccccccgg

SEQ ID NO: 227902 - DNA, 749 bp, Homo sapiens
  misc_feature: GYAE6OF01C8R2L.23.21.B10.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtgatggttagggtacttttaatagtggtctcggtacggtaaccaactaccctccgaggaccaaaaccgccccctaaatccgaattactttagtcgacggactactaagccggtccctcgtagggtttctacgtcgtcttctcgtacggctaccgtaagtcgtacggacctaaccgtaccggcccttcccgtacgaaccctacgttcctcgtccgggtccctccgacgtcccgtacggaaccgacggacggtccttagttaatttacgtttaattcggtctcgtacttacgtattacgtagtaccgaaggtacgttaagtttacgtttaacgttttaggggtacggggtttaccgggggacgggggttaaccgtaaaggggttcccgggtaaccggttaccgggttaacggtaccgtaaccggtacccccggtaaaccgggttccccgttaccccgggtaccccccgttaccggggttacccttaacccggtttcccgttaccccggtttaccccccc

SEQ ID NO: 227903 - DNA, 725 bp, Homo sapiens
  misc_feature: GYAE6OF01EDUGU.23.21.B10.1.454.CMB.1.raw
  modified_base (216)..(216): a, c, t, g, unknown or other
  misc_feature (216)..(216): n is a, c, g, or t
  modified_base (457)..(457): a, c, t, g, unknown or other
  misc_feature (457)..(457): n is a, c, g, or t
tcagacgcgagtatcacgaccggtgctcgatttagtgtcgtcgcaaggtaggagaggggggggtcacaacgaggcaagcgctctcgggaccgtctccaccatcggcctgggctctgctgcctcctcactcgtcctcgactcaggactacgagggttccgtgggcccagtctgaccctgactcacgccgtgacctccgtgtctgggtctccgtgganagtacgactcgaccgtctcgtgactcgtaccggacccggcaggtcgtacgtgttaggtaacttttatagtcggttctacgtacggtaaccaagttacccgccgacggacctaaacggccccccaaagtctaagtaccgtttagaggacgggtacgtaccgtaagccggtcctacgtagggttacctaaggcctcgtcacgtggactccaagtcctagaccgtaacgtaccggacccgtccncggaccctagtccttacgccgggaccctccgaacggtcccttaggaccgaaacggtacgaccgtagtaaactttacggtaattcgaacgtcaacccttatactagacgtacaggtaacgttaggttattacggtttacggagggttacccgggtcggggaaactaagggtacggacccggtttcgaacggttatacggtaacccgtagggtcccttaccggtccccttacgggtacctttaccggtaccgttccggttaccccccggg

SEQ ID NO: 227904 - DNA, 717 bp, Homo sapiens
  misc_feature: GYAE6OF01EA21T.23.21.B10.1.454.CMB.1.raw
  modified_base (407)..(407): a, c, t, g, unknown or other
  misc_feature (407)..(407): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtcctgccctgactcagcctgcctccgtgtcgtggtcctccgtggacagtcgactccaccgtctcctgcactcggaacccgcgtacgtgtattggttacggttacttttaagtacgtggtctacggttacggtaacctaactccctaccgaacgtaccgaaaaccgacccccaaacgtactaactttacttaagtacggacgggtactacgtaacgccggtccttaggtacggtttctacggtcctcttcncgttcgactaccgtaagtcgtacggacaaacgtccggaccctccacgacctacgtccgtacgtccgcccgttaccgacgtaccgtcggaaccggtacggtacggtccgttaggttactttaacgtttgttacgtcccgttagtacctaccgttagttactacggtacgaagtttacgtacggttagtttacggtttagggtacggggttccggggaacgggtacgtaacgggtccgaacggtttccgggtaacgcgtaacggccgtacgccgtcccgacccgtcggtactccgttcctccggttaccccg

SEQ ID NO: 227905 - DNA, 796 bp, Homo sapiens
  misc_feature: GYAE6OF01DMLON.23.21.B10.1.454.CMB.1.raw
  modified_base (130)..(130): a, c, t, g, unknown or other
  misc_feature (130)..(130): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctnactcaggacacagggtcctgggcccagtctcgccctgactcagcctgcctcgtgtcgtgggtcctcctggacagtcgatcaccgtctctgcacgtcggaacccnagtgagtggttggtactttaatntgtctcgtgtacactacctcaggacaaacgccccaaatctacttacttatggaggacagtaacggccgccttcggtacgggttctacgtccgtcttcgtcgtcggtcctaccgtaagtccgtgaacaaccgccggtccctaccgtacgtacctagtccttcgtaccggtcctacccgacggtcccgtaggaaccggtaccggacggtacgttaacggttaactttttacgggttacgtttccggacgtttaccgtaccgttacttaacgttacgttacggaacgttacggtttaaagtttaaccggggtttaccgtttacgggttttaacgggggttaacccggggggttcggggggttaaacccgggggggtaacccgttaacgggggttaccccgggtaacccggggttttaccggggtaaccggtacccgggtaaaccgggtacccccggtaacgggttcccgttacccccgggttccccccggtttacggggtacccctttacccggttccccgtttaccccggtttaccccccc

SEQ ID NO: 227906 - DNA, 741 bp, Homo sapiens
  misc_feature: GYAE6OF01ATMFM.23.21.B10.1.454.CMB.1.raw
  modified_base (240)..(240): a, c, t, g, unknown or other
  misc_feature (240)..(240): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctccgtggacagtcgactccaccgttctcctcgcacgtcggaacccgnagtgattggttaggtacttttaatgtgtctcgtacgtaccataccnccgagacaaccaccccaaatcattacttagngacggcactacgccgcctcgtagggttctagtctcttctcgtcgctacacgtcgagcaacgcgcctccgcactctctctcgcctacgcgtcctacggacgacggtcgtctagttacttattcgtacgtcgtcgtacttacgtacttaacgtcgaacgttaaggtaacgttttaacggtttaacggtttacgggtttacgggggtaacgggggtttacccgggggtaaaccggggggttaaccgtacgggggttaacccgggttaacccggggtttacgggttaaacccgggtacccggtaaaccccggggtaacccccggttaaaccgggtcccccggttaccccccggttaccccccgggtttacggtaaaccccccgttttcccggtttaccccggtttacccccccggttaaccccccccg

SEQ ID NO: 227907 - DNA, 948 bp, Homo sapiens
  misc_feature: GYAE6OF01EIC85.23.21.B10.1.454.CMB.1.raw
  modified_base (250)..(250): a, c, t, g, unknown or other
  misc_feature (250)..(250): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgtacgggtcctcgggcccagtctcgccctgactcacgcctcgcctccgtgtcgtcggtctccgtggacagtcgactcctaccgtctccgtgccgtacgtacggaacccgngagtcgtagttaggttacggttaacttttaagacgttcgttccgttacggtaccggtaaccctaacgttccccgtaccggaacggtaacccaaaaccccgtacccccgtaaacttacttaaccgttttaacgtttcggacgggtaaccgggtaccttaaaccggtaccggtccccgggtacccttttagggttacggggttttaccacggtttccgtacctttccgtacggtaccggtccttaaaccggtagtcccggtacaccgaacccggtcccggtcccgttaccctagaacccgttgtacccgtcggtacccgtcccgtaccgtaccccggtaccgtacgggtaaccggtacggtaaccgggttacctaagtttacgttttaacgttcgttaccggtcgttacgtacctacgtttaactacggttacgtaacgtaaacggtttacgttaaaccgggttttaccggtttaaccgggtttaacgggggttaaccggggggttacccgggggtaaaccggggggttaacccgtaaacggggtttaccccgggtaacgggttaccggggttaaacccggaacccgggtttaaccccggtacccggggaacccggttaccccccggtccccgggttaacccccggttaccgggtttaaccccgttacccggtttccccgttcccccgggtttacccccc

SEQ ID NO: 227908 - DNA, 690 bp, Homo sapiens
  misc_feature: GYAE6OF01CAJGR.23.21.B10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgacgggtcctgggccagtctcgccctgactcagcctgcctcgtgtcgtcggtctccgtggacagtcgatccaccgtctcctgctacgtcggaaccnagtgagttggttaggtactttatagtcggtctcgtcggtaaccaacgtaccctccgacggaaccaaacccgacccctaaactactaacgttactttacgaggacggactaactaacggccggtaccgttcggtaaggggtttctacgtcggttcttccgtcgtacggtctaccgtaagttcgtacggaccaaaccggtccgtccctaccctacgtaacctagtccttccgtcgccctacgacgtccgacggaccgaggaacggtcttaagtaagtttacttagtcgtctacgtctacgtagtatcgaagaagttagttaacgttagttaaggttggacgggtcggggacggggtacgtaggtcggtacggttacgggacgtaccggacggtaccgacggtcccgttcccggtaccccggtacggttaccctacggtttccctcccggttaccccc

SEQ ID NO: 227909 - DNA, 905 bp, Homo sapiens
  misc_feature: GYAE6OF01D4BP8.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgactcagcctgcctcgtgtcgtgggtctccgtggacagtcgactccaccgtctccgtgacctaccgtacggaaccccgcgtaggtgtagttcgggtttacggtaacttttttaaagtagttcggttccgttacggttaacggtaaccctaaaccttaccccgtacccgaaggaccaaaacccgacccccctaaaattctaactttacgtttagcggaacgggacctaacgtaacggccggtacccgttaggttaacggggtttcctacggttccgtcctttccgtcgtcggtaccttaccgtaaggttccgtacgggaaccctaaaccggtacccggtcccctttaccccgtacgtaaccccttacgttccccgttccggtacccggtccccttacccgaacccggtacccgtacgggaaacccggtaacccggtaacggtaccgttaaggtttaacttttaacgttttaacgttccggtaccgttcggtaccttaccgttaagttacgtacggtaacgtaacggttaagtttaacgggtttaacggttttaaccgggtttacgggggttaaccgggggtttaccggggggaacccggggggtaaacccggtaacggggttccggtaacccgggtttaccgggtaacggtacggaacccggtaccccggaaaccggtccggttacccccggtcccccggttaccggtaccttacccgttccgttccccggttaaccccc

SEQ ID NO: 227910 - DNA, 663 bp, Homo sapiens
  misc_feature: GYAE6OF01DDETX.23.21.B10.1.454.CMB.1.raw
  modified_base (239)..(239): a, c, t, g, unknown or other
  misc_feature (239)..(239): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagcctgcctccgtgtcttgggtctccgtggacagtcgatccaccgtctcctgccacgtcggaaccccgnagtgactggttgggtacttttaatagtgtctcgtggtaacctaatccctccagacaaacgcccccaatcattacttagtcgaggacacgtagcgccgtagtagggttcagtctcttctctcggctcaagtcgtcgacaaccgcgtcctaccgcgacctatcgtcgtcggcccttacgacgcctaggaccgtacggcgtactgtaactttagttacgtcgtcgtcggtccttacgtaacttacgtacggactaaggtaacgttagtttaacggttacgtttcgggttaacggggttccggggaacgggggttaacccgtaaagggtccggtaccggttacgggtacggtaccgtaaccggcccgtaacggtcccgttacccggtcccccgtacggttccacccgttcccgttaccggtccccccg

SEQ ID NO: 227911 - DNA, 629 bp, Homo sapiens
  misc_feature: GYAE6OF01CW0IE.23.21.B10.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (306)..(306): a, c, t, g, unknown or other
  misc_feature (306)..(306): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcactggaacccgnagtgatgttggacttttaanatggtctcgtggtaaccaatacctccaggacaaacgccccaaatcaatactttangacggcataagcgccctgtaggggtttcagtcgtcttctcgtggctaccgaagtcgtaggaccaaacgaccggtcccttaccctagaaccctactcctcgtcggtccctcccgaacgcccgttacgaaccggaacggagggtcttagtaatttaacttagttcggctcgtactacgtattancganaagtataaggttagttacgttgggacggttacggggacgggggtaacaagggtccggtaacggttcggtaacggtacacgtacccgaaggtccgtcccgtcccccgtacggttaccacgttcctccggttacccccc

SEQ ID NO: 227912 - DNA, 826 bp, Homo sapiens
  misc_feature: GYAE6OF01B3R8M.23.21.B10.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtggacngtccgatccaccgtctccngacacgtcggaacccgnaggtgtagttggttacgggttaactttttaagtagtggttctcggtacggtaaccaaacttaccctaccgaacggaccaaaaccggaccccccctaaaacttacctaattaccttttagtacggaacgggacctaaccgtaaacggcccgggtaccccttacggtaaacgggggttttccttaagggtcccgttcgttccgttcgtcggtacctaacccggtaagttccgtacgggtacaaacccggtacgggtcccccttaccgtacgacccgtactccgtaccgtacgggtcccctcgaacgttccgacggaacgaccggtaacgggtctttaagtaacgtttagttactttcgaccgttacggccttaacgtagttacttacggaacctaagggtaacgtttaaggtacggttttaacggtttaggggttaaccggggttaccgggggacgggggttaaacccaggggtttaccggtacccgttaccgggttagggtaccaacgggtccccggaaacgggtcccgttcccggaccccccggttacgttaccgaccccgttttacggtcccctttaacccccccgg

SEQ ID NO: 227913 - DNA, 718 bp, Homo sapiens
  misc_feature: GYAE6OF01EALK0.23.21.B10.1.454.CMB.1.raw
  modified_base (232)..(232): a, c, t, g, unknown or other
  misc_feature (232)..(232): n is a, c, g, or t
  modified_base (495)..(495): a, c, t, g, unknown or other
  misc_feature (495)..(495): n is a, c, g, or t
tcagacgcgagtatcacgaccggtgctcgatttagtgtcgtcgcaagaagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgnagtgatggttaggacttttaatatggtctcgtggtaccaatacctccaggacaaacgcccccaaactcattactttatggaggcacgtaacgccggcctgtaggggtttctagtcgtcttctctggcctaccaagtcgtggacaaacgaccggtccctccctgacctagtcctcgtcggccctaccgacgtccgtggaaccgacggtacgtccttagtaactttagtttattcggtcttacggtaccttactaagtttaacgngtaaccgtaaggttaagtttaacggtttaacggtttaacggtttttcgggaacgggggttttacccggggggacggggggtaaaccctaaacggggttcggtaacccgggttacgggttacgggtaccgaaccgggtaaccccgtaaacggggtcccgttaccccgggtccccccgtttacgggacccttaaccgtttcccgttccccggtttacccccccgg

SEQ ID NO: 227914 - DNA, 728 bp, Homo sapiens
  misc_feature: GYAE6OF01C3RDV.23.21.B10.1.454.CMB.1.raw
  modified_base (231)..(231): a, c, t, g, unknown or other
  misc_feature (231)..(231): n is a, c, g, or t
  modified_base (330)..(330): a, c, t, g, unknown or other
  misc_feature (330)..(330): n is a, c, g, or t
tcagacgcgagtatcacgaccggtgctcgatttagtgtcgtcgcaagagaggagggggggtcacaagaggcagcgctctcgggacgtctccaccatggcctgggctctgctgctcctcactctcctcactcaggacacagggtcctggcccagtctgccctgactcagcctgcctcgtgtctgggtctccgtggacagtcgatccaccgtctcctgccacgtcggaacccnagtgagttggtaggttacttttaagtagttcggtctcgtcggtaaccaacttacctaccgaagacctaaacgcccccctaaactcaatttaacctttancggaaggtaccaacgtaacgccggtaccctcgttaagggtttctacgtcgtacttccgtcgtcggccttaccgtaagtccgtacggtaccaaacgtcccggtccctcccgtagaaccctacttcctacgtcggtcccctaacccgcgacccgtacggaccgaacggcgtacttataagtttacgttaacttcggtctgtaccttacaattcgacgcaaggttacgtaaggttaacgttttcgtttacgggtacggggttaccggggacggggtaaacccgttagggaccgtaccggttacggtacggtaacgtacccggaacccgttaagggccccgttacccggtccccccggtttacggtaccctaacccgttcttaccccgggtttaaccccccc

SEQ ID NO: 227915 - DNA, 784 bp, Homo sapiens
  misc_feature: GYAE6OF01B4BNW.23.21.B10.1.454.CMB.1.raw
  modified_base (142)..(142): a, c, t, g, unknown or other
  misc_feature (142)..(142): n is a, c, g, or t
  modified_base (240)..(240): a, c, t, g, unknown or other
  misc_feature (240)..(240): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgngggtcctgggcccagtctcgccctgactcagcctcgcctccgtgtccgttgggtctccgtggacacgtcgatccaccgtctcctgcacgtcggaaccncagtgagttggttaggttaacttttagtagttcggtcgtacggttacggtaacctaactacccgtaccgaaggaaccaaacccgaccccctaaaatccgttaaactttactttaacggcgggaacggtacctaaaccgtacgggcccggtacccttacgggttacggggttttctacgggttccgtcctttctacggtcggtacctacgtaacgttccggtacggaacccaacccggtaccggtaccccttacccgtacgtaaacccttcgtttcccgtcggtccccgtacctcccgacgttcccgtacgggaaccgtaacggtcgttaccgttaaggttaattttacgtttacgttccgtacgttactaccttacgtaagtcgtacggtcaagtaacggttagtttaacgggttagttcggggtacggggttccggggacgggtacgtaacgggtccggtacggtacgtacgggtcgaaccggtaccggtacggtcccgttacccggtacccccgttgtaccctcttccgttccctacccccg

SEQ ID NO: 227916 - DNA, 836 bp, Homo sapiens
  misc_feature: GYAE6OF01BI0BU.23.21.B10.1.454.CMB.1.raw
tcagacgcgagtatcacgaccggtgctcgatttagtgtcgtcgcaagagaggagggggggggtcacaagaggcagcgctcttgggacgtctccaccatggcctgggctctgctgctcctcactctcctcactcaggacacgagggtcctggcccagtctgccctgactcagcctgcctccgtgtcgtggtctcctggacagtcgactccaccgtctcctgactacgtcggaacccgcagtgagttggttaggtaactttttaagtacgtcggttccgtcggttacgtaaccctaacgttacccgtacccgaaggaaccaaaacccgacccccctaaaactctaactttaacgtttacgaggacggtacctaacgttaaccggccggtcccgttaggtacggggtttacacggttccgtacttccgtcgtacggtccttaccgaaggttcgtacgaccgaaccggtccggtcccctacccgtagtaacctacttccgtaccgtcggtaccctccgacgtaccgtacggaccgtacggacgtcgtagttatttacgtttacgtcgtaccgtcgtacctacgttaacgtacgtcggtaacctaaggttaacgtttaacggtttacggtttaaccggtttaacgggggttaaccggggggttaccggggaaacccggggggttaaccttaaccgggggttccggtaaacccgggttacgggtaccgggttacccgtaacccgggtacccggtaaaccgggtcccccgttaaccccgggttcccccggtttacggtaccccgtttacccggtttcccggtcccccgggtttaacccccccg

SEQ ID NO: 227917 - DNA, 760 bp, Homo sapiens
  misc_feature: GYAE6OF01BYMXS.23.21.B10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtgtcgtcgcaagagggagggggggggggtcacaagaggcagcgctctcgggacgtctccaccatggcctgggctctgctgctcctcactctcctcactcaggacacagggtcctgggcccagtctgccctgactcagcctgcctccgtgtcttggtctcgtggacagtcgatccaccgtctcctgcacgtcggaacccgnagtgatggttggtacttttaatagtggttctcggtcgtacctaataccctccagaccaaaccgacccccaaatcctacttactttagagtacggcctaacgtaacggccggtccctacgtacggggtttactacggttccgtactttcgttccgtcggtacctaacctaaggttccgtacggaccaacccggtacccggtcccttaccccgtcgtaccctaccttccgtacgtcccggacccttacccgacggtcccgttacggaaccggtacgtacgggtcttaacgttaacgtttatttacgttcggttctcgtaccttactagtttaacgacgtacgtaaagttacgttaaggttaccgtttaggtttacggggtaacggggtttccggggaaccgggggttaacctaacgggttaccggtaaccggttacggtacggttaccgacggtacccggtaacgtccccgtacccgggtcccccgttagggtcccttacggttcccttcccggttcccctaccccg

SEQ ID NO: 227918 - DNA, 678 bp, Homo sapiens
  misc_feature: GYAE6OF01A10I6.23.21.B10.1.454.CMB.1.raw
tcagacgcgagtatcacgaccggtgctcgatttagtgtcgtcgcaaaggaggagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggacccgcagtgattggttggtaacttttaatatggtctcgtcggtaacctactacctaccgaggaccaaaccgacccccaaactctaattacgtttaggtcggggacaacgtaagccggacctcggtagggtttctagtccgtctttctctcggctacaacgttcgtcggacacgaccggtccctccctacgacctatcctcgtcgaccctccgacgtcctacgacggagacggtctacgtatttcttacgtgtcttcgtacttctatagtcgtagacggtaattagttaaccgtttaggtttacgggttacgggggttaccggggaccgggggtaacgtacgggtcggtaaccggtacgggttacggtccgaaccgcccgggtaaacgtcccgtacccggtccccggttccggacccttacccgttcgttccccggttccccctaccccg

SEQ ID NO: 227919 - DNA, 882 bp, Homo sapiens
  misc_feature: GYAE6OF01D0QDM.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgactcagcctcgcctcgtgtcgtgggtcctccgtggactcgtcgactccaccgtctcctgctacgtcggaacccgcgtagtgtacgttaggtttagggtaacttttaatagttcggttccgtcgttacggtaacctaacttaccccgtccgtaacggaaccaaaccgtaccccccaaaacttacctaatttaaccttttaaggtacggaacgggtacctaaaccgtaacggtcccggtaccccgttacgggttaacggggttttaccgttaccggtccgttccgtttaccgttacggttcggtaccttaccggtaacgttaccgtacgggaaccctaaaccggtcccggtaccccttaccccgtcgtaaccctaacgttccctttaccggtcccggtccccgttacccgtaaccgtacccgttacggaaccggtaacggtacggtacgttaggttaacgttttattacgttcgtccgttacgtacctaccgttagttacgtacggaacgtaacggtaacgttaaggttacgtttaacgggtttacgggttacgggggtttaccggggaaccgggggttaaccggtaaggggttaccgggttaaccgggttacgggtaaccgggtaccgaacccgggtaacccgaacccgggtaccgtaccccgggtaccccgttaccgttacccgtaaccgttcccggttacccgtttccccccgg

SEQ ID NO: 227920 - DNA, 682 bp, Homo sapiens
  misc_feature: GYAE6OF01DFKTV.23.21.B10.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccgtctcctgcactcggaacccntagtgatggttggtactttaatagtgtctcgtagtaccaactcctccaggacaaacgccccaaatcattacttagagaggcacgtacgccgtacctggtacgggttcacgtcgtcttctcgtcggcctaccgaagtcgtgaccaaccgccggtccctccctagacctacgttcctcggtccggtcctccgacgtccgtacggaaccgacggtaggtaccttagttaactttagtttacttcggtactgtccttctaagttacgtcgacttagtaacgtttaacggttagttacggtttacgggtacgggggttccggggaacgggggtaaccttacggggtaccggtaccgggtacggttaacgggtacgaacccgggcccgaacgggtcccgtaccccggtccccccggttaacgttcccgtaacctttccccggttcccttaccccccg

SEQ ID NO: 227921 - DNA, 840 bp, Homo sapiens
  misc_feature: GYAE6OF01D529R.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagcctgcctccgtgtcgtgggtcctccgtggacagtcgatccaccgttctcctcgccaccgtcggaaccccgcgagtgagttggttacggtaacttttaagtagttcggtcttcggtacggtaaccaaacttaccctacccgaaggaccaaaaccgacccccctaaaacttcctaactttaaccttttagtacgggaacgggtacctaacggtaaacggcccgggtaccccgttaggttaaccggggttttactacggttccgttaccgtttccgtcgtacggtccttaaccgtaaacggttcccgtcgggtaacccaaaccggtaaccccggttcccctacccccgtaccggaaccctacttcccgttcgtcccgggtccctacccgaacggtcccgtacggaaccgggaacggtacggtacttagtaacttttattacgttcgtctcgtcttacgtatacgtcgaacgtagtaacgtttaggttaacggttttacgttacggggtaaccggggttccgggggaacccggggggtaaccgtaaggggttaccccggtacgggtttaccgggtaccggtaccggaacccggaccccgggtaacggtcccgttacccgggtccccccggttaggttacccctacccggtttccgtcccccggttaaccccc

SEQ ID NO: 227922 - DNA, 676 bp, Homo sapiens
  misc_feature: GYAE6OF01AW2I9.23.21.B10.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (541)..(541): a, c, t, g, unknown or other
  misc_feature (541)..(541): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctncactcggaacccgtnagtgagttggttagggttaacttttaatagtggttcgtcgtaggtaccaattacccctccgaggtacaaaccgccccctaaactcaattacttagtggacggacacgttaacgccggtcctcgtacggggtttctaggtccgtccttctcgtcggtaccttaccgaagttcgtacggactaaacccggaccggtcccctacccgtaggtaccctacttccgttccgtcgggtacccttccgacgtccccgtaggaaccggcggacggtctagtaactttacgttagtcgtccgtagtcctactattancgtacgtaagttattagttacgttaggttcggtacgggttcgggcggggtaactacgggtcgtaccggtcggtacggtcgacggccgacggtccctacgggtccccgtacggtcctaccgttcgtcccgttcccc

SEQ ID NO: 227923 - DNA, 706 bp, Homo sapiens
  misc_feature: GYAE6OF01D0WU7.23.21.B10.1.454.CMB.1.raw
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
  modified_base (531)..(531): a, c, t, g, unknown or other
  misc_feature (531)..(531): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcgaccgtctcctgcacgtcggaacccgcagtgatggttggtaacttttangtcggtctcggtgtacctaatacctccgaggacaaacgcccccaaatctatactttanggaggacacgtaagccggaccttcgtagggtttctacgtcgtcttctcgtcggtacctacgaacgttcgtacggaccaaccgcccggtaccctcccgacgtaaccctattcccgtaccgttccggcccttacccgaacgtcccgtagaacccggaacggtacgggtacttaggttaactttagtttaacttgccgtttaggcccttaacgtacttancggtaactaagtacgttaaggtttacgtttaacgtttaggggtacgggttccggggacgggggtaaccgtaggggtccggtaacgggttacggtacggttacgaccggtacccgaagggtcccctcccgggtccccctacgggttacccttcccgtcggttccccgttccccccg

SEQ ID NO: 227924 - DNA, 638 bp, Homo sapiens
  misc_feature: GYAE6OF01DAURL.23.21.B10.1.454.CMB.1.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggcagtcgatcaccgtctcctgcactcggaaccccgnagtgatggttaggtatttaatntggtctgtaggtaccaactcctccaggaccaaacgccccaatctaatacttagtcgaggcaacgtacgcgtcctgtagggttcacggtcgtacttctcgtcggtctctaagtcgtcggacaaccgtacgccccttcctacgaccgtacttccgtccgtccggacccttacccgacgtccgtcgaaccggtacgtcggtactagttatttacttagtcgtctgtactcagtctgactagtattaagtgttacgttgggtacgggttcggggacgggtaccgtaaggtccggtacggttcggtaacggtaccgtacggcccgtaacgggtcccgtaccccggtccccggttacgttaccctccgttccgttcccggttacccccg

SEQ ID NO: 227925 - DNA, 832 bp, Homo sapiens
  misc_feature: GYAE6OF01CJCI3.23.21.B10.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctcgggcccagtctgccctgactcacgcctcgcctcgtgtctgggtcctcgtggacngtcgatccaccgtcctcctgacctacgtaccggaacccgnaggtgtagttagggttacgggttaattttaattggtcggttccgttacggttacggtaaacctaaacttaccctaccgaacgaaaccaaacccgaccccctaaactactaactttacttacgtaggacggtacctaacggtaacggtccgtacccgtacgggttacggggtttactacggttccgtcttccgtcggtcgacctacgtaacgtcgtacgaaccccgtacgacccggtccctcccgtacgtacctcgttccgtacggttccgacccgttacccgacgtacccgtacgggaaccgtacggtacggtaccttaagttaacttttacgttagtttctcggttactactacgttaatcgtacgaacgtaagttaagttaacggtttagttaccgggtttacgggtacggggggtttaccggggaaccgggggttaaccgttaacggggtaccgggttacccgggttacgggttaaccgggtaacggaacccgggtacccggaaccgggttcccccggtaccccggttccccgggttaacgtacccgtttaaccccgttcccggtttacccccgttaaccccccg

SEQ ID NO: 227926 - DNA, 697 bp, Homo sapiens
  misc_feature: GYAE6OF01BHPNN.23.21.B10.1.454.CMB.1.raw
  modified_base (237)..(237): a, c, t, g, unknown or other
  misc_feature (237)..(237): n is a, c, g, or t
  modified_base (536)..(536): a, c, t, g, unknown or other
  misc_feature (536)..(536): n is a, c, g, or t
  modified_base (656)..(656): a, c, t, g, unknown or other
  misc_feature (656)..(656): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctcgtgtctgggtcctcctggacagtcgactccaccgtctcctgccacgtcggaacccctnagtgagttggttaggtacttttaatagtggtctcgtacggtacctaacttacccgtccgaggaccaaaccgcccccctaaaatctaacttactttagcggtacggacctaacgtaaccggccggtacccgttacggtacggggttttacctacggtccgtctttccgtcgtcggtaccttaccgtaagtccgtacggaccaaaccgtaccggtccccttacccgtacgacccctatcccgttaccgtccggtccccttacgaccgtccgtacggaacgacggtaggtctagtaactttntagtacgtctacgacttctagttacgcgtactaagtagttagttacgttagttcgggtacgggttccgggacgggtactagggtcggaccggttgtacgtacgacggtcccgaggtcccnccggtacccgtcggtactacccggttcgtcccgttcccccg

SEQ ID NO: 227927 - DNA, 766 bp, Homo sapiens
  misc_feature: GYAE6OF01B8QV8.23.21.B10.1.454.CMB.1.raw
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
tcagacgcgagtatcacgaccggtgctcgatttagtgtcgtcgcaagagggagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctgacagtcgatcaccgtctcctgcacgtcggaacccncagtgtatggttgggtaactttttaagngttggttctcgtcggtaacctaactaccctccacggacaaaaccgaccccccaaatctaattactttagtacggacggcaacgtaacggccggtccctggtacgggtttctacgttcgtcctttcgtcgtacggtctaccgtaagtcgtacggacctaaccgaccgggtcccttcccggtacacccttacgtctccggtcgtccctccgtaccgcccgttacggaccgacggtacggtcttaacgtaacttttaacgttcgtttaacgtccttaccggtacttaacgtaacgtttaagcggtaacgtaagttaacgttaacggtttacgtttacgggtttacgggtacgggggtttacccggggggtaccggggtaacggtaaaccggggttccgggtaccggttaagggtaacccggtccgtaaaccggacccggtaacccggtccgtacccccggttcccccgttaggttccctaacccgtttctcccggttacccccttacccccg

SEQ ID NO: 227928 - DNA, 748 bp, Homo sapiens
  misc_feature: GYAE6OF01ED2JU.23.21.B10.1.454.CMB.1.raw
  modified_base (551)..(551): a, c, t, g, unknown or other
  misc_feature (551)..(551): n is a, c, g, or t
  modified_base (559)..(559): a, c, t, g, unknown or other
  misc_feature (559)..(559): n is a, c, g, or t
tcagacgcgagtatcacgaccggtgctcgatttagtgtcgtcgcaaggagaggagggggggggtcacaagaggcagcgcttctcgggacgtctccaccatggcctgggctctgctgctcctcactctcctcactcgacggacacgtacgggtccgtcgggccctagttcctcgccctgactcagtcctcgccgtccgtgtcgtggtcctccgtggacacggtcgactccgtaccgttcctccgtcgcctacgtaccggaacccgcgtagtcgtagtttcggttttagggttaaactttttaagtagttcggttcgttacggttaccgtaacctaacgttccctaccggaagacccaacccgtaccccaatctaacgttacgttaggacgggtacggactacggtacggtccggtccgttaggttacggttctacggtccgttctcgtcgtcgtacctacgtagttcgacgaccaccgtccggtcctccgacgacctctcgtccgtaccgtctaccgcgtccaggagccgtagtctagtattactgtctctntactactnacgtcgtagtaacgttacggtagttacggtttaacggtcggggtaccgggtaacggggaccggtaacgtaacgggttcccgttaacgggttacgtaccgttacgggaacccgtcccgggacgttcccccggttaccccggttccggttacccgtaccgtttccgtacccccggttcccggtaccccccg

SEQ ID NO: 227929 - DNA, 754 bp, Homo sapiens
  misc_feature: GYAE6OF01BQFRY.23.21.B10.1.454.CMB.1.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgactcagcctgcctccgtgtcgtggtctccgtggacagtcgatcaccgtctcgngcacgtacggacccgnagtgtagttggttaggttaacttttaatgttcggtacttacggtagtaacctaacttacccgccaacggacctaaaccgaccccaaactactagttaacgtttagacggacggacctaacgtaacggtcccggtacctacgggttaaggggtttcctaacggttccgtcttcgtcgtacggtacctaccgtaagtccgtaacggaaccaaaccggtccgacccttaccggactaacctactccgtccgttaccgacccttccgacgtccgaacggaccggtagacgttacgtagttaactttagtacgtttcgtctacgtcgtatacgtaacgtggtactaaggttacttaacggttacgttacgggttacgggtacgggggtaccggggaaccgggtaacggacgggttaccgtacggttacgggttcgaaccggaacccgggttacgccggggtaccttaccccgggtacccccacgggttaaaccctccggtttaaccgtccccggttacccccg

SEQ ID NO: 227930 - DNA, 680 bp, Homo sapiens
  misc_feature: GYAE6OF01BUUQZ.23.21.B10.1.454.CMB.1.raw
  modified_base (247)..(247): a, c, t, g, unknown or other
  misc_feature (247)..(247): n is a, c, g, or t
  modified_base (352)..(352): a, c, t, g, unknown or other
  misc_feature (352)..(352): n is a, c, g, or t
  modified_base (528)..(528): a, c, t, g, unknown or other
  misc_feature (528)..(528): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacgggtccgtcgggcccagtctcgccctgactcacgcctgccctccgtgtcgtcgggtcctccgtaggacagtcgatccaccgttctctgcgtacgtacggaaccntagtgagttggttacggtaacttttaagtgttacggtcgtacggtacgtaaccaacgttacctaccgaaggaaccaaaccgacccctaaactctaattacttagngacggacaacgtacgccgtacctcggttacggttctagtctcttcctcgtcgctcgtaagtcgtacggaccaacgtccggtccctccctacgaacctcttccgtccgtccgacctccgacgtcctacggaacggtacgagtctagttaatttcgtactcgtctgacttacgatcgngtatagtagttagttacgtttaacggttcgggtacggggtacgggaccgggtaaactcggggtcgtacccggtaggaccgggttcaaaccggttccgaacgggtcccttacccgggtcccgttcgaaccttcccgttccgtacccgtccccg

SEQ ID NO: 227931 - DNA, 638 bp, Homo sapiens
  misc_feature: GYAE6OF01CNEDS.23.21.B10.1.454.CMB.1.raw
  modified_base (310)..(310): a, c, t, g, unknown or other
  misc_feature (310)..(310): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgcagtgatggttggtacttttaagtatggtctcggtgtaaccaataccctccgagacaaacgccccaatcatacttangaggcacgtagcgaccctcgagggtttcagtcgcttctcgtcggctcagtctgacaacgcgccctcctgacctatcctgtcgcctcacgtcctgacgacgagctagtacttattagtcgacttgccttacgaattacgcgtaaccgtagtacgtttaaggttacgtttacggtttacgtaccggggttcgggggaacccgggggtaacgtacggggttaaccgggtacccggttacggttaacgggtactaaaccgggtacccgtaaacgggccgttaccccgtccccgtaacggtccttaccgtccccgtttccgttaacccccccg

SEQ ID NO: 227932 - DNA, 898 bp, Homo sapiens
  misc_feature: GYAE6OF01BEI50.23.21.B10.1.454.CMB.1.raw
tcagacgcgagtatcacgaccggtgctcgatttagtgtcgtcgcaagagaggaggggggggtcacaagaggcagcgctctcgggacgtctccaccatggcctggctctgctgctcctcactctcctcactcaggacacagggtcctgggcccagtcctcgccctgactcagcctgccctccgtgtcgtcgggtctccgtggacagtcgactccaccgtctcctgccacgtacggaacccgcaggtgtagttggttagggttaactttttaagtacgttcggttccttacggttacggtaacctaaaccttacccgtaccgtaacggaaccaaaacccgacccccctaaaacttaccgtaaactttaaccgttttagacggtaaccgggacctaacggtaaccggcccggtacccgttacgggttacggggttttacgtacggtccgttcctttccgtaccggttcggtacccttaaccgtaacggttccgttacggaacccgtaaacccgtacccggtcccctttaccccgaccgtacccctaacgttcccgttccgtacccggtccccgttacccgacccggtcctaacgggaaccggtaaccggaacggttccgttaaagtttacttttagtttacgttccggtacgtttccgtaccttaacgtaatacgttacggtactaaggttaaccgtttaaagggtttaccgtttaacgggtttcggggttaaccggggttacccggggggtaaccgggggtaaaccgggtaaccggttacggggttaaccccggttaggggttaacccggtaccgtaacccgggtcccgggtacgttccccggtacccggtccccctttacgggtacccctttacccgtccgttacccccggttaccccc

SEQ ID NO: 227933 - DNA, 712 bp, Homo sapiens
  misc_feature: GYAE6OF01EW2HU.23.21.B10.1.454.CMB.1.raw
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacgagggtcctgggcccagtctcgccctgactcagcctgcctccgtgtctgggtctccgtggacagtcgatccaccgtctcctgcactcggaacccncagtgatggttggtacttttaantggtctcgtcgtaccaatacctccgagacaaacgcccccaaatctaattactttatggacggacacgtacgccgtcctacgtagggtttctaggtccgtcttctcgtggcctaccgtaagtcgtacggaccaaacgacccggtcccttccctacgaccctatcctccgtcggtcccctccgacgtcccgtagaacccggacggtacggtcttacggttaattttaacgttagtttgtccgttagtacctttcgaattagttcgacgtaacgttaagttaagttacggtttaacgtttgggttaacgggggttccggggacgggggtaacgtaaggggttccggtacccggttacggtaccggttaccgaccgggtacccggtaccggtaccgttccccggtaccccccgtacgggttacccctacggtttcccttcccggttcccccgtaccccg

SEQ ID NO: 227934 - DNA, 792 bp, Homo sapiens
  misc_feature: GYAE6OF01DXW0F.23.21.B10.1.454.CMB.1.raw
  modified_base (239)..(239): a, c, t, g, unknown or other
  misc_feature (239)..(239): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacgagggtcctgggcccagtcctgccctagactcagcctgcctccgtgtcgtgggtctcctggacagtcgatccaccgttctcctgcactcggaacccgnagtgatggtaggttaactttaatatggtctcgtagtaccaactacctaccagacaaaccaccccaaactctaactactttatacggacggacaacgtaacggccggcccttacgtaaggggttttacacggttcgtacctttcgtacggtcggtacctacctaaaggtcgtacgggacaaaccggaccggttcctacccgtacgaacctaacgtccgttacggtccgtacccgtacccgtacggaccgttacgggaaccggaaacggtaacggtccgtttaaggttaaactttttaagttaaccgttttcggacgtttacgttaacctaacgtaacgtttaagtacgggtacctaaagggtaactttaacgggttttaaacggttaacgttttacggggtaggggttaccccggggggacggggtaaaacccgttaacggggtccggttaaccgggtaaccggttacgggaccgtaaccggtaaccccggtacggtcccgttacccgtaccccggtaccggtacctaccgtttccgtacccgggttccccccg

SEQ ID NO: 227935 - DNA, 780 bp, Homo sapiens
  misc_feature: GYAE6OF01BPFFD.23.21.B10.1.454.CMB.1.raw
  modified_base (137)..(137): a, c, t, g, unknown or other
  misc_feature (137)..(137): n is a, c, g, or t
  modified_base (234)..(234): a, c, t, g, unknown or other
  misc_feature (234)..(234): n is a, c, g, or t
tcagacgcgagtatcacgaccggtgctcgatttagtgtcgtcgcaagtaggtaggagggggggggtcacaagaggcagcgactctcggacgtctccaccatggcctcgggctctgctgctcctcactctcctcactnaggacacaggtcctgggccagtctgcctgactcgacgcctcgcctcgtgtcgtcggtctcgtggcagtcgatcgacgtcacctgcacgtcgaaccgngagtgagttgttggtaacttttaagtattggtcgtcgtacgtacctaactacctccgaggacaaaccgaccccaaactctactacttacacggacggaccacgtacggcggtcccttacgggtaggggtttaccgtaggtcgtaccgttctacgttcggtaccttaccgtaacggtccgttacggacctaaccgtaaccggtcccctaccgtacgtaacctacgttccttacggtaccgggtaccctccggtaccgtccggtaccggtaaccgggacccggtaaagggtccttaacggtaacttttaacgttacggttactaccgtcggtacctacgtagttacgtacggacgtaacgttaggttaacgggttacgtttacgggtttacgggtacgggggttaccgggaacccggggggttaacggaacgggttaccgggtacgggttacggttaacggtaccgtaccgggtacccgtaaaccgggtcccgttcccgggtaccccgttcgggtaacccttcccgttccgtcccggtttacccccgg

SEQ ID NO: 227936 - DNA, 885 bp, Homo sapiens
  misc_feature: GYAE6OF01ANROF.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctccctcactcaggacacgagggtcctcgggcccagtcctcgcccctgacctcagcctgccctccggtgtcgtgggtcctccgtggacagtcgactccgacccgttctccgtgccaccgtcggaacccgcgagtgagttaggtttacgggtaactttttaagtagttcggttccgttccggttacggtaaccctaaacttaccccgtacccgaacggaaccaaaacccgacccccctaaaacttaccgtaactttaaccttttacgtagggaacgggtacctaaccggtaaccggcccgggttaccccgttacgggttacggggttttacctacggttccgttccgtttccgttcgtacggtcccgttaccgtaacgttccgtacgggaaccaacccggtacccggttacccctacccgtaccgtacccctacttccggtaccgttcccggccccgttacccgtaccgtaccgtaccgggaaccggacggtacggtacttagttaactttacgttcgttcgtccgtcgtaccttacgtagttagtcgaaccttaggtaacgttagggtttacggttacggtttggggtaaccgggttaccgggggaaccggggttaaccggtaacggggttccgggtaacccgggttacgggttaacccgggtacccgtaaccgggtcccgggtaccggtccccggttaccccggttcccccggttaccggttaccccgttacccgttcccgtttcccccggttaccccccg

SEQ ID NO: 227937 - DNA, 840 bp, Homo sapiens
  misc_feature: GYAE6OF01DK9TU.23.21.B10.1.454.CMB.1.raw
  modified_base (244)..(244): a, c, t, g, unknown or other
  misc_feature (244)..(244): n is a, c, g, or t
tcagacgcgagtatcacgaccggtgctcgatttagtgtcgtcgcaagagggagggggggggggtcacaagaggcagcgctctcgggacgtctccaccatggcctgggctctgctgctcctcactctcctcactcaggacacagggtcctgggcccagtctgccctgactcagcctgcctcgtgtcgtgggtctccgtggacaggtcgactccgtaccgtctcctcgactaccgtcggaacccgnagttagtagttcggttacgggttaactttttaatcggttcggttcttacggtacgtaacctaactcccgtaccgaacggaacaaacccgccccctaaatctaatttacgtttagaggacggacctaacgtaacggtcccggtacccttagggttacgggtttacacgggttcctcttccgtcggtcggacctttacggtaacgtctacgggaccaaccggtcccgtccttaccgtaccgtaacctctccgttaccgccggtaccctccgacgtccgtacggacggacgtaagggtcttaaggttaactttagttactcggtacttaccggttctaacgttatacgtcgtaacgtacgtttaggtttaaccggttaacggttttcggttacgggggtaccggggttacccgggggggtaacgggaaacccgggtttacgggtaacccgggttacccgggtaagggttacccggtaaccggaacccggttaaccgggaaccccgggttcccgttaaccccccggggttacccccttttaccgggcccttaacccggttttccccggttccccggttaacccccccgtttaaccccggg

SEQ ID NO: 227938 - DNA, 790 bp, Homo sapiens
  misc_feature: GYAE6OF01DHL8B.23.21.B10.1.454.CMB.1.raw
  modified_base (236)..(236): a, c, t, g, unknown or other
  misc_feature (236)..(236): n is a, c, g, or t
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctggcccagtctcgccctgactcagcctgcctcgtgttcgtgggtcctccgtggacagtcgatccaccgtctcctgcacgtcggaacccnagtgtatggttaggtacttatatggtctcgtgtaccaactacccnccgaggaccaaacnccccaatctaattacttagngacggactaacgtaacgccggtcccgttcggtacgggtttactacggtccgttctttccgtacgtcgtaccgtaccgtaacgttccgtaggtaaccgaaccgtacccgtccctacccgtcggtaaccctacgtccgttccggtaccgtcccttaccgtacgtccccgtaacgggacccgaaacgggtaccggtacgtttacgtaacgttttaagtttacgtttcggtaccgtacgttaccttacggtaacttacgtgtaaccggtaagttaacggtttaacggttaacggttttacggtttaaggggtaccggggtttaccgggggtaaccgggggtaaccgggtaaacggttaccgggtaccgggttaaccggttaacgggtacccgtaccggggtacccgttaccggttccccgtaccccggttaccccccggtggtttccccaaccgttccccggttacccggttacccccc

SEQ ID NO: 227939 - DNA, 766 bp, Homo sapiens
  misc_feature: GYAE6OF01C6SHH.23.21.B10.1.454.CMB.1.raw
  modified_base (129)..(129): a, c, t, g, unknown or other
  misc_feature (129)..(129): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
  modified_base (567)..(567): a, c, t, g, unknown or other
  misc_feature (567)..(567): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctnactcaggacacgagggtcctgggcccagtctcgccctgactcacgcctcgccttccgtgtcgttcgggtcctccgtgggactaggtccgattccgaccgttcctcctgccaacgtaccggaacccgcgtagtcgtagttcgggtttaacggttaacttttaagtgttcggttccttacgggtacgtaaccctaacttaccccgtaccgtaacgggaaccaaaccccgtaaccccctaaacttaccttaaattttaaccgtttagacgggtaacggacccttaaacggaccggccggtacccttacgggttacggggttcctacggtccgtacttcgtcgtcggtctactcggtacgtcgaaccaccggcgtccctccgtacnctcgttcncgtccgcctcacgtctacggcgactcgtcttaactattacgttctcgngtctctactatcgtaacgtgtaaggtaacttagggtttactaacgggtttcgggggtaacgggtcccgggggttacggggaaaccggttacgggtaccggttacgggacgttaaccgggcctaaaccgggcccggtacggttcccctcccgggggttcccctaggtaacccccgttcttcccggttccccttacccccc

SEQ ID NO: 227940 - DNA, 967 bp, Homo sapiens
  misc_feature: GYAE6OF01BC6TS.23.21.B10.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtgtattggttagggtaacttttaagtagttggtacttcggtacggtaaccaattaccctacccgaacggaccaaaaccgacccccctaaaactcctaaactttaaccttttaagtacgggtaacgggtacctaaccgttaaaacgggcccgggtaccccgtttacgggttaacgggggtttttaccctaacgggttccggttaccttttaccgttccggttcgggtacccttaaccgtaaacggttccgttacggacctaaaccgacccggtccccttaccccgtacgaaccctacttccgtccgttaccggcccttacccgacgtcccgttacggaacccggtaacggtaccggtacgttaggttaacttttaacgtttaacgtttcggtaccttcggttacccttacgtaacgtttacgtacggtaaccgttaaggttaacgtttaaacgggttttaaccggttttaaccggttttacgggggtaaccggggggtttacccggggggtaacccggggggggtaaacccgttaaaaggggggttacccgggttaacccggggtttaaccgggggttaaccggggttaacccggaacccggggttaaaccccccgggtaaaacgggggtttccccccgttaacccgggttccccccccccggggtttaacggggttaccccgtttaaaccccggttttccccgtttaccccccggggttttaaacccccccccg

SEQ ID NO: 227941 - DNA, 720 bp, Homo sapiens
  misc_feature: GYAE6OF01C5QWZ.23.21.B10.1.454.CMB.1.raw
  modified_base (238)..(238): a, c, t, g, unknown or other
  misc_feature (238)..(238): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgactccaccgtctcctgccacgtacggaacccnagtgatggttagggtactttttaatagttcggtctcggtacgtaacctaactaccctccaacggaccaaaccgacccccaaactctaattacttttagcggacggcaacgtacgccgtccgtagtacggggtttctacggtctcttctcgtcggctacgacgtcgtacggaccaacgtcccggtccctccgtacgacctatcctcgttccggcctccacggtcctacggaaccggacggtacggtcttaggttaacttttacttacgttcgtccgttacggtccttacgttatagttcggaactaacggttagtttaacggttacggtttacggtttacgggttacggggtttccgggggaaccgggggtaaacggttacggggtaccggtaccggttacgggtaacggtccgaacggcccgtaacgggtcccgtacccgtccccgttacgtacttacccgtccgtttcccgttaccccccg

SEQ ID NO: 227942 - DNA, 806 bp, Homo sapiens
  misc_feature: GYAE6OF01B7OAS.23.21.B10.1.454.CMB.1.raw
  modified_base (233)..(233): a, c, t, g, unknown or other
  misc_feature (233)..(233): n is a, c, g, or t
  modified_base (728)..(728): a, c, t, g, unknown or other
  misc_feature (728)..(728): n is a, c, g, or t
tcagacgcgagtatcacgaccggtgctcgatttagtgtcgtcgcaagagaggagggggggggtcacaagaggcagcgctcgtcgggacgtctccaccatggcctggctctgctgctcctcactctcctcactcagacacgagggtcctgggccagtctcgccctgactcagcctgcctcgtgtcgtggtctacgtgacagtcatcaccgtctccgtgacacgtacggaacccngtagtgtagtggttacggtaactttaagtgttcggtctacggtacggtaaccaactacctaccgaggaacctaaaccggaccccctaaaatctaattaccgttagtaggacggactaaccggtaacggccggtacccttacggtaacggggtttcctacggtaccttccgtttccgtcgttacggacccttacgaaaggttccgtacggtaaccaaccgtaccggcccctttaccgacgtaacctacgttccgttccggtacgtaacccgtcccgaaacggttccgtaccggtaacggtaccggagggtaacttaacgttacgttttaagtacgttacgaccttgtacccgtaattacgtagtcaacgttaagtaacggttacgttaagtttaccgggttacggttacggggtccgggaaaacccgggggtaactaaaccgggggttctaaacccggggttaggtaaaccggttaccgaaccgggttaaccccgnggggtttaaccccctccccggggtaacccctttaccccggaaccttttcccggttcccggttccccggttaccccccg

SEQ ID NO: 227943 - DNA, 766 bp, Homo sapiens
  misc_feature: GYAE6OF01CFGKP.23.21.B10.1.454.CMB.1.raw
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
  modified_base (500)..(500): a, c, t, g, unknown or other
  misc_feature (500)..(500): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgactcagcctcgcctcgtgtcgtgggtctccgtggacagtcgactcgaccgtctcctgcacgtacgggaaccccgtnacggtgacgtttggtttacgggttaactttttaaagcgttcgggttaccttcggtacgtaacctaacttaccccgtaccgaaggaccaaaaccgaccccctaaaatcctaattacgtttaanacggacggactacgtacggcccggtccgtacggttacgggttctacggtccgttcttccgtcgtacggtctaccgaagtccgtacgacaaccgacggtccctaccgtacgaccttacgccgttccgtcggtcccncgtaccgccgtacggacggtaccggacggtacgttagttaacgtttgtttaacgttgtccgtcgtctacgttatacgtaggtactaaggttacgtaagggttttaaccgtttacggtttaggggttaccgggggttaccggggaaccggggttacgtaacggggtaccggtacggtacgggttaccgtacggacggcccgtaaacgggtcccgttacccggtaccccggttcggtaaccctccgttcccggttcccgttcccccgg

SEQ ID NO: 227944 - DNA, 735 bp, Homo sapiens
  misc_feature: GYAE6OF01EREOL.23.21.B10.1.454.CMB.1.raw
  modified_base (455)..(455): a, c, t, g, unknown or other
  misc_feature (455)..(455): n is a, c, g, or t
  modified_base (533)..(533): a, c, t, g, unknown or other
  misc_feature (533)..(533): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctcgggcccagtctcgccctgactcacgcctgccttccgtgtcgtgggtctccgtggacagtcgactccaccgtctcctgcacgtcggaacccgcaggtgtagttggttaggtaacttttaagtagttcggttcgtcgttacggtaacctaacgttacccgtaccgaacggaaccaaacccgtcccccaaattctaacgtttactttagcggtacggactaacgtacgccggtccttacggtcgggttctacgtccgtcttacgtcgtcgctcgtacgtcgtacgaccgacgtccgtcctacccgtanacctacgtccgtacgtcggtaccctcgtaccgtcgacggaaccggacggtagtaccttgttaaactttcttagttccncgttcgacttacagtactacgaagttaacgttacggttaacgttacggttacggtttacggggtaccgggttaccgggggaaccggggtaactacggggttaccgggacccgggtttaggaaccgggtcacccggttacccggaccggttcgacccccgttccggttacggtacccttaccggttccctccccggttacccc

SEQ ID NO: 227945 - DNA, 732 bp, Homo sapiens
  misc_feature: GYAE6OF01CMUCX.23.21.B10.1.454.CMB.1.raw
  modified_base (262)..(262): a, c, t, g, unknown or other
  misc_feature (262)..(262): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagcctgcctcgtgtcgtgggtctccgtggacagtcgactccaccgtctcctgccacgtcggaaccgcagtgatggttggtaacttttaagtntcggttctcgtacggtaacctaactaccctaccgaggtaccaaaccgtacccctaaatctaattaccttagtaggacggtactaacgtaacggccgtcccgttaggtacgggtttcacgttccgtacttcgtccgtcgtcctaccgagtcgtacggtacaaccgtaccgtcccttccgtacgacctacttccgtcgtaccgtaccctaccgacgtcccgtacgaaccggtacggacgttacgtagttatttagttactcggtctacgtctaactattaccgtgtacgaaggtttacgttaaggtttacgttaggtttacggggtaccggggtttacggggaccgggggttaaccgtaacgggtacgggtacccggttacgggtaacggtcggaacccggtaccggtaaccggtcccgtaacccggtcccccggttacggtacccgttacttcccggttccgttccccccg

SEQ ID NO: 227946 - DNA, 662 bp, Homo sapiens
  misc_feature: GYAE6OF01C7LE2.23.21.B10.1.454.CMB.1.raw
  modified_base (205)..(205): a, c, t, g, unknown or other
  misc_feature (205)..(205): n is a, c, g, or t
  modified_base (238)..(238): a, c, t, g, unknown or other
  misc_feature (238)..(238): n is a, c, g, or t
  modified_base (430)..(430): a, c, t, g, unknown or other
  misc_feature (430)..(430): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggcacgagggtcctgggcccagtctgccctgactcacgcctcgccttccgtgtcgtgggtctccgtggacngtcgatctaccgtctctcgacacgtcggaaccncgagtgtagttggttacggttacttttaatagtggtctcgtagtaaccaactcctacacgtaacaaaccgacccaatctaacttactttagacggaggacaacgtacgcggtaccctaggttacgggtttctagtcctcttctaccgcggtcctaacgtaacgtgtacggaaccaacgcccgtcctccgtanacctagtccacgttcgcctacacgactgaacgagcgtactagtacgttatattcgacacgtctatacgtatgactaaggtattaaggttacggttacgttacggggtacgggtaccggggacgggtaacggtaacgtcgggttaaccggtgtaaacgggtacgaccgaacccggaaccggtccgacccgggttcccctaacggtccgtaacccgtcgttcccgttaaccccc

SEQ ID NO: 227947 - DNA, 699 bp, Homo sapiens
  misc_feature: GYAE6OF01EJ2ME.23.21.B10.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgtggtacttttaatatggtctcgtagtaccaatacctccaggcaaacgccccaatcatacttatgaggcacgtaagcgcctgagggttcagtcgtcttctcgtggtctaccaagttctacggacaaaccgaccgaccctcccgtacgaacccattccgtccgttcgggacccttccgaaccgtccgttacggaaccgtaaccggaacggtaccttaggtaacttttaagtttaactttacggcttacggccttacgtaatacgttcgacgtaagtaagttaacggttagtttaaccgtttagggtaacgggttaccggggtaccggggggaaacctaaggggttaccgtaacccgggttacgggtaacgggtacccgtaacggaccccggtaaacgggtcccgttcccgggtacccccccgttacggtaccctaaccgttcccgttcggtttaccccccccgg

SEQ ID NO: 227948 - DNA, 718 bp, Homo sapiens
  misc_feature: GYAE6OF01EE08C.23.21.B10.1.454.CMB.1.raw
  modified_base (509)..(509): a, c, t, g, unknown or other
  misc_feature (509)..(509): n is a, c, g, or t
  modified_base (550)..(550): a, c, t, g, unknown or other
  misc_feature (550)..(550): n is a, c, g, or t
  modified_base (566)..(566): a, c, t, g, unknown or other
  misc_feature (566)..(566): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcgaggacacgacgggtcctcgggcccagtctcgccctgactcacgcctcgcctccgtgtcgtggtctcgtgacagtcgatcaccgtctcctgcacgtacggaccgcgtagtcgtagttggtttacggtaacttttaagtgttcggtccgttacggtacgtaacctaacgtacccgtacccgaacggtaacccaaaacccgaccccctaaaacttctaaacgtttaaccttttaaggacggaaccgggactaaaccggtaacggcccggtccttacgggttacggtttcgtacgttccgtctttcgtcgtcgacctaccgtaagtcgtacgaccaacgcccgtccctccgtcgtacctcgtctcgtccgtctacccgngtccgtacgacgcggacgtctagttacttgttactcgtctntaccttctagtacgtntcgtaagttacgttggtttaacttggttacggtacggggcggggtaccgggtaacgtagggttcccgaccgggttaggacgtacggacccggaccgaccggtcccctacccgggtccccttacgcccttcgttcccgtccccgtttcccccg

SEQ ID NO: 227949 - DNA, 693 bp, Homo sapiens
  misc_feature: GYAE6OF01DSJYL.23.21.B10.1.454.CMB.1.raw
  modified_base (234)..(234): a, c, t, g, unknown or other
  misc_feature (234)..(234): n is a, c, g, or t
  modified_base (325)..(325): a, c, t, g, unknown or other
  misc_feature (325)..(325): n is a, c, g, or t
  modified_base (406)..(406): a, c, t, g, unknown or other
  misc_feature (406)..(406): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgccctcgtgtcgtgggtctcctggacagtcgatcaccgtctcctgcacgtcggaacccgntagtgagttggttgggtaacttttaagtagtgttctcgtacgtaccaataccctccaaggaccaaccgacccccaaatctaattacttagngacggcacgaagccgcctgtagggttctagtcgtcttctcgtcgtctactagtcgtagacaacgccgtcctcctagtaccntcctcgtccgaccctccgacgtccgtaagaccggtacgacggttcctagttaactttacttagttcggactttacgtcttaacgtataccttaggaacccgttaagtaacgtttaaggggttacgttttacgggtttacggggtacgggggtttacccgggggaaccgggggtaaccgttaaaggggtcccggtaacccgggttacgtacgggttaccgaaccgtaccgggaccggtcctaccccggtccccgttagtcccgttaccgttccgttcccgtacccccc

SEQ ID NO: 227950 - DNA, 802 bp, Homo sapiens
  misc_feature: GYAE6OF01AQ5EM.23.21.B10.1.454.CMB.1.raw
  modified_base (129)..(129): a, c, t, g, unknown or other
  misc_feature (129)..(129): n is a, c, g, or t
  modified_base (261)..(261): a, c, t, g, unknown or other
  misc_feature (261)..(261): n is a, c, g, or t
  modified_base (520)..(520): a, c, t, g, unknown or other
  misc_feature (520)..(520): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctnactcaggacacgacgggtcctgggaccccagtcctcggccctgacctcacgccgtgccctcgtgtctgggtcctccgtaggactagtcgtactccgtaccgttcctctcggactaccgtacgggaacccccntagggtcgtagtgggttttacggtaacctttttaaagtcgttcggttcgtcggttacggaaccctaagtaccccgtaccgacggaccgaaaccgaccccctaaacgttcctaattacgttagtaggacggtaccacgtaagcccggacttggtacgggtttctagtccgtcttacgtcggtcgtacctaccgtaggttcgacgtacctaaacgcccggtacctccgtacgtaactcgttcgtaccgttcgacccgtacncgtacccgtacggtacggaacgtcggtactgttaacgtttactttgttcggacctttcgtaacccttgtaacggttactacggtttaccgacgttaacggtttaaacgtacggttttacgtaacgggggtttacgggtccggggtaaacccggggggtaacttaacgggtacccggtaccgggtttaaccggtcgggtacggacccgttacccgggaggttacccccgttcccggcccccggtttagttacccgtaccttccccggttaccgttccccccgg

SEQ ID NO: 227951 - DNA, 887 bp, Homo sapiens
  misc_feature: GYAE6OF01DE8DZ.23.21.B10.1.454.CMB.1.raw
  modified_base (252)..(252): a, c, t, g, unknown or other
  misc_feature (252)..(252): n is a, c, g, or t
tcagacgcgagtatcacgaccggtgctcgatttagtgtcgtcgcaagaggaggagggggggggtcacaagaggcagcgctctcgggacgtctccaccatggcctgggctctgctgcctcctcactctcctcactcaggacacgagggtcctgggcccagtctgccctgactcacgcctgcctccgtgtcgtcgggtctccgtaggacagtcgacttccgaccgtctccgtcgacctacgtaccggaaccccngtaggtacgtagttacggggtttacgggttaactttttaagtacgttcgggttaccgttaccgggttacggtaaccctaaacgtttaccccgttacccgaacggaccctaaaaccccggtaacccccctaaacctttacctaaacggtttttaaccttttaggaccgggtaacggtaaccgtaacccggttaaaccgggtccccgggtaccccttttaggggtttaaccggggttttaccgttacgggtccctttccgttttcgttcgttccgggtacctttaccgtaacgggttcgtacggaacctaaacccgacccggttcccctaccggttacaacccttcgttacctccgtacccggacccttacccgacgtcccgttacggaccggtaacgtacgttcttaagttactttagtttacgtcgtcgtcgttaccttagtacttacgggttacgactttaacggtaacgtttacggttttaacgggttacgggtttacggtaccggggggtttacccggggaagggggttaaccctaggggtacccggtcggttacggtcggttacccgaacggtcccggaacggttcccgcccgttacccggtcttacgtccctccgggtttcccctccccg

SEQ ID NO: 227952 - DNA, 966 bp, Homo sapiens
  misc_feature: GYAE6OF01EWYER.23.21.B10.1.454.CMB.1.raw
  modified_base (235)..(235): a, c, t, g, unknown or other
  misc_feature (235)..(235): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatccaccgtctcctgcacgtcggaaccccgnagtgagttggtttagggtaactttttaatagttggttcttcggttacggtaacctaactaccctcccgaaggaccaaaaccgaccccccaaaacttctaatttaaccttttagtacgggaacggggacctaaaccgtaaacggcccggtaccccgttacggtacgggggtttttaccttaacggttcccgtccgttttccgttccggttccggtacccttaacccgtaaacgggttccgtacggggtaaccctaaaacccggtaccccgggtaccccctttacccccgtaccggtaacccctaacgtttcccgttacccggttccgggtccccttaccccggtaacggtccccgttacgggaaacccgggtaccgggtaacgggttccgttaaggtttaaacttttaacgtttttaacgtttccggtacccgtttcggtacccgttaacgtttaacttacggttaccggaacgttaaaggttaacggttttaaacgggtttaacggtttttaaccgggttttacgggggtaacggggggtttacccgggggggtaaaccgggggggtaaaccgttaaacgggggtttacccgggtaacccggggtttacgggttaaccgggttacccggaacccgggtaccccggttaaacgggtcccccgttaccccgggtcccccccggtttacgggtaccccttacccggtttcccgttccccgtttaaccccccccg

SEQ ID NO: 227953 - DNA, 884 bp, Homo sapiens
  misc_feature: GYAE6OF01C50YZ.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcacggacactacgggtcctcgggcccagtctcgccctgactcagcctcgcctccgtgtcgtcggtcctccgtggactgtcgactccgaccgtctcctcgcacgtaccggaccgcagtgtacgtggttagttaactttaataggttcggtcgtacggtacgtaacctaaccttacccgtaccgaacggaaccaaaccccgtaacccccctaaactaaccttaacgtttaaccgttttaagaggtaaccgggtaaccctaaacggtaaccgggtcccgggtaccccgttacgggtttacggggtttacctacggttccgttcctttaccgtccgttaccggttaccgtaaccccggtaaaggttcccgtaaccggggaaaccccgtaacccgggtaccccggttaccccgttacccccgtttaacgaaacccgttccggttacccttcccgggttaccgggtccccgtacccgaccggtacccgtacggaaccgggtacggtacggtacttacgttaatttcgttaagttccggtactcgtacttactacgttgtacgtaacgttaagtacggtttaacgttacggtttcggtttaacgggtacgggggttccgggaaccgggggtaaccgtaacgggtaccgggttacggtaccgggtaacggtcccggtaacccggtacccggtaaccggtccccgtacccggtccccgttaccggtcccgttaacccgtcccggtttcccgttaccccccg

SEQ ID NO: 227954 - DNA, 730 bp, Homo sapiens
  misc_feature: GYAE6OF01EBWVO.23.21.B10.1.454.CMB.1.raw
  modified_base (232)..(232): a, c, t, g, unknown or other
  misc_feature (232)..(232): n is a, c, g, or t
  modified_base (314)..(314): a, c, t, g, unknown or other
  misc_feature (314)..(314): n is a, c, g, or t
  modified_base (398)..(398): a, c, t, g, unknown or other
  misc_feature (398)..(398): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgnagtgattggttaggtacttttatagtggtctcgtggtaccaataccctccgaggtacaaacgccccaaactcatactttagnggaggcactagccgcctagtgggtttctagtcgtcttctcgtcggcctacgtaagtcgtggactaaccgaccggtcccttcccngtaccctattcctccggtcggccctcccggacgtcccgttacgggaaccgtaccggtaggtaccgttaaggtaacttttacgtttaacgttgccttcgacgttctaacgttagtacgactaaggtacgttaagggtttacgtttaacgtttggggtacggggttacggggtaccggggggtaaaccgttagggttacccggtaaccggggtttacgggtaacgggttcccgtaaacgggtccccggtaaacgggttccccgtaacccccggttccccccgggttaccggtttaaccctaccggtttccccggtttaccccgttacccccccg

SEQ ID NO: 227955 - DNA, 672 bp, Homo sapiens
  misc_feature: GYAE6OF01CPRE7.23.21.B10.1.454.CMB.1.raw
  modified_base (222)..(222): a, c, t, g, unknown or other
  misc_feature (222)..(222): n is a, c, g, or t
  modified_base (365)..(365): a, c, t, g, unknown or other
  misc_feature (365)..(365): n is a, c, g, or t
  modified_base (494)..(494): a, c, t, g, unknown or other
  misc_feature (494)..(494): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagccctgcctcgtgtcgtgggtctccgtggactgtcgactcaccgtctcctncacgtcggaccgcagtgatggttaggtactttatagtggtctcgtgtaccaactcctccgagaccaaccgccccaaactctattactttagcggacggctaacgtacgccggtccgtagttacgggttctacgttcgtccttntcgtacggtctaccgagtctacgaccaacgcccggtcccttaccgcgtactactctcgtcggccctacgcgtaccgtcgaacccggtacggtacgtacggttatacgttttaagttacttcggtccgtnttcccgtttagattactgggtaacctaagttagttacggttaggttacgtttacgggtcggggttaccgggggacgggtaaacgtgggtaccggtacggtcggtaaacggtcccgacggtacccgacggtcctccccggtcccctttacggaccttaccctcgttaaccccgtccccc

SEQ ID NO: 227956 - DNA, 743 bp, Homo sapiens
  misc_feature: GYAE6OF01DNQ0C.23.21.B10.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctncacgtcggaacccncagtcgtatggttaggtacttttaatagtggttccttcggttacggtaacccaacttaccccgtacccgaacggaccctaaaacgaccccccctaaaacgttcctaaactttaaccttttaagtcgggaacggggacctaaaccggtaaaccggccgggtaccccttacggttaacggggtttcctacggtcctcttcctcgtcggtcctacgtaagtccgtggaccaaccgtccggtaccctcccgtacgaccctattccgtcgccggtcccctaccgaccggtcccgtacggacccgtacggacggtccgttagtaactttagttacgttcgtcgtcgtacccttcacgttagtcgaactagtaagttagttacgtttacgttacgggttacggggtcgggtaccggggtaaccgtaagggttccggtacggttacggtacggtacgacggtacccgaacggtcccgacccgtccccgtacgtaccctccgtccgttcccggtaccccc

SEQ ID NO: 227957 - DNA, 750 bp, Homo sapiens
  misc_feature: GYAE6OF01CZBCG.23.21.B10.1.454.CMB.1.raw
  modified_base (238)..(238): a, c, t, g, unknown or other
  misc_feature (238)..(238): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtcctcgccctgacctcagcctcgcctccgtgtcgtgggtctcctggacagtcgatcaccgtctctgccacgtcggaacccntagtgagttggttaggttactttaatgtcggtatcggtacgtaacctaactaccctccgaaggaacctaaaccgaccccctaaagtctaacttaaccgtttagacggaacggctaaacgtacggtcccgtccttacggttaacgggttcttacgtccgtcttcgtacgtcggtactacctaagtctacggaaccaaccgccggtaccctcccgtacgtaacctaccgtctccggtccggtaccctaccgaggtcccgtagaaccggtagacggttactagttacttacttgtccggattcgacttacgtaattcgtacgccttaaggtactttaacggtacggtttaacgtttcggggtaccggggggtttaccggggaacggggttaaacccgaggttcccgggtaaaccgggtcgttacgggaaacccaccggtacccgggtaaacggtccccgtacccgttacccggtccggttaccctaccgtttcccggttaccccgttaacccccg

SEQ ID NO: 227958 - DNA, 834 bp, Homo sapiens
  misc_feature: GYAE6OF01EAY6H.23.21.B10.1.454.CMB.1.raw
  modified_base (478)..(478): a, c, t, g, unknown or other
  misc_feature (478)..(478): n is a, c, g, or t
  modified_base (785)..(785): a, c, t, g, unknown or other
  misc_feature (785)..(785): n is a, c, g, or t
tcagacgcgagtatcacgaccggtgctcgatttagtgtcgtcgcaagagaggagggggggggtcacaagaggcagcgctcgtcgggacgtctccaccatggcctgggctctgctgctcctcactctcctcactcgacggactacgacgggtccgtcgggccctaggttccttcggcccttagacctacgacgtccgttcgtcccgttccgttggttccgtcgggttcctcccgtgggacctacggtcgtactccgtaccgttcctccgtcgaccgacgtacgggaacccgtcgtaggttcgtaaggttcggtttaacggtaactttttaagtacggttcggttccgttacgggttaccgtaaaccctacgtaccctaccggagtaaacccaaaccccgtaccctaagtcttaacgtttaacgttagtacggggacgtaccaaaccgtacgggccttccgttaagggttacccgggttnttacgtccgttcttctcggccgttactacgaccggttgtaccgaccgtaacgtccgtccaccgtagcttacctcgtccgtaccgtcccgtaccgacgttccgacggacgtacggagttcgtaacttacggtttaactctccggtactcgtaccttacgtaatcgaaccgtagacgtttaacggtacgtttaacgtttcgggttaacgggggtcgggtccccggggggttaaacggtaccgtaagggttccggtaacccggtttaggaccggttacccgggaaaacgttcccggaaacgggttccccncccggttacccggccgttaactccggtttcccacccgtttaaccccccg

SEQ ID NO: 227959 - DNA, 836 bp, Homo sapiens
  misc_feature: GYAE6OF01D3ZOJ.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacaggtcgatcaccgtctcctgcactcggaacccgcagtgatggttaggtacttttaatatggtctcggtagtacctaactaccctaccaggaccaaaaccgaccccctaaactctaacttacgtttagacggaacgggccaacgtaacggcccggtacccttacgtacggggtttctacgtccgtcctttacgtccgtggaccttaccgtaagtcgtaggacccaaccgtcccggtccccttacccgtagaaccctaatttcccgtcgttacccggccccgtacccgtacggtcccgttaacgggaacccggtaacgggtacggtacttaacggttaattttactttaacggttccgtcgttaccgttctacttagttaacgacgtaaccgtaaggttacgtttaacgggttttaaccttttacgggttttacgggggtaacccgggggtttccggggggaaacccggggggtaaaccgtaacgggggttcccgttaaaccgggggttaccggtaaccgggtaccggaaccccggttaacccgggaaaccgggttcccccgtaccccccggggttaccccggttaccccgggttacccctttaaacccggttccccgtttcccgttaacccccccccg

SEQ ID NO: 227960 - DNA, 603 bp, Homo sapiens
  misc_feature: GYAE6OF01DYTNB.23.21.B10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (296)..(296): a, c, t, g, unknown or other
  misc_feature (296)..(296): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacngtcgatcacgtctcctgcactcggaacccnagtgatgttggacttttaatatggtctcggtgtaccaatacctccagcaaacgccccaatcatacttangaggcacaagcgcctgagggtttctagtcgcttctctgctaccaagtctggcaacgacgtcctccgtgaccatccgttctcggcctaccgacgtccgtggaaccgacgaggacttaggtactttagttattcggtctggtcccttagtaattactcggaaccaggtacttaaggttacgtttactttcgggtacgggtttcggggacgggggtacctaaagggtcgtaccggttacgggtacgtacgaacggtcccgaggtcctaccggtcccccgttacgggtcccacgttccctcggttaccccc

SEQ ID NO: 227961 - DNA, 909 bp, Homo sapiens
  misc_feature: GYAE6OF01AQWRM.23.21.B10.1.454.CMB.1.raw
  modified_base (252)..(252): a, c, t, g, unknown or other
  misc_feature (252)..(252): n is a, c, g, or t
  modified_base (569)..(569): a, c, t, g, unknown or other
  misc_feature (569)..(569): n is a, c, g, or t
tcagacgcgagtatcacgaccggtgctcgatttagtgtcgtcgcaagagaggagggggggggtcacaagaggcagcgctctcgggacgtctccaccatggcctggctctgctgctcctcactctcctcactcaggacacgaggtcctgggcccagtctcgccctgactcacgtcctaccgtccgtgtccgtcgggtctccgtggacacgtcgtactcctaccgtctccgtcgacctacggtacggaacccgngtaggtagtacgttcgggtttaacggttaacttttaagtacggttcggttaccttcggtaacggtaaccctaaccgtaccccgttcccggaaggtaaccctaaaccggtaccccctaaagttacctaacttaaccgtttagacgggtaccgggacctaaaccgtacggcccgtacccgttacgggttacgggttctacgtccgtctttccggacgttccgggtacttaccgtacggtccgtacggtaaccgtacccggtacccgtcccgttacccgtaacgtacccttacggttcctacccgggtaccgttaccccncccgtaacggtcccggtacggtaaccgggacggttacggtaccttaagttaacgttttaaccgttacggttacggcctttaacgtaccgtaaagtttacccgttaggaaccgttaacgtaaacgtttacgttaaaccgggtttaacgttttacggggttaaccgggggttaccggggtacccggggtaaccggggtaccgttaacggggtacccgttaacgggtaccgggttacggtaacccggtaacccggtaccggttaaccgggttcccccgtaccccgttaccccgggttactacccgttaacccgttcccgttacccccgttaccccgtaccccg

SEQ ID NO: 227962 - DNA, 789 bp, Homo sapiens
  misc_feature: GYAE6OF01C4VX8.23.21.B10.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctggtctctggacagtcgatccaccgtctcctgcacgtcggaacccnacgtgattggttaggttactttaagtagtcggtcttcggtacgtaaccaacgttaccctaccgaggtaaccaaacgaccccctaaagtcctaacgtttaacttttagcggaacgggacctaacgtaacggtccggtcccgttacggttacggggtttactacggttccgttaccttccgtacgttcggtccttacccgtaagttccgtacggactaaccgaccggtccccttacccgtagaccctacttcccgtcgttccgccctacccgacgtcccgtaggaccggtaacggtacgtacgttacgttaacgtttagtttacgttacggtccgttacgtccgttaactaacgttacgtacgaaccgtagttaacgttaacggttaacggtttacggtttacggggtaacgggtttaccgggggaaccggggtaaaccggttacgggtacgggttaccggttaccgggtacggtaccggtaccgggtacccgtaacggtccccgttaccgtaccccccggttacgttaccgtacccgttccgttacccgttaaccccccg

SEQ ID NO: 227963 - DNA, 828 bp, Homo sapiens
  misc_feature: GYAE6OF01EP6HS.23.21.B10.1.454.CMB.1.raw
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacgagggtcctgggcccagtctcgccctgactcagcctcgcctcgtgtcgtggtctcgtggacagtcgactccaccgtctcctgctacgtcggacccgcgagtgtagttggttacggtactttttaagtagtcggtctcggttacggtaaccaactacccgtccgaggaccaaacccgacccccaaactctaactttacgtttacgtaggacgggacctaacgtaacggccggtacccgttacggtacgggtttctacggttccgtctttccgtcgttcggacctacgtaacgttcgtacgaccaaccggtaccggtcccctacccgtcgtaaccctacgttcccgtccgtaccggtcccgtacccgtaccgtacccgtacggaacgggaaccgggtacggtacgtttaacgttaacgttttacgttttaacgttcggtaccgtttacgtaccttaacgttactagttaccgagttaacgttaacgttaaggttacgttttaccgggtttacggggtaacgggggtttaccgggggaccggggggtaaacgttaaccggggtccgggttaaacccgggttaccggttacgggtacccggaaaccggtaccccggtaacggtccccggttacccggttccccccggttaggtaccccgttaccgttccccgttaacccgggttccccccc

SEQ ID NO: 227964 - DNA, 598 bp, Homo sapiens
  misc_feature: GYAE6OF01CRY6N.23.21.B10.1.454.CMB.1.raw
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtgacagtcgatctaccgtctcctgcacgtcggaacccgcagtgagtggttggtactttaatgtggtctgtgtaccatacctccgagaccaacnccccaanctatattngagcacgacgcgtcctgtaggtttcagcgtctcgctcgctacagtcngacacgtaccgcctcctacgacctacttccgactcggccctacgacggcctaggaaccggacggtacgtacgttacgttaagtttacttagttccgtcttcgtaccgttacagtaatcgtaatacgtaagtacgtttagtttacggttggtacggggtcgggacgggacgtaacggcggtacgtacggtcggtaccgacgccgacgtccgtcccggtcccgtcgccctacgtccgtacccgttccccg

SEQ ID NO: 227965 - DNA, 845 bp, Homo sapiens
  misc_feature: GYAE6OF01BMTF6.23.21.B10.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacgagggtcctgggcccagtctgccctgactcagcctgcctcgtgtctgggtctccgtggacagtcgatccaccgtctcctgcacgtcggaacccgntagtcgattggtttagggtaactttttaatattcggtcgtcgttacggtaacctaacttaccctcccgaggaccaaaaccgaccccctaaaactctaacttactttagtcggaacgggacctaacgtaacggcccggtacccttcggtaacggggttttctacggttccgtcgtttaccgtccgttcgggtaccttaccgaaggttccgtacggaacctaacccggtaccggtcccttccccgtacgacccttacttcccgtcgtccgggtccctaccgacgtccccgtaggaacccggacggaggttaccgttagtaaacttttactttacgttcgtccgttcgtcctacgtaattcgtaccggtactaacggttaacgtttaaggtttaacgggttttaccgttttagggggtaacccggggggtttaccggggtaaccggggggtaaacccgttaaggggttacccggttaacccggggtttacggggtaaaccgggttcccggaaccgggttaccccggtaacgggttccccgttacccgggttacccccccggtcggtttaccctaacccggttttcccgtttccccgttaccccccgtaaccccc

SEQ ID NO: 227966 - DNA, 716 bp, Homo sapiens
  misc_feature: GYAE6OF01DOX17.23.21.B10.1.454.CMB.1.raw
  modified_base (247)..(247): a, c, t, g, unknown or other
  misc_feature (247)..(247): n is a, c, g, or t
  modified_base (491)..(491): a, c, t, g, unknown or other
  misc_feature (491)..(491): n is a, c, g, or t
  modified_base (540)..(540): a, c, t, g, unknown or other
  misc_feature (540)..(540): n is a, c, g, or t
tcagacgcgagtatcacgaccggtgctcgatttagtgtcgtcgcaagagagggagggggggggtcacaagaggcagcgctcgtcgggacgtctccaccatcggcctgggctctgctgctcctcactctcctcactcgacgacacgacgggtccgtcgggcctcgtcgtcgaccgtagactcgcgctcgctcgtgtcgtggtctcgtgacgtacgtcgactaccgcgtctcgtcgacacgtcgaccgngtagtacgtagtcggttacgttaactttaagtcgtcggtcgtacggtaacgtaacaacgtaccacgaaacgacctaaccgacctaattactaacgttacttcggacggaacgtactacgtaacggccgtacggttacgttaacgggttctacgtcgttactcgtcgacggtactacgtacgtcgtacgacgtaaccgtctaccgtaccagtacctacttccggtccgaccttaccgacggtacncggtaacggacgtaggtcgttaacttagtttaactatttacggctacgnttacagttactcgagtactaaggtattttaagttcggtacgtttaggggtccgggaacgggtaccgggtaagtcgggtaaccgttaggtccgggttaaacgacgacccggttaacggttacccgccgggttttccccaccgggtcttaacgttccccgtttgtaaccccgtccccg

SEQ ID NO: 227967 - DNA, 780 bp, Homo sapiens
  misc_feature: GYAE6OF01CVN9Z.23.21.B10.1.454.CMB.1.raw
  modified_base (211)..(211): a, c, t, g, unknown or other
  misc_feature (211)..(211): n is a, c, g, or t
  modified_base (254)..(254): a, c, t, g, unknown or other
  misc_feature (254)..(254): n is a, c, g, or t
  modified_base (502)..(502): a, c, t, g, unknown or other
  misc_feature (502)..(502): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacacgggtcctcgggcccagtcctcgccctgactcacgcctcgcctccgtgtcgtcgggtcctccgtggacngtcgactccgaccgttcctccgtgacctacgtcggaacccgtntagtgtagttggttacggttaacttttaagtacgttcggtacgtcggtacgtaacctaacctacccgtaccgacggaccaaaccgtaccccaaacttctaactttacgttagtcggacggtactaaccgtaaccggtccggtacccgttcgggttacgggtttactacggtccgtccttcgtcgtacggtcctaacgtacgtccgtacggaccctaaccgtccggtcccctaccgtaccgaacccgtnttcccggtacgtccggtccctaaccgtcggtacccgtacgggaaacccgtacggtcggtaaccttaaggttactttacgtacgttcgcccgtgttacccttagtaacgttacgtcgaacgtaagttagtttacgtttaggtttaccggttagggtaccggggttcggggaaaccgggttccgacgggtcgtacccggtaggtaccggtacccgaaccggtcgaccgttccccggtcctaccccggtagtacccttcccggtcccgttcccgtcccccg

SEQ ID NO: 227968 - DNA, 814 bp, Homo sapiens
  misc_feature: GYAE6OF01B0005.23.21.B10.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagaggagggggggggtcacaagaggcagcgctcgtcgggacgtctccaccatggcctgggctctgctgctcctcactctcctcactcaggacacgagggtccgtgggcccagtctcgccctgactcgagcctcgcctccgtgttcgtgggtcctccgtggactagtcgatccgaccgtctccngacgactacggaacccgcgtagtgtagttggttcggttaacttttaagtagttggttccttcggttacggtaacctaaaccgttccccgtacccgaaggaaccaaaaccgcccccctaaaactccgtaattaactttacgaggacggaccaacgtaacggcccggtacccttcgggtacgggttttacctacggtaccgttccttacgtccgtggtaccctaaccgtacgtccgtacggaacccaaccgtaacccggtcccttaccccggtacgtaccctaaccttccgtaccggtcccggtcccctacccgtaccgtcccgtacgggacccggtaaccgacggtacgtaacgttaattttacgttagttccgtacgtcggttacctactagttactaagtaccgaaaggttacgtagtttaacggttaccggtttacgggtaccgggttacggggtaccgggggtaacggttaacgggttaccggtaccgggtaccggttacggtacccggtacggtacccgaccggtcccgtacccggtacccccgttcgtaccctccgtttacccgtccccgttacccccg

SEQ ID NO: 227969 - DNA, 889 bp, Homo sapiens
  misc_feature: GYAE6OF01DVBET.23.21.B10.1.454.CMB.1.raw
  modified_base (238)..(238): a, c, t, g, unknown or other
  misc_feature (238)..(238): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgacgggtcctgggcccagtctgccctgactcagcctgcctccgtgtctgggtcctccgtggacagtcgactccaccgtctcctgccacgtcggaacccntagtgagttggttaggtaacttttaagtagtcggtcttcggtacggtaaccctaacttaccctccgaaggtacccaaaacgcccccctaaaacttctaatttaaccttttagacggtacgggacctaaacgtaaccggccggtaccccttacggttacggggttttacctacggtcctcgtttcctcgtcggtcctaccgtaagttcgtacggacctaaccgtacccggtccctacccgtacgaaccctacttccgttaccgtccgggtaccccttaccgaccggtaccccgtacggaaaccggtaaccggtacggtacttaacggttaacttttacgtttaacgttccgtacgttacgtacccttacgtaacgtttacgtacgtaacgtaacggttaacgtttaacgggtttaaccggtttacgggttttaaccggggttaacggggttacccgggggggtaaccggggttaacccggtaacggggtacccgggttaacccgggttaccggggtaaccgggttaccccggaaccccggggttaccccgtaaaccccggggttcccgttaacccccggggttccccccgttttaccgggtaccccgtttaaaccccggtttccccggttaccccccggtttaacccccccg

SEQ ID NO: 227970 - DNA, 823 bp, Homo sapiens
  misc_feature: GYAE6OF01C1G43.23.21.B10.1.454.CMB.1.raw
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggccctagtctcgccctgactcagcctcgcctcgtgtcgtgggtcctccgtggacngtcgatccaccgtctccgtgctaccgtcggaacccgntagtgtagttcggttagggttaactttttaaatacggttggttccgttacggttacggttaaaccctaaaacttaccccgtacccgaacgggaacctaaaaacccggacccccctaaaaccttcttaaactttaaccgttttaacggtacgggaaccgggtacctaaaaccggttaaccggccccgggttaccccgttacgggttaacgggggttttacctacggttcccgttcctttcgtaccgtcggtaccttaccgtaaaggttccgtacgggacctaaaccggcccggtcccttacccgtagaaccctagttccgtacgttccgggtcccctaccgtaccgtccgtacggtaaccgacggtacgtacgttaagtattttagtaacgttcgtccgtgtacctagacttatcgagtaagttacgttaggttaacgtttacggtttacgggtacggggtcgggaaccggggtacggtaacgggtccgtaccgggttacgggtacggtaccgtaaccggacccgagggtcccgtcccgtaccccggtacgtcccgtacgtcccgttacccggttcccccg

SEQ ID NO: 227971 - DNA, 930 bp, Homo sapiens
  misc_feature: GYAE6OF01BMARK.23.21.B10.1.454.CMB.1.raw
  modified_base (261)..(261): a, c, t, g, unknown or other
  misc_feature (261)..(261): n is a, c, g, or t
tcagacgcgagtatcacgaccggtgctcgatttagtgtcgtcgcaagagaggagggggggggtcacaagaggcagcgctctcgggacgtctccaccatggcctggctctgctgctcctcactctcctcactcaggacacgacgggtcctcgggcccctagtcctcggccctgacctcacgcctcgccttccgtgtcgtcggtcctccgtggacgagtcgactccgtaccgttcctacctcgcctacgtacgggaaccccgngtacgtgtagttgggttacggttaacttttaagtcgttacggttcgtccggtaaccgtaacctaacttaccccgcccggtaacgtaaccaaccccgtaaccccccctaaactaccttaacgtttaactttacggtacgggaaccgggtaacctaaccggtaaccggtcccgggttcccgttacgggtttacggggttttactacggttccgttcttcccgtacggtcggtaaccgtacccgtaggttcccggtaagacccgtaacccggtcccggtcccttacccgtacgtacctacgttcccgtaccggtacccgtcccgtaccgtaccgccggtaacgggaccgtaacgggtccggtattacgttactttagtttacgttcgtaccttcgttacctagttaacgtacggtacgtaccgttaagttaaaccggtttacgtttaaccggggtttaacggtttaacgggggttacccgggggttaccgggggggtaacccggggtaaacgggttaccgggtttaacggggaacccgggtttcgtaacccggggtaacccgtttacccgggacccccggttaccgggaccccggtttacccccggtacccccggtttacccgggttcccgttaccccgttttccccgggtaacccccgtttacccccccgg

SEQ ID NO: 227972 - DNA, 699 bp, Homo sapiens
  misc_feature: GYAE6OF01D50KK.23.21.B10.1.454.CMB.1.raw
  modified_base (243)..(243): a, c, t, g, unknown or other
  misc_feature (243)..(243): n is a, c, g, or t
  modified_base (512)..(512): a, c, t, g, unknown or other
  misc_feature (512)..(512): n is a, c, g, or t
  modified_base (542)..(542): a, c, t, g, unknown or other
  misc_feature (542)..(542): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctggcccagtctcgccctgactcagcctcgcccgtccgtgtcgtgggtcctccgtggacagtcgactccaccgtctcctgccacgtacgaacccgnagtgtagtggttgtaactttatagttgtcgtcgtaggtaaccaactaccctccgacgaccaaaccgtaccccctaaactcgtactttaactttagtcgggtaacggactaaccgtaacggcccggttacccgttacggttaacgggtttcgtaacgtccgtctttacgtcgtcgaccgtacctacgtcgtggaccctaaaccgccggtcccctccgtcgacctctccgtcgtcgccctcgacgcgtacgacggacgtacggctgtattnttacgtgacttcggaccttagtacttaggntaacgtaactagtttaacggttaagtttaccgtttagggttcggggtacggggtaccggggaaccgttggggtaccgtaacgggtcggtacggtaccgacggcccggtacgcccggtcctacccgggtcctactcccgttcctcccgttaccccccg

SEQ ID NO: 227973 - DNA, 770 bp, Homo sapiens
  misc_feature: GYAE6OF01C8XGO.23.21.B10.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgcctgactcagcctgcctcgtgtcgtgggtcctcgtggacagtcgactcaccgtctccgtnacctacgtacggaaccgntacggtgtagttggttcggttaacttttaanagttggtctacggtcgtaacctaacgttacccgtaccgacggaaccaaaccgtacccccaaactactactttaactttagcgggaaggacctaaccgtaacggccggtaccttacgggttacggggtttacctacggtccgttaccgttcctacgttcggtacccttacgtaacgttcgtacgaccgtaaccgcccgttacctcccgtacaccgtacgttaccgtcgttccggtccctacgtccgtaccgtaggacccggtacggcggttaactaaggttacttttaacgttcggttcgtacgtcgttacctacgtacgtacgttacaacgtagttagtttaacggtggttttaaccggtgggttaccggggttcggggtaaccggggtacgtacgggttaccgtcggtaccgggtaggtacccgtaccggaccgtaaaccggcccggttaccccggtcccgttcgggttacttaacccgttccgttccccggtacccc

SEQ ID NO: 227974 - DNA, 796 bp, Homo sapiens
  misc_feature: GYAE6OF01E4LWF.23.21.B10.1.454.CMB.1.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
tcagacgcgagtatcacgaccggtgctcgatttagtgtcgtcgcaaggagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtgattggttaggtacttttanatggtctcggtgtaaccactaccctccgaggacaaccgccccaaatcattactttangagcactaagccgcctgtagggtttctagtctcttctcgtcggcctacgaagttcgtacggaccaacgtaccggtcccttacccgtacgaaccctattccgttccgtccgggtacccctcccgaagtcccgtaggaacccgtacgggtacgtcttagttaattttaacgtttacgtttcgcctttggtacccttacgttaacgttacgtacggaccgtaaagggttaacgtttaacgggttaaccggtttttacgttttacggggtaacgggggttttacccgggggggtaacccggggggggtaaacccttaacgggggtttaccgggaaaccccgggttttccggggttaaccgggtacccgtaaacccggggtacccccggttaaacgggggtcccccgtttaacccccgggtccccccgggtttaccgggttaaccccgtaccccgtttttccccggttccccgggttttacccccccccg

SEQ ID NO: 227975 - DNA, 662 bp, Homo sapiens
  misc_feature: GYAE6OF01B8ZMZ.23.21.B10.1.454.CMB.1.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (240)..(241): a, c, t, g, unknown or other
  misc_feature (240)..(241): n is a, c, g, or t
  modified_base (611)..(611): a, c, t, g, unknown or other
  misc_feature (611)..(611): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcgaggacacgacgggtccgtcgggcccagtcctcggccctgactcacgtcctcgcctcgtgtcgtggtctcgngcngtcgctccaccgtctctcgcacgtacgaccnngtgtgtggttaggtactttagtgtggttcctcggtacgtacctaacgtccctaccgacgaaccaacccgtacccctaatctaactttacgttagcggaacggtactaacgtaccgtccggtccgttacggttacgggtttctacggtcttaccgttcgtcgtcgtactaccgtagtccgtacgacgaccgtccgtcctccgactactcttccgtcgacccgtcctccgacgtcgacggacgtacgcgtagtatagtttactgttcgctactcgtacaagtcacgagtaagttagtaggttacgttcgggttacggtcggggtacgggaccgggtaacgtcgggtaccggtccgtagtccggagacccggnggtacccgcgtccccggtaccgttcgtacgtcccgtcgttccccgtacccg

SEQ ID NO: 227976 - DNA, 905 bp, Homo sapiens
  misc_feature: GYAE6OF01BAD47.23.21.B10.1.454.CMB.1.raw
  modified_base (247)..(247): a, c, t, g, unknown or other
  misc_feature (247)..(247): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctcgggcccagtctcgccctagactcacgcctcgcctccgtgtcgtggtctccgtggactagtacgatcgaccgtctcgtacgctacgtacggaacccgntacgtgtagttacgggtttaggtaaactttttaagtgttcgggttaccttacgggttaaccggttaaacctaaaccgtttaaccccgtacccggtaaacggggaaaccctaaaaacccccgggtaaccccccctaaaaactttaccggtaaacttttaaacccgtttaaagggttacggggaaaccgggtaacctaaaacggtaaaccggccccgggtacccgtttacggttaaaacgggggttttcctaacgttccggttacctttaccgtccggttacggtacccgttaaccggtaaacgttccgtaacggggaaacccaaaccgggttaaccccggccccctttacccgacggtaacccctaacttcccgttacccggtacccggacccgtttaccccgaacggttacccgtaacgggaacggtaaccggtacgttacgttaaggttaactttaagtttaaccgttcggactacggtacttacgtaaggtactacgacgtaaggtaacgttaacggttacgtttaacgttcggggtacggggttaccgggaacggggtaaccgtaagggtaccgtacggtacggtacgaccggtaacgaccgggacgtccggtccccgtaaccgtcgttacccacctttccgtacccggtccccc

SEQ ID NO: 227977 - DNA, 774 bp, Homo sapiens
  misc_feature: GYAE6OF01AIKAB.23.21.B10.1.454.CMB.1.raw
  modified_base (244)..(244): a, c, t, g, unknown or other
  misc_feature (244)..(244): n is a, c, g, or t
tcagacgcgagtatcacgaccggtgctcgatttagtgtcgtcgcaagagaggaggggggggtcgacaagaggcagcgctctcgggacgtctccaccatggcctgggctctgctgctcctcactctcctcactcaggacacgacgggtcctgggcccagtctcgccctgactcagcctgcctccgtgtctcgggtctccgtggacagtcgtactcctaccgtctcctgactacgtcggaacccgnaggtgagttgggttaggtaacttttaagtgttggtccttcgtacggtaacctaagtaccctccgtaacggacaaaccgccccctaaactcctagttaacctttagtcggacggtacacgtaacggccgtcctacgtaggggtttctacgtcgtccttctcgtacggtccttaccgtaacgttccgtacggaccctaaaccgccggttacccccgtaccgttaccggaaacctccttaccgtccgtacgtcccgtaaccgtccgtaccgtacgggacgaaccgtacggtcgttacgtatttacgttactcggtactccgtcttacgattacgtatacgtaagtacggttaagttaaggtttccgtttaaggggacccggggtttaccgggaaccgggggttaaccgacggggtttccgaaacccggggttgttaaccgggaccgtaacccggtacccgttacgggacccctttccccgggacccccggttccgtacccgttacccgttcccggttcccgtttaaccccccg

SEQ ID NO: 227978 - DNA, 782 bp, Homo sapiens
  misc_feature: GYAE6OF01C2LDD.23.21.B10.1.454.CMB.1.raw
  modified_base (201)..(201): a, c, t, g, unknown or other
  misc_feature (201)..(201): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctcgccctgactcagcctgcctccgtgtcgtggtcctctggacngtcgatcctaccgtctctgcacgtacggacccgcagtgagtggttaggtacttttaatgtggtctcgtgtaaccaacgttaccctccgaggaccaaaccgacccccaactacgtacttactttagcgacggtacacgtaacggccgtccgtagtacgggttctagtccgtccgttcgtcgtcggtcctaccgtaacgtccgtacggactaaaccggtccggtccccttcccggtacaaccgtcgttacctcggtccggtacccttaccgacccggtccgtaaccggaacccggacggtacggtctttaacgtactttacgttacgtacgttcgtacgtaccttacgtaatccgtaggtactaacggttaatttacgggtttaccggtttacggtttacgggttaacgggggttacccggggggtaaccgggggttaaccgtaaacggggtcccggggttaacgggttaccgggtttaacgggcccggaaaccggttcccccggtaacgggttcccccgttacccccggtccccggttaccggtaccgtttacccgtcccggtttacccccgtacccccccg

SEQ ID NO: 227979 - DNA, 728 bp, Homo sapiens
  misc_feature: GYAE6OF01CKXA6.23.21.B10.1.454.CMB.1.raw
  modified_base (329)..(329): a, c, t, g, unknown or other
  misc_feature (329)..(329): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacgacgggtcctgggcccagtctgccctgactcagcctgcctccgtgtcgtggtctctagacacgtcgatcaccgtcctcctcgccactcggaacccgcgagtgagttggttaggtacttttaagtagttggtcgtcgtacggtaacctaactacctaccgagaccaaccgaccccaatcattacttagngacgactactacgcgtaccgtggtaggttctacgtctcttcgtcgtcgtctacgagtctcgacacgccgcctctcgacctctctcgtccgacctccgacgtccgtacgacggtacgtacggtactacgttatttacgttagttcgtcgtactctaacgtattacgacgtaacgtacgttaagttaacgtttaacgttcgggtttaacggttacggggggtacccggggtaacgggggaacccgttacgggttaccgggtaacccggggtttccgggttaacgggacccgggttaaacccggtaccccgggtaaacgggttccccgtaaccccccgggttcccccggtttaaccggtaccctttaccccggtttaccgttccccccggttttaacccccg

SEQ ID NO: 227980 - DNA, 736 bp, Homo sapiens
  misc_feature: GYAE6OF01B806W.23.21.B10.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (464)..(464): a, c, t, g, unknown or other
  misc_feature (464)..(464): n is a, c, g, or t
tcagacgcgagtatcacgaccggtgctcgatttagtgtcgtcgcaagagaggaggggggggtcacaagagcagcgctctcgggacgtctccaccagtggcctgggctctgctgctctcactctcctcactcaggacacgagggtcctgggcccagtctcgccctgactcacgcctgccctcgtgtcgtgggtcctccgtggacngtcgatcaccgtctctgcactcggacccnagtnagttggtgtaacttttaangtaggtcgtcgtacggtacaacgtcctccgacggacaaccgacccccaaatctaactttacttagtagacgggtaccaacgtaaccggccggtcccgtacggtacgggtttcctaaggtcgtactttccgagtcgtctaccgaagtccgtacggacaccggaccggtccctacccggactaaccacttccgtacccggtaggtccccncgtaccggtccgtacggaaaccggcggtaggtctaaggtttatttacgtttaagttcgcttcgaccttactagtacgcgtaaccggtattaacggttacgtttaaggtttcggttacgggtaaccgggggtttaccggggacggggtaaaccgttacgggtccgggtaaccggtttacggtacggttacccggaacggttaccccggaggtcccccgttaccgggcccccgtttgggaacccctttaccgttccccgttacctaccccccgg

SEQ ID NO: 227981 - DNA, 849 bp, Homo sapiens
  misc_feature: GYAE6OF01DCVG0.23.21.B10.1.454.CMB.1.raw
  modified_base (185)..(185): a, c, t, g, unknown or other
  misc_feature (185)..(185): n is a, c, g, or t
  modified_base (244)..(244): a, c, t, g, unknown or other
  misc_feature (244)..(244): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgacgggtcctgggccccagtctcgccctgaatcagcctgcctccgngtctgggtcctccgtggacagtcgactccgacccgtcctcctgccaactcggaacccgnagtgacttggttcggtacttttaagtatggtcgttcggtaggtaccaacttcctaccaggaccaaacgacccccaaatctaacttactttagtgacggacaacgtaaggccggtaccctcggtacgggttttcacgtccgtccttctcgtcggcctacgtaacgtctggaccaaccgccggtacccctcgtacgtaccctacttcgtccgtcggtaccctccgacgccgtacgaccggaacggcgtaccttaggtaactttagttacgttacgtcgtcgtaccgttacttaacgtacgtaacggtacgttaaggtaacgttttaaacgggtttaacgttttaaccgggttttaacgggggttaccggggggtttaaccgggggtaacccgggggggttaaaacccggtttaaccgggggtaccccgggttaaaccgggggtttcccgggtaaacggggtttaccggtaaacccgggttaccccggggttaaaacccggggttacccctttccccccggggttaacccccccgggtttacccggggtttaccccctttaaaccccggttccccgggttttaaccccccgttttaaccccccccggg

SEQ ID NO: 227982 - DNA, 675 bp, Homo sapiens
  misc_feature: GYAE6OF01CLX9H.23.21.B10.1.454.CMB.1.raw
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagaggaggaggggggggtcacaagaggcagcgctcgtcgggacgtctccaccatggcctgggctctgctgctcctcactctcctcactcaggacacgagggtcctgggcccagtctgccctgactcagcctgcctcgtgtctgggtcncctggacagtcgatcaccgtcnctgcactcggaaccnaagtgagttgttaggtaacttttanagtgtctcgtgaaccatacctccgaggacaacgccccaatcgtatacttangacggcaacgtaagccgcctacgtagggttctagtcgtcttcgtcgtggcctacgaagtctaggaccaaacgccggtccctaccgtacgtaacctacgtcgtccgtacggtccccttacacggtacccgtagaaccggacgacggtactaggttaatttagttaacgttggacctgtacctataacgtagtcgacgtaagtagttaggttaacgttacgtttggggaacgggtttacggggaccggggtaaacgtagggtccggtaaaccggttcgggttaacggcccgaacggtccccgtaaacgggtcccgtacccgtcccccgggttacgtaccccgttaccgttccggttccccggtaccccccg

SEQ ID NO: 227983 - DNA, 889 bp, Homo sapiens
  misc_feature: GYAE6OF01BHDVX.23.21.B10.1.454.CMB.1.raw
  modified_base (429)..(429): a, c, t, g, unknown or other
  misc_feature (429)..(429): n is a, c, g, or t
tcagacgcgagtatcacgaccggtgctcgatttagtgtcgtcgcaagaggaggagggggggggtcacaagaggcagcgctctcgggacgtctccaccatcggcctgggcctctgctgcctcctcactcctcctcactcgaggaccacgacgggttccgtgggccccagttcctcgccctgacctcacgcctcgcctcgtgtcgtcgggtctaccgtcggacacgtccgactccgaccgtccgttacctcggtacctaaccggacccggaacccggtacgtacggttcggagtttcgggtttacggggtttaaccttttttaaaggtacttacgggtaccttcgggttaaccggttaaccctaaccgtacccctacccgaaccggtaaccaaaccgtaccccctaaaacctcctaacgtttacgtttacncggtacggtaccaacgttacggccgtccgtcggttacgggttctcgtcgtacgttctacgtccgtacgtaccgtaacgttccgtacggaccctaaccggtcccgtccccttaccgtacccgtaacctaccgttccgttaccgtaccgggtccccacccgtacgttacccggtaacggaccggtaacgggtccgttactaacggtttatttaaccgtttacgtcggttaccgtccgtacctttacgtaacttaccggtacgtccgtaattacggtttaacgggttaacgttttacggtaaggggttacccggggtacgggggtaccggtaacgggttaacgggttaaccgggtaccgggttggtaacccggggtacgtacccgggacccggtaaccggaccgtttcccccgggccggtttccccggaactttcccggtttcgttccccccttacccccggg

SEQ ID NO: 227984 - DNA, 831 bp, Homo sapiens
  misc_feature: GYAE6OF01DK84E.23.21.B10.1.454.CMB.1.raw
tcagacgcgagtatcacgaccggtgctcgatttagtgtcgtcgcaagagaggagggggggggtcacaagaggcagcgctcgcgggtttacgtctccaccatggcctggctctgctgctcctcactctcctcactcgagacacgacgggtccgtcgggccctagtcctcggccctgacctcacgtcctcgtccctccgtcgtccgtcgggtcctccgtacggacgtacggtacgactacccgtaccgttccgttccgtcgaccgtaaccggtaccggaacccggtacgtaggttacgtagtttacgggtttacggtttaacttttaacgtcggttcggttccgtacggttacgtaaacctaacttaccccgtaccgaacggaaacctaaaccccgaaccccctaaattcctaacgtttacctttacgaggaaccggactaaccgggtacggtcccgtaccgttacggttacgggtttctaccgtccgttcgttaccgttccggtaccgtaccgtaacgtaaacggttcgaccggaaaccgtaaccgcccgttacccgtacccgtacgaccttaccgttccgtccgtaccggtccctaacggccgttccgacggacgtagtacgtcctaagttacttagtgtcgtacctagtacctataatcgtacgaactaaggttacgttaacggtttacgtacggtttcgggggtaaccgggtacgggggaacccggtaggtaacggtccggtaacggtccggtaacggcgaaccgtacgggtaccgttcccggtaaccgtccccgggttacacgttcccttaccgtccccggtaccccg

SEQ ID NO: 227985 - DNA, 955 bp, Homo sapiens
  misc_feature: GYAE6OF01DD2EL.23.21.B10.1.454.CMB.1.raw
  modified_base (238)..(238): a, c, t, g, unknown or other
  misc_feature (238)..(238): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctcactcaggacacagggtcctgggcccagtctcgccctgactcacgcctgcctcgtgtcgttggtcctctggacacgtcgactccacctctcctcgcacgtacggacccngtagtgtagttcggttaggtaaccttttagtacgtcggttacgttccggtacggtaacccaacgttaccctaccgacggaaccaacccgtaccccctaatactaactttacgtttaggacggaaccgggtactaaccggaacggtcccggtcccgttacgggttaacgggtttccgtacgttccgtctttaccgtcgttacggtacctaccggtaacgtccgtacgggaccctaaccgggtcccgtaccccgttcccgtaaccgaaccgttacccgttcccgtacccggtaaccggttccccgtacccgtaccggtaccccggtacggtacccgggtaaccggtacggttaccgttaacgttaagtttaacctttggttccggttaccttaccgtaccgtttacgtaactttcgggttacgaaccgttaaggttaacgggtttacgtttaaaccgggtttaacccggggttttggggttaaccccgggggggttaccgggggtaacccggggttaaaccgggttaacggggtttaccccggggttaacgggttacccgggttaaaccgggtttaaccccgggaacccggttaaccccggggtaccccggtaacccccggttaccccccggggttttccccccgggtaaaaccccggtttccccgggtttacccccggttttaaccccccggtttcccccggggttaccccccccccg

SEQ ID NO: 227986 - DNA, 791 bp, Homo sapiens
  misc_feature: GYAE6OF01ANQY8.23.21.B10.1.454.CMB.1.raw
tcagacgcgagtatcacgaccggtgctcgatttttagtgtcgtcgcaagagaggaggggggggggtcacaagaggcagcgctctcgggacgtctccaccatggcctgggctctgctgctcctcactctcctcactcaggacacgagggtcctgggcccagtctcgccctgactcacgcctgcctccgtgtcgtggtctccgtaggacagtcgactccaccgttctccgtgacctacgtacggaacccgctagtgtagttggttacggttaacttttaagtagttcggtccgtacggtacggtaaacctaacctacccgtaccgaacggaacctaaaacccgtaaccccctaaaacttacttaaactttaacgttttaacggacgggtaaccggtaacctaaccggttaaccggcccggttacccgttacgggtttaacggggtttaccttacggttaccgttccttacggttaccgtacggttacctaaccgtaacggttccgaacggaaccgtaaccgtccggtcccctacccgtacgtacctactccgtacgtcgtaccctacgtaaccgtccgtacggaaccgtacggtaacgtcgttacgttaattttacgtcgttcgactcgtcttactatcgtgtactaagttacgttagttacgtttaggtagggttaaccgggacggggtaccgggaactacggggtactaacccgggttgaaaccggtcgaaaccgccggtacgtcccgttccccggaccggttcgtacctacccgttcgtccccgtacccc

SEQ ID NO: 227987 - DNA, 728 bp, Homo sapiens
  misc_feature: GYAE6OF01E03OP.23.21.B10.1.454.CMB.1.raw
  modified_base (260)..(260): a, c, t, g, unknown or other
  misc_feature (260)..(260): n is a, c, g, or t
  modified_base (326)..(326): a, c, t, g, unknown or other
  misc_feature (326)..(326): n is a, c, g, or t
  modified_base (389)..(389): a, c, t, g, unknown or other
  misc_feature (389)..(389): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctcactcaggacacagggtcctgggcccagtctcgccctgactcagcctgcctccgtgtctggtctcctggacagtcgatcaccgtctcctgcactcggaacccgcagtgagttggttaggtaacttttaatnttggttcttcggtggtaacccaattacctaccaggaccaaaccgaccccaaactcattactttagnggaggactactaacggccgccctgtacggggtttctagtcgtcttctcgtcgcctacgaagtnggaccaacgaccgcccttccctgaccatccttcgcgtccctaccacgtcctcggaaccggtacggagtacgttagtaactttacttacggttgtccgtgtccgttacaacgttataggaccgttaaggttaaccgtttaagggtttaacggttttaccggtttaaggggtcgggggtttaaccggggggccgggggtaaaccggttaaaggggtttcccgggaacccggggtttaggttacccgggtagttacccggaccgggtaccgggcccgttaccggtcccccccgtttacggggtaccctttacccggttcccgttcccgggtttacccccccg

SEQ ID NO: 227988 - DNA, 797 bp, Homo sapiens
  misc_feature: GYAE6OF01AV02E.23.21.B10.1.454.CMB.1.raw
  modified_base (129)..(129): a, c, t, g, unknown or other
  misc_feature (129)..(129): n is a, c, g, or t
  modified_base (235)..(235): a, c, t, g, unknown or other
  misc_feature (235)..(235): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctnactcaggacacagggtcctgggcccagtctgccctgactcacgcctcgcctcgtgtctgggtctccgtggaccagtcgatcaccgtctcctgcacgtcggaacccncgtagtagtacgttggtttacgggtaacttttaagagttggtctacggttacggtaacctaaaatacccgtacccgaagggtaccaaaaccgtccccccaaaactacctaattactttaacgaggtaacggcaacgtaacgcggtacccgtgtacgggttctaacgtcgtacttcgtctggcctacgtaagtccgtaggtacccaacgtaccggtcccttaccctacgtaacccctaagttccctcggtaccggtacccctccgtaaccgtaccgtacggtacccggaacggtacgtacgtacgttaacttttaagttaaccgtttagtcgtacggttacctactaacgtacgtacgtaactacggttaattaaccgggtttaagttaccggtttttaaccggggaagggggttcccgggggtaaaccggggggtaccgttaacggggtaccggtaccgggttaccggtacgggtaaccgtccgggtacccgtaaacggtcccgtacccggtacccccggttacggtaccgttacccgttacccgttcccgttaaccccccg

SEQ ID NO: 227989 - DNA, 762 bp, Homo sapiens
  misc_feature: GYAE6OF01DXS52.23.21.B10.1.454.CMB.1.raw
  modified_base (241)..(241): a, c, t, g, unknown or other
  misc_feature (241)..(241): n is a, c, g, or t
  modified_base (601)..(601): a, c, t, g, unknown or other
  misc_feature (601)..(601): n is a, c, g, or t
  modified_base (705)..(705): a, c, t, g, unknown or other
  misc_feature (705)..(705): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgacgggtcctcgggcccagtctcgcccctgactcgacgcctgccttccgtgtctgggtctccgtggacagtcgatccaccgtctctgcacgtcggaacccgnagtgtagttggtttcggtaacttttaagcgttggttccgttacggttacgttaaaccctaactaccccgtaccgaaggaaccaaaacccgtaccccctaaaacttccgttaatttaaccgtttagtacgggaacggtactaaacggttaccgccgggtaccccgtttacggttacgggttttactcggttccgtcttttacgcgttcggtaccactacgtcgaggaccaaccggccgtccctacccgtacgtactacgtcccgtccgtacggaccccttcgaccgtccgtacggaccgtaacggcggtacttacgttaatttacgttacgtttcgtcccttgtaccctagttataaccgngaacttagttacgtagttacgtttacggttagggtaacgggttccgggggaacggaagtaccggtccgtacggttaccggtcggaccaccggtaccgggtaccncccggttcccggtacccccgttgtacccccgtttcgtcccgtttcccgtaccccccg

SEQ ID NO: 227990 - DNA, 746 bp, Homo sapiens
  misc_feature: GYAE6OF01A9P25.23.21.B10.1.454.CMB.1.raw
  modified_base (224)..(224): a, c, t, g, unknown or other
  misc_feature (224)..(224): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctgggcccagtctgccctgactcacgcctcgcctccgtgtcgtggtctccgtggacagtcgactcaccgttctcctncgacgtccggaaccgcagtgagttggttaggtactttaatacgtggtcttcggtacgtaaccctaacttacccctccgtacggaaccaaaccgtacccccctaaaacttacctaactttaaccgttttactacgggacgggtacctaaccgtaacgtcccggtaccccgttacggttacggggttttctaacggtccgttcgttccttccgtacggtcctaacgtacgttcgtaggaccctaacgaccggtccctactcgtacctagtcctccgtcgtccctcgaccgtacgtcgaacggtaccggtcgtacgtagtaactttagttcgttacggtcctctaccttacgtatacgtcgaccgttattaacgttaggttacgttagggtttcgggtacggggtttcccggggaaccggggtacgtaacgggtccgggtaacccggttacggtcgggtaccacggtacccggagttccccgacccgtcccggttcgacccttcccggtcgttcccccggtcccg

SEQ ID NO: 227991 - DNA, 840 bp, Homo sapiens
  misc_feature: GYAE6OF01EYS1D.23.21.B10.1.454.CMB.1.raw
  modified_base (240)..(240): a, c, t, g, unknown or other
  misc_feature (240)..(240): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacactagggtcctcgggcccagtctcgccctgactcacgcctgcctccgtgtcgtggtctcgtggacagtcgactcaccgtctcctgctacgtacggaacccncgtagtgtagttcggttaggttacttttaatgttggtcttcggtacgtaacctaactaccctaccgacggtaccaaaccgaccccaaactctacttactttagacggacggactaacgtacggccgtccgtagtacgggtttctacgtcgtcttcgtcgtcggtaccgtactaagttcgtacggaaccaacccggtaccggtacccttacccgtacgtaaaccgtcgttaccctccggttaccggtccctaccggacccgtacggtacgggaaccgaaggtaccggttcgtacggtttaaactttacgtttcgtaccgttacgtccgtaccgttaacttagtacgttcgggaacgtttaaagttaacgttaacgggtttaacgtttaacgggttttacgggggttaaccggggggttaccgggggtaacgggggggttaaaaccggttaaccgggttaccgggttaaacccgggttaacggggtaaccggttacccggtaaaccccgggtacccggttacggggtacccccgttaaccccggggttcccggtaccgggtttacccttacccgggttcccgtttcccccgggttacccccg

SEQ ID NO: 227992 - DNA, 865 bp, Homo sapiens
  misc_feature: GYAE6OF01EVJZU.23.21.B10.1.454.CMB.1.raw
  modified_base (244)..(244): a, c, t, g, unknown or other
  misc_feature (244)..(244): n is a, c, g, or t
tcagacgcgagtatcacgaccggtgctcgatttagtgtcgtcgcaaagagagagggggggggtcacaagaggcagcgctctcgggacgtctccaccatggcctgggctctgctgcctcctcactctcctcactcaggacacagggtcctgggcccagtctgccctgactcagcctgcctccgtgtctcgggtctccgtggacagtcgactcctaccgtcctccgtgccacgtacggaaccccgntagtcgtagttggttacgggttaactttttaaatgttacggttccttacggttacggttaaaccctaaacgtacccctaccgaacggtaaccgaaaacccgtacccccctaaaactccgtaactttaaccgttttaagtacggaacggggtacctaacccgtaaacggcccgggtaccccgttacggtacgggggttttacctacggtaccgtcctttcctcgtacgtaccttaccgaaacgttcgtaccggacaacccggtaccggtccccgttaccccgtacgtaccctacgttcccgttccgtaccggtaccctacccgaccggtacccgtcgtaaacccgggaccggtacggtcccgttaggtaaacctttagtttacgtttccgacgttcgaccttacgtaatagtccgaacgtaaggttagttaaacgtttagttaacccgttttggggtaaccggggttcccgggggtaacggggtaaacccgtaggggttaccggtaacccgggtttcggtaacggggtccctaacccggtacccgggtaacggttccccgtacccccggtacccccgttcggttaccctacccggtttcccgtccccggtttaacccccccg

SEQ ID NO: 227993 - DNA, 887 bp, Homo sapiens
  misc_feature: GYAE6OF01EHO1L.23.21.B10.1.454.CMB.1.raw
  modified_base (197)..(197): a, c, t, g, unknown or other
  misc_feature (197)..(197): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctcgcctccgtgtcgtcgggtctccnggacagtcgatccgaccgtctccgtgccacgtcggaacccgcgagtgtagttggttaggtaacttttaagtagttcggtcgttcggttacggtaaccctaaacgtaccctaccgaacggtaaccaaaacccgtaccccctaaaacttacctaactttacgtttagaggaacggggactaaacgaacggtcccggtacccgttacgggttaacggggttttcctacgttccggttcctttccgtcggtcggaccttaccgtaaacgggttccgtacggaaccctaaacccggtacccgtccttaaccccgtacgaacccgtacgttcccgtcgttacccgggtccccttacggtaaccggttcccgacgggtaacccgggaacggtaccgggttactaccgggtttaattttaacgtttacggttcccgggtactttaccgtacccttaaagttacgttaacgtccggaaagttaaggttaacggttaacggtttaaggtttaccggggtttacggggtaacgggggttcccggggggaaacccgggggttaaaccggtagggttaccccgggtaccgggttacggggtaccggttaccggtaaccgggaccgtacccggggttacccgtcccccggtacccccgggttacggtacccttacccggtttccccgtcccgggttaccccccc

SEQ ID NO: 227994 - DNA, 765 bp, Homo sapiens
  misc_feature: GYAE6OF01DXXT6.23.21.B10.1.454.CMB.1.raw
  modified_base (200)..(200): a, c, t, g, unknown or other
  misc_feature (200)..(200): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctctcactcaggacacagggtcctgggcccagtctcgccctgactcagcctgcctcgtgtctgggtctcctggacngtcgactccacccgtctcctgccacgttcggaacccgcagtgatggttagggtacttttaagtagttgtctcggtggtaaccaacttaccctaccgagaccaaccgccccaatcattacttagngacgnacacgccgtcctagtacggttctagtcgtcttctcgtcgtctaccgtaagtccgtgaaccaccgaccggtacccctccccgtagtaccctactccgtaccgtccggtccctaccgtaaccggtcccgtaagggaccccgtaaggcggttacctaagtttaacgttttacgtttaagttccgtacgttcgtaccccgttagtattacggtccgaagttaacgggttaacttaacggggtttaacgtttacgggttttacgggaaccgggggggtttccggggtaaccgggggtaaacccgttaacggggtacgttaccccggggttacgggtaaccggtccccgtaacggtcccccgggaaacggtttcccgaccccccggtttaccccgttacggtaccccttaacgggtttcccccgttacccggttcccccccg

SEQ ID NO: 227995 - DNA, 805 bp, Homo sapiens
  misc_feature: GYAE6OF01B2UP1.23.21.B10.1.454.CMB.1.raw
tcagacgcgagtatcacgaccggtgctcgatttagtgtcgtcgcaagagaggagggggggggtcacaagaggcagcgctcgtcgggacgtctccaccatggcctgggctctgctgctcctcactctcctcactcaggacacgagggtccgtcgggcccctagtcctcgccctgacctcacgtcctcgtcccttccgtgtcgtcgggtctccgtggactagtcgaactccaccgttctccctgaccgtacgtaccggaaccctgtagtgtacggttggttaggtttaaacttttaagtagttcggttccgtacgtaacggttaaccctaacttccccaccggaggaacccaaacccgaccccctaaaactctaacgtttactttagcggaacggtactaaccgtacggcccggtacccttagggttacgggtttactacgtccgttaccttcgtccggttcggccctaacgtacgttcgacgacctaaccggtcccgtccctcccgacgactaccgttcctcggtccgtccctccaccgtccgacgtaacgggtaccgtacgtacgttacttaagtttcttaggtttccgcttcgaccgtttactagttacgtagtaacgtaagttaacgtttacggttaaggttaacgggtttgggtaacgggggttaccgggggacgggtaaacggtacggttacggttacccggttacgggtaccgtaccggtaaccggaaccggtccggtaccccgttcccgtcccccggttaccggttacgttacccgtttccccggtacccttcccccgg

SEQ ID NO: 227996 - DNA, 907 bp, Homo sapiens
  misc_feature: GYAE6OF01C1JFB.23.21.B10.1.454.CMB.1.raw
  modified_base (122)..(122): a, c, t, g, unknown or other
  misc_feature (122)..(122): n is a, c, g, or t
tcagacgcgagtatcacgaccggtgctcgatttagtgtcgtcgcaagagaggagggggggggtcacaagaggcagcgctctcgggaccgtctccaccatggcctgggctctgctgctcctcnctcctcctcactcgaggacacacgggtccgtcgggccccagtcctcgccctgacctccacgccctcgcccgttccgtggttccgttcgggtcctcccgtaggacctagtccgactcccacccgtcctccgtgccgaaccgtaccggaacccgtcgtaggtgtaggtttacggttacggttaacttttaagtacgttcggttcgttaccggttacgttaaaccctaaacgttaccccgtacccgaacggaacccctaaaaccccgtacccccctaaacttaccttaaacttttaccgtttaaggtaccggtacgggaacctaacggtacccggtcccggtaccccgttagggtttacgggttttccgtacgtcctttccgtcttcggtccgtacccgttactacggtcggtacggacctaaccggtcccgtccctacctactaccgtccttccgtccgtcccgtacgtcccgacgttaccgacggaccgacgtacgtctttaagttactttaggttcttccggaccgtttcacgtttacaacgtttcaacgttaacgtaacggtttaacttacgggtttaacggttcggttttaacggggtacgggggggttaccgggggtaaccggtaacccgggtttaaaccgggtccgggttaaccggtttaccggggtaccggtaccccggtaacctaacccccggggttaaccggtcccggttaaccccgggttcccccggttaactccccgggtttaacctttcccccgggtccccctttcccccccggg

SEQ ID NO: 227997 - DNA, 880 bp, Homo sapiens
  misc_feature: GYAE6OF01DRBMV.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctcgggcccagtcctcgccctagactcacgtcctcgtcctccgtgtcgtcgggttcctccgtgactagtcgactccaccgtctccgtcgccacgtacggaaccgctagtgtagttcggtttaggttaacttttagtagttcggtcgtacggtacgtacctaactccctccgaagtaaccaacccgacccccaaattctaactttacgttaacgtcggaacggtacctaacgtaaccggccgtaccgttaggttacgggttactcgtcgtccttcgtccgtcgcccttaacgtacgtcggttaccgaccgaacccgtcccggtcccctaccgtacctacccgtcgtacccgttccggtcccggtaccccttccgtaacggtccccggtaacgggaccccgtaaagggggttcctacgtttaggttaacttttacgttttacgtccgtttccgaacgtttaccacgtttaataccggtacgtacgggtaaataaacgttttaggggtttaaccgttttcgggggttttacgggggaaaccgggggtttccccgggggggaagggttaaaaccccgggtagggttttaccccggaaaccgggggtttaaccgggttcccgggaacccgtaaccccgggttaacccgggtaccgggttccccccgttcccgggttaccccccgtaagggttcccccgtttaaccccgtttcccgggttacccccccgtttccccccg

SEQ ID NO: 227998 - DNA, 834 bp, Homo sapiens
  misc_feature: GYAE6OF01D34SC.23.21.B10.1.454.CMB.1.raw
  modified_base (251)..(251): a, c, t, g, unknown or other
  misc_feature (251)..(251): n is a, c, g, or t
  modified_base (513)..(513): a, c, t, g, unknown or other
  misc_feature (513)..(513): n is a, c, g, or t
tcagacgcgagtatcacgaccggtgctcgatttagtgtcgtcgcaagagaggagggggggggtcacaagaggcagcgctcgtcgggacgtctccaccatggcctgggctctgctgctcctcactctcctcactcgaggacacgacgggtcctcgggcccagtcgtcgccctgactcagcctcgcctccgtgtcgtcgggtctccgtgactagtcgactcaccgttctcctgacctacgtacggaacccgtntacgtgtagttggttacggttaacttttaagtcgtcgggttacttcggttaacggtaaccctaacgttcccgaccgaaggaacccaaaacccgaccccctaaattccttaaacttttacgtttaacggacggaacggtacctaaccggtaccgggtcccgttacccgtggttacgggtttactacggttcgtcctttcgtcggtacgtaccttacgtacgtctaccgggactaaccggtcccgtccttacccgagacccttnttcccgtacgtccggtcctaccgacgtccgacgggtaaaccgtcggacgttacgttagttaaccttttagtcgttccggtaccttagaccttaactaacgttcgaggtaaccgtaaaggttacgtttaaacggttaacccgggttttacgggtttaacggggggcccgggggtaaaccggggtaaccttacgggggtaccggttacccggttcgggtaacgggtaccgacccgggtaaccccggtcgggttcccccgttacccgacccccgggtttactcccggttaacccgttccccgtttacccgtaacccccgttccc

SEQ ID NO: 227999 - DNA, 840 bp, Homo sapiens
  misc_feature: GYAE6OF01CZEEQ.23.21.B10.1.454.CMB.1.raw
  modified_base (186)..(186): a, c, t, g, unknown or other
  misc_feature (186)..(186): n is a, c, g, or t
  modified_base (264)..(264): a, c, t, g, unknown or other
  misc_feature (264)..(264): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
  modified_base (600)..(600): a, c, t, g, unknown or other
  misc_feature (600)..(600): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctcactacgacggacacggtacgggtccgtcgggccctagtcctcgcctagactcgacnccgtcgcccgtcgtgtcgtcggtctcgtggactagtcgactccgtaccgtctccgtcacgaaccggtaccggacccgngtagtaggtacgtttacggtttacggtttaactttaagtcggttggttacctacgggtaaccgttaaccaaccgttacccgaccggaacggtaccaaacccccgtaccctaatacttacgttacgttaggacggacggtacctaacggaccggtccgtaccgtacgggttagggtttcctaggccttccttcgtcggtaccggacttaaccggtacggtcgaccggtacccaaccggtccccgtaccgttaccctaccgacgttccttaccggccgtccgccctaccggtacacggtaccccggngtaaccgngttacttagtaacttgtttaccngttacgtatcgttaactggtaccggttcgaaattaagggtacgtttaacggggtttacttttacggggcgggttaacccggggggggttaccgggaaccgggttcggggttaaccggtaccggggtttaaccggtccggggtaaaccgttaccggaccccgggtacccgggttaccgttcccgggaccccgttccccgttaagttccccggttaccccttcgggttacccccccgttacc

SEQ ID NO: 228000 - DNA, 845 bp, Homo sapiens
  misc_feature: GYAE6OF01C7NV3.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgactcacgcctcgccctccgtgtcgtcgggtcctccgtggactagtcgactccaccgtcctcctcgccacgtaccggacccgcgtagtgtagtggttaggttaacttttaagtgttcggttccgttaccggtacgttaaaccctaaccgttaccctacccgaacggtaaccaaaaccccgtacccccctaaaattccgttaaacgtttaaccgttttaaggacggggaaaccggtaacctaaccggttaaccgggccccggttacccggtttacgggtttaacggggttttacctaccgggttccgttccgtttccgttccgtaccggtacctaccgtaaacgtcggtaccgaacccgtaaaccgtccccggtacccttaccgaccgaccttcgtaccgtcgtccgacctaccgacggtaccgacggtaaccggacggtacgttacgttaacgttatttaacgttcgttcgaccttcggtaccttacgtagtacgtcgtaaacgtagttaacgttaacggtttacggtttacggttcggggtaccgggggttaccggggacgggtaaccggttcgggtaccggttacggtcggtacggtaccgtaccggtaccgtaccggtcccgttaccccggtcccggttaccgtccgttaccccgttccgttccccggttaccccg

SEQ ID NO: 228001 - DNA, 822 bp, Homo sapiens
  misc_feature: GYAE6OF01DERUM.23.21.B10.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (650)..(650): a, c, t, g, unknown or other
  misc_feature (650)..(650): n is a, c, g, or t
tcagacgcgagtatcacgaccggtgctcgatttagtgtcgtcgcaagagaggagggggggggtcacaagaggcagcgctctcgggacgtctccaccatggcctgtgctctgctgctcctcactctctcactcaggacacgagggtcctcgggcccagtcctcgccctgactcacgcctcgcctcgtgtcgtcggtctcgtgacngtcactccaccgtctcctcgactacgtaccggaaccncgtagtgtacgttggttacggttaacttttaagtcgttcggttccgttacggtacgtaacctaaccgtacccgtaccgaaggaacccaaaccgtaaccccctaaaacttaccgtaattttaaccgtttacggtacggaacggtacctaaaccggttaaccggtccccggttaccgtttaacgggttaccggggttttacctacgggttccttccgtttacgtcggtacggtacctaccgtaaggttccggacgtacccgaacgtccccggtaccctccgttaacacccgttaacgttcccgtaccgtcccggtaccccgtaccgtaccgacccgtcgggaacccgggttacggaacggtagtttacgttaactttacgttcgtacgtcgtcgtaccttgtaagtcgtanacgttaaggttaacgttaagtttacgggttcgttaacggggtccgggggttaccggggaaacgggtaccgtaacggggttcgtaaccgggttcgtacggtaccgaaccggtaccgtaacgggtccccgtcccgggttacccctaccggtccctttcgtccccgtttaccccg

SEQ ID NO: 228002 - DNA, 761 bp, Homo sapiens
  misc_feature: GYAE6OF01DLLG3.23.21.B10.1.454.CMB.1.raw
  modified_base (171)..(171): a, c, t, g, unknown or other
  misc_feature (171)..(171): n is a, c, g, or t
  modified_base (458)..(458): a, c, t, g, unknown or other
  misc_feature (458)..(458): n is a, c, g, or t
  modified_base (520)..(520): a, c, t, g, unknown or other
  misc_feature (520)..(520): n is a, c, g, or t
  modified_base (583)..(583): a, c, t, g, unknown or other
  misc_feature (583)..(583): n is a, c, g, or t
  modified_base (731)..(731): a, c, t, g, unknown or other
  misc_feature (731)..(731): n is a, c, g, or t
tcagacgcgagtatcacgaccggtgctcgatttagtgtcgtcgcaagagaggagggggggggtcacaagaggcagcgctcgtcgggacgtctccaccatggcctgggctctgctgcctcctcactcctcctcaactcgaacgacacgacgggtccgcgggaccctagtccncgtcccgtagactcgacgtcctcgtcccttccggtggttcgtcgggttcctccggtaggaaccgtaggtcgaactcccgtaccgtcctcgtcgaccgtaacgaccgaccgagtaagtggtagttagggtttaacggttaacttttaaagtgtacggttccgtacggttaccgtaacctaaactcccgtacgaaccggtaaaccaaacccacctacttacgtaacgttattacggcgacgacctaaccggacggtccgtctaacggttggtacagtccgcttacggtncgactaccgtagtcgaacgacccaacggtccgactaccgaccttactcgtaccgcggtaccnccaccgtgcctacggacggcggtaatcgttaagtactttagtactacgttcgctataacgttnaacgtcgacgtaagtacgtttaagtacggtttacggtcggggttaaacgggcggggtaaacgggtacctagggtaccggttaaccgggtagttacggacgtaaccgggcccggtttaaaccgcccggttaccccgtccgggttaaccnccggttcccggtccctccccgggttccccg

SEQ ID NO: 228003 - DNA, 900 bp, Homo sapiens
  misc_feature: GYAE6OF01AL8FR.23.21.B10.1.454.CMB.1.raw
  modified_base (130)..(130): a, c, t, g, unknown or other
  misc_feature (130)..(130): n is a, c, g, or t
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
tcagacgcgagtatcacgaccggtgctcgatttagtgtcgtcgcaagagaggaggggggggtcgacaagaggcagcgctctcgggacgtctccaccatggcctgggctctgactgctcctcactctcctnaactcaggacacagggtcctggcccagtctcgccctgacgtcagcctgacccttccgtgtcctgggttcctacccgtggacngttacgactcacccgtctccgtgcgacgtcgggaaaccccgntaaggtgaacgttcggtttgggtaaaccttttttaatacgttcggttacgttacggttacggtaacctaaacgtttacccgtacccgaaggacctaaaaccccggtaccccctaaaaaccgtcgtaaccgtttaaccgttttaacgtacgggtaaccggtaccgtaaaccgttaaaccggcccggtacccgttacggttacggggttttacctacggttaccggtcctttcctacgttcgggtaccttaccgtaaacggttccgtttacgggaacctaaccggtaccggcccccgttaccttacggaaccttaccgttacttcccggttcgtaccccgtaccgttacgtaccggttacggaaccggtaaccggtacggtacccgtagttaaacggttcttttaacggttccgcgttaaccgtcgtttaccgaattaccggttagacccggtaataaccggttacggttaacgtttaccgttgggtaacgggttaccggggaccgggttaaaccggaccgggtttacctaacggggttacccgttaacggggtacccgttaccgggtaacccgtaaccgggtccccgtaacccgttccccgggtaccgttaacccggtacccttccggggttccccttaacccccgg

SEQ ID NO: 228004 - DNA, 784 bp, Homo sapiens
  misc_feature: GYAE6OF01A29RI.23.21.B10.1.454.CMB.1.raw
  modified_base (240)..(240): a, c, t, g, unknown or other
  misc_feature (240)..(240): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgaggtcctgggcccagtctcgccctgactcagcctcgtcctcgtgtcgtcggtctccgtgacagtcgactctaccgtctccgtgctacgtacggaacccncgtagtgagttacggttaggttaactttagtagtcgttcgttcgtacggtaacctaacttacccgtccgaggtaccaaaccgtaccccctaaactctatttacgttagtacggacggtacacgtaacggcccggtacctacggttacgggtttacctacggttctaccgtttcctcggtcggtcctaccgaacggttccgtacgggaaccctaaccggtacccgtaccccttccgtaccgacccttacgttcccgttcccgtaccggtaacccccttcgacccgggtaccgttacggtaacccggaccggtacgtacgtagtttaacgtttacgtttacgtccggtctaacgttcttaacgtacgttacgactacgtaacggtaggttaacgtgtttaccgttacggggtccggggtaccggggtacgggtaaccgtacgggttaccgtccggttaggttaccggacctaccggtacccggaggttcccctcccggtacccggtaccgttaaccttccggttaacccgttcccccgtaaccccg

SEQ ID NO: 228005 - DNA, 875 bp, Homo sapiens
  misc_feature: GYAE6OF01DHF84.23.21.B10.1.454.CMB.1.raw
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggcacagggtcctgggcccagtctgccctgactcagcctgcctcagtgttcgtgggtctccgtggacagtcgatcaccgtctcctgcacgtcggaacccgnaggtgattggttagggtaacttttaagtnttggtctacggtacggtaacctaactaccgtaccgacggacaaaccgtaccccctaaatcctaattaactttagtcggacggacctaacgtaacggccgtacccgttacgtacggggtttctacggtcctcttacgtcgtcgtaccttaccgtaacgtcgtacggacctaaccgtacccggtccttcccgtacgaaccctacgtccttccgtaccggtccccttaccgacgtcccgtaaggaacccggtaacggtacggtacgttacggttaattttaacgtttacgttacgtacgtccgttaccttacgtaacgttaacgtcgggaaccgtttaacgggtaaagtttaacggtttaacggtttaacggttttaacggggggttacccgggggtttaaccgggggggtaaaccccggggggggttaaaccggtaaacccggggtttacggggttaaacccccggggttaacgggtttaacggggtaaccccggtaaacccgggtaacccccggggtaacccggtttaaccccccgggtaccccggggttacccccccccggtttgggtttaacccccggttaacccgtttcccccgggttttaaccccccg

SEQ ID NO: 228006 - DNA, 625 bp, Homo sapiens
  misc_feature: GYAE6OF01BM5WN.23.21.B10.1.454.CMB.1.raw
  modified_base (314)..(314): a, c, t, g, unknown or other
  misc_feature (314)..(314): n is a, c, g, or t
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagacgcgagtatcacgaccggtgctcgatttagtgtcgtcgcaagaggagaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgagttggtttggacttttaatatggtctcgtacggtaccaatacctcccaggacaaacgcccccaaatacatacctttanagacggcaactaagccggcctacgagggtttctaggtctcttcnctgctcagtctgcacgcgcctccngaccatctctcgccctacacgctagaccgagacgctagtatttattagtccgatcgtacctntacttagngacctaaggtaactaggttaacgtttacggtttagggtacgggggttacgggtaaccgggggtaccttaagggtccgggtaccgttacggggtcggttacccgacccggaccggtaaggtccctcccgggtaccccgttacggtacctacccgttccgtcccttaccccccgg

SEQ ID NO: 228007 - DNA, 747 bp, Homo sapiens
  misc_feature: GYAE6OF01AWJDA.23.21.B10.1.454.CMB.1.raw
  modified_base (173)..(173): a, c, t, g, unknown or other
  misc_feature (173)..(173): n is a, c, g, or t
  modified_base (608)..(608): a, c, t, g, unknown or other
  misc_feature (608)..(608): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctcggccagtctgtcctgactcagcctncctccgtgtcgtggtctcgtggacagtcgactcaccgtctctcgacacgtacgaaccgcagtgagttggttaggttaacttttaagtacgtcggttccgtcggtacgtaacctaactacccgtaccgaagaccctaaaaccgaccccctaaaacgtactaactttaacgtttagacggacgggacctacgtaacggcccggtaccgttacgggttacgggttttacctaggttccgtacttttccgtacgttcgaccgttaaccgtaacggttcggtaacggacctaaaccggtacccgtccccttaccggttaccgaaccttactccgttccgtaccggtcctacccgaacgttacccgacgggtaaccgacggtaacggttctaacgtttaacgtattagttcgctcgtacctagtctagcgagtaagttaanagtttacgttagttacgggacgggttcgggaaccggggtaacacggggttacgaaccggttcggtaccggacgacccggaacgacggtcccgttcccgtaaccccgttcggtaactcccgttcccggttcccgtacccc

SEQ ID NO: 228008 - DNA, 818 bp, Homo sapiens
  misc_feature: GYAE6OF01D6MZE.23.21.B10.1.454.CMB.1.raw
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcatcaccgtctcctgccacgtcggaaccccnagtgtgtggttacggtaacttttaagtattcggtctcgtacggtaaccaacttaccncccgtaagacctaaaacgacccccctaaaacgtctaactttacctttagtacgggaacggggacctacgtaaacggcccggtacccgttacggtaacggggttttctacggttaccggttctttaccgttcgttcggccctacgtaacgttccggtagaccaaccgtacccggtcccctaccgtccgtaaccctacgtttccctaccgttccgggtaccccgttacccgtaacggtcccccgtagggaaacccgggtaccggtaacgggttaccttaagggtttaaactttttacggtttaacgtttccggtctttacccggtacctttcgtaagttcggttaaccgcgtaaacggttagttaaacgggttttacgtttaacggtttcggggtaacgggggtttacccggggggaacggggtaaccggtaacggggtccggtaacccggttgggtaccggtacgaccggtacccggaggtccctccggtcccccggttacgtacccgtcctcggttcccgtacccccc

SEQ ID NO: 228009 - DNA, 831 bp, Homo sapiens
  misc_feature: GYAE6OF01CZE06.23.21.B10.1.454.CMB.1.raw
  modified_base (114)..(114): a, c, t, g, unknown or other
  misc_feature (114)..(114): n is a, c, g, or t
  modified_base (191)..(191): a, c, t, g, unknown or other
  misc_feature (191)..(191): n is a, c, g, or t
  modified_base (486)..(486): a, c, t, g, unknown or other
  misc_feature (486)..(486): n is a, c, g, or t
tcagacgcgagtatcacgaccggtgctcgatttagtgtcgtcgcaagagaggagggggggggtcacaagaggcagcgctcgtcggacgtctccaccatggcctgggctctgctnctcctcactctcctcactcgacggactacgacgggttccgtcgggcccaggtcctcgccctacggacctcacgtccncgtcccgtcgtcgttcgtcggtcctccgtaggacaggtcctactccgtaccgtcttaccgcgcccgtacgtaaccggaacccgtgtaggtgtaagttgggtttacggttaacttttaacgtggttcggttacgtaccgggtaacgttaaccaacccgttacccaccggtaacgaacccaaacccggtaacccctaaaattccgtaaaattttaccgttagacggggtaacacccgttaaccggacgtcccggttacccttaacgggggtttggttaacctgtccgttaccgttcncggtacgttctaaccgtacgggtcctaacggacgaaacccgtcccggtccctaccggtacttaccttgtcccgggtcgttccgacccgtaccgtccgtaaccggtaaccggaccggtaacggtcgtcgttaagtttaccttttagttacgtcgttacttacgtacccttaagctttacgacggtaacttaagtacggtttaagtttaacgtttacggttacggttacggggtacggggtaaccgggtaacggtacgggtaccggttacgggccggtacgacgtacccggacgtacccggcccgttaccgcccgttacggtacctaccgttcctacccggttcccc

SEQ ID NO: 228010 - DNA, 768 bp, Homo sapiens
  misc_feature: GYAE6OF01AF6JI.23.21.B10.1.454.CMB.1.raw
  modified_base (174)..(174): a, c, t, g, unknown or other
  misc_feature (174)..(174): n is a, c, g, or t
  modified_base (244)..(244): a, c, t, g, unknown or other
  misc_feature (244)..(244): n is a, c, g, or t
  modified_base (453)..(453): a, c, t, g, unknown or other
  misc_feature (453)..(453): n is a, c, g, or t
tcagacgcgagtatcacgaccggtgctcgatttagtgtcgtcgcaagagaggggggggggtcgacaagaggcagcgctctcgggacgtctccacatggcctggctctgctgctcctcactctcctcactcaggactacgagggtcctcgggcccacggtctcgccctgactccncgcctcgcctccgtgtcgtcgggtctccgtgactgtcgatccgaccgtctcctgactacgtcggaacccnacggtgtacgtggttacgggtaactttttaagtcgtcggttctacggttcggtaacctaacttaacccttcccgaaggacctaaaccggacccccaactctaacttacttacgacgtacggactacgtaacgccgtaccctggtacggttacgtcgtacgtcgttctactcgaccgttcgacctacggtcgtagaacccgtccgtaccncccgttcccgataaccttcctcgtcccgccgttaccctacgtcccgtaccgaccggacgtaacggtcgtcgtaactttacggtttaacttcggttaaccgtcttaaccgggtcctaagtttacctaggtacgtaccgttaaggtaaggtttacgtttaacggtttacggttacggggtttccggggtaaccggggtcgggtaaaccgggtcggtaccggttacgggtacgggttccgtaacggtaccgggccgtaccggtacccggtcccgttacccggtaccttacccgtaccgttcccgtcccgttacccccg

SEQ ID NO: 228011 - DNA, 670 bp, Homo sapiens
  misc_feature: GYAE6OF01B9UCC.23.21.B10.1.454.CMB.1.raw
  modified_base (234)..(234): a, c, t, g, unknown or other
  misc_feature (234)..(234): n is a, c, g, or t
  modified_base (502)..(502): a, c, t, g, unknown or other
  misc_feature (502)..(502): n is a, c, g, or t
tcagacgcgagtatcacgaccggtgctcgatttagtgtcgtcgcaagagaggaggggggggtcacaagaggcagcgctcgtcgggacgtctccacatggcctggctctgctgctcctcactctcctcactcgacggacacgacggtccgtcggaccagtcctcgccgtgacctcgacgtcctcgccgttcggtgtcgtcggtctccgtaggactagtcgactcctaccgtctcncgacgtaccgtacggaccgcgtagtgtacggttggtttaacggttaactttaagtcgtacggtcgtcggtaacgtaacctaaccgtaccaccgaacggaacctaacccgaacccctaaatctaacgttagttacgacgacgacacgtaaccgcgtaccgtagtacggttctacgtctacgtgtcgtcgtactacgtagtcacgtaccgacgaccgtcctacgtcgactactcgtcgtacctcctcgtacgccgtagaacgacgtcgtnttaacgtatttacgtacgttgtccgtctataacgtacagtcgatagacgttagtagttacgggtcggtacgggacgggaacggtcgtaacggtcggtaacggcgtaccgatcccggtagaccgtccctaccggtcccaacgttccctaccttcccgtccgttaccccg

SEQ ID NO: 228012 - DNA, 683 bp, Homo sapiens
  misc_feature: GYAE6OF01CD616.23.21.B10.1.454.CMB.1.raw
  modified_base (258)..(258): a, c, t, g, unknown or other
  misc_feature (258)..(258): n is a, c, g, or t
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
  modified_base (532)..(532): a, c, t, g, unknown or other
  misc_feature (532)..(532): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcgaggacacgacgggtcctgggcccagtctcgccctgactcacgcctcgtcctccgtgtcgttcgggttcctccgtggactacgtacgactccaccgtcctccgtgcctaaccgtacggaaccccgngacgtagtacgttcggttaggttaacttttaagtacgtcggttccgtacggttacgtaacctaaccgttcccgtaccgaggaccaaacccgaccccctaaatctaactttacgtttagcggacggtactacgacggcgtaccgttagtacgggttctacgtctcttcgcgtcgacctacgactcgtagacaccgtcgaccctcgtacactctcgtcgtccgacctcgactcgagcgtacgngtatattattagttctgtctacnctactagtancgaacgtagttaacgtacgttcggtttacggtcgggtacgggtaccgggacgggtaacgtaggcccggttagtccggtaacgtccggaccgtaccggacgttcccggtccccgtaaccgtcggtaacccttccgttccgtaccccgtcccc

SEQ ID NO: 228013 - DNA, 1034 bp, Homo sapiens
  misc_feature: GYAE6OF01DEVAS.23.21.B10.1.454.CMB.1.raw
  modified_base (128)..(128): a, c, t, g, unknown or other
  misc_feature (128)..(128): n is a, c, g, or t
  modified_base (747)..(747): a, c, t, g, unknown or other
  misc_feature (747)..(747): n is a, c, g, or t
tcagacgcgagtatcacgaccggtgctcgatttagtgtcgtcgcaagagaggaggggggggtcacaagaggcagcgctctcgggactctccaccatggcctgggctctgctgctcctcactctcctanactcaggacacgcggtcctcgggccagtcctcgccctgacctcgacgtccgtccgtcccgtccggttgttccggttcgggtccctccgttacggaccgtacggttaccgacttccgtacccgttcgtcccttaggccgtaaccgttaccgggacccgcgttacggtagttgtttacgggtttaacgggtttactttttaagtaggttcggttacggtaccggttacggtaaaccctaaccgttacccttaccggaacggtaaccccaaacccgtacccctaaacttaccgttaaatttacggtttacgagggtaccggtaccgtaacggtaacccggtcccggttacccggtttaacgggtttacggggttttaccttacggttcccgttccgttacggttaccttacccggtaccccgtaacggttaaacccgtcgttaccggaaaccctacccggtaccccgttaccccgtaccctacggacctttaccgtaccgttcccggtaccggtccccgtacccgtacccgggtacccgtaacgggtaccggtaaacccgggttacggtacgtttaaacggttttaaccgttacgtttttacgttaaccggtccttttaacnccggtttaaaacgttacgttttaaccgggtcgttaaacgttaacgggttttacgtttaaaccgggtttcgggtttttaaacggtttaaccggggggtttaccggggttacccggggggtaaaccggggttaaacgggtaaccgggggttttacccgggtaccgggtaaacccgggtttaccgggacccggttacccgggttaaacccgggtcgttaccccccgggtttcccggttaaccccggtttacgaccccgtttccgtttacccggtttcccccctacccccg

SEQ ID NO: 228014 - DNA, 905 bp, Homo sapiens
  misc_feature: GYAE6OF01B8LJR.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcacgcctcgtcctccgtgtcgtcgggtcctccgtggacctagtcgactccgtacccgtcctccgtcgaccgtacgtaccggaaccccgcgtacggttgtacttgggtttacgggttaaacttttaagttacgttcggttccgttaccggtccggtaaacccctaaaccgttcccctaacccggacggaacccgaaaaccgacccccctaaaactcctaactttaccgttttaagtacggacgggtacctaaccgtaacggcccggtacccggttaggtttacggggtttaccttacggttccgtaccgtttcctccggttcgtacccgttaccgtaacggttccgtcggtaacccgaacccgtaccggtccccttaccccgtacaacccgttaccttcccttccgtccggttaccctcccgtaacggtcccgttaacgggacccgtaacgggtacggttactagtttaacgtttacgtttaacgttcggtaccctcggttaccttacggtaacgttaccgtagacgttaaggtttaacggttaacgtttacggttttaaccggtttacgggggtaccgggggttaccgggggaacccggggttaaccggtaacgggttcccggaaccgggtttacggtaacggtaccccggtacggtaccccggtaacgggtcccgttccccgggtaaccccgttcccgggtaccctacccggttccccgtttcccggtccccccg

SEQ ID NO: 228015 - DNA, 645 bp, Homo sapiens
  misc_feature: GYAE6OF01A8VFU.23.21.B10.1.454.CMB.1.raw
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagacgcgagtatcacgaccggtgctcgatttagtgtcgtcgcaagaggagggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggacccncagtnatgttggacttttaanatgtctcgtggtaccaatacctccaggcaaacgcccccaaatctatactttangaggcactaagcgccctacagggtttctagtcgcttctctggctccaagtcnggcaacncggcctccncgaccatctcgtcggtacctccgacgcctcgacgacggaggctgtaatttattacgttcgtctgtcgttactacttattacgactaagtaattaaggttaagtttaacgtttttagggtaaccggggtttcgggggaccgggggggaaccgtaaaggggttaccgggaaccgggttaccgggttaaggtaccgaccggtaccccggaacgggtcccttaccggcccccgttcgggttacccacccgtttccgtcccgtttcccccggtcccccg

SEQ ID NO: 228016 - DNA, 848 bp, Homo sapiens
  misc_feature: GYAE6OF01B139Z.23.21.B10.1.454.CMB.1.raw
  modified_base (423)..(423): a, c, t, g, unknown or other
  misc_feature (423)..(423): n is a, c, g, or t
tcagacgcgagtatcacgaccggtgctcgatttagtgtcgtcgcaagagaggagggggggggtcacaagaggcagcgctctcgggacgtctccacatggcctgggctctgctgctcctcactctcctcactcaggacacgagggtccgtcggcccagtcgtcgccctgactcacgcctgccgtccgtcgtcgtcgggtctccgtaggacagtcgactccaccgtctctcgcacgtaccggaaccgctagtgtagttaggttacggttaaacttttaataccggtggttactacgggttaacgaacctaaacttacccgaaccgacggtaaacctaacccgaaccccctaaagttctaaactttaacttagcggacggtacaacgtacggcgtacctaggttaggttctagtcctacttcgtcncggtacctacgacgtcgacggactaaccgaccgtccgtaccgacgtaaccgtcgttaccgacgtccggtacccaccgtagtacccggtaggtaaccggtacggagttaaccgttaaggtttactttaacgttaacggttctccgtacggttaccgtaaacttagttaaccgtagtaaaccgaagggttaacgttaacgggtttacgttaaacgggtttacggggttaaccggggggtaccggggaacccgggggttaacggtaaacgggtcccggggtttaaacggtaacccgggttaacggtaacccggtacccggttaaccgggtaaacccgggtccccggttaaacccccggtttaccccggggtaccgtttaacccccggttacgtttaaccccccggttaccccggtttaaacccccccg

SEQ ID NO: 228017 - DNA, 840 bp, Homo sapiens
  misc_feature: GYAE6OF01DW677.23.21.B10.1.454.CMB.1.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (455)..(455): a, c, t, g, unknown or other
  misc_feature (455)..(455): n is a, c, g, or t
  modified_base (506)..(506): a, c, t, g, unknown or other
  misc_feature (506)..(506): n is a, c, g, or t
  modified_base (742)..(742): a, c, t, g, unknown or other
  misc_feature (742)..(742): n is a, c, g, or t
  modified_base (821)..(821): a, c, t, g, unknown or other
  misc_feature (821)..(821): n is a, c, g, or t
tcagacgcgagtatcacgaccggtgctcgatttagtgtcgtcgcaagagaggaggggggggtcacaagaggcagcgctcgtcgggacgtctccaccatcggcctgggctctgctgcctcctcactctcctcactcaggacacgacgggtccgtcggccctagttctcgccctgactcacgcctgtcctcgtgtcgtggtcctcgtgacgagtcgactccgaccgttctccgngaccacgtaccggaacccgngtaggtgtagttggtttacggttactttaagtgttcggtccgtttacggagttaaccctaacctaccgaccgtaaggacccaaacccgtaccccctaattcctaatttacgttacggtaggaaccgttcgaaacggttccggaccggttccctagggtttaccggtttacgtcgtacgtcctttcgtccgtacgtcctaacgngttccgtaacgaccaacccgttaccggccccttacggacccacgtttaccnccgttaccgtacccgtcctaccgacggtccctaacgggacggtacctacgggtactttactttaaacggttttttaaccggcgttaaaccgtctttacgaaacttaggttcgtaccgtaacgttaaagtttacggtttaaccggttaggttttacgggacgggggttttaaccggggtaccgggggaaccgttaacgggttacggtttacccggggactttgggtaaaccccggtntaccccgggtaacccgtcggggttaccccccgttccggtaaccccccgtttggttaaccctcccccgggggttttaccncccccgttaccccccccgg

SEQ ID NO: 228018 - DNA, 879 bp, Homo sapiens
  misc_feature: GYAE6OF01ECSHA.23.21.B10.1.454.CMB.1.raw
  modified_base (143)..(143): a, c, t, g, unknown or other
  misc_feature (143)..(143): n is a, c, g, or t
  modified_base (212)..(212): a, c, t, g, unknown or other
  misc_feature (212)..(212): n is a, c, g, or t
  modified_base (566)..(566): a, c, t, g, unknown or other
  misc_feature (566)..(566): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctcactcaggacacgngggtcctgggccctagtctcgccctgacctcacgtccgtcgccctccgtgtcgtcggtcctcgtggacncgtcgactccgtaccgtcctcctcgacctaccgtaccggaaccccgtgacgtagtacgttgggttacggttaaacttttaagtacggttcggtccgttaccggtacggtaaccctaacctacccgtaccgaacggaaccgaaaccccgtaccccctaaacctactaacgtttacgtttaggacgggaacgggtaccaaccggtacggcccggtaccctttacgggtacggttttcgtacggttccgttccttacgtcgtccggtaccgttacgtaacggtccgtacggacccgtaaaccgtcccggttacccgtacccgtacgtaccctaaccttccgttccgtacccggtccncccgtacgtaccgtacggaaccggtacggtcgtaacgttcgttaagttttacgttacgtccgtacgtcgtacttacggtaacttacggacgtaaccgtaaagttacggtttaacgggttacgtttaaccgggtttggggtaaccggggttccgggggtaaccggggtaaacgtcggggtttaccggtaaccgggtttaccggtaccgggtaccgaacccgggttaccgtaacccgggttacccgtaccccccggttcccgggttacccggttaccctttccccgggttacccgttcccccggttaaccccccg

SEQ ID NO: 228019 - DNA, 807 bp, Homo sapiens
  misc_feature: GYAE6OF01B477W.23.21.B10.1.454.CMB.1.raw
  modified_base (622)..(622): a, c, t, g, unknown or other
  misc_feature (622)..(622): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcgaggacacgacgggtccgtcgggcccagtctcgccctgtactcacgtcctcgcccgtcgtgtcgtcgggtcctccgtgactagtcgtactcctccgtctccgtcgcctaccggtaccggaacccgacgtagtgtaggtttagggtttacgggtttaacttttaagtacggttcggttaccgttaccgggttaaccggtaacccctaaaccgttacccccaacccggaacggtaaacccctaaaacccccgtaacccccctaaaacttccgttaacgtttaaaccgtttaggacgggtaaccggtaccttaaaccgggaccgggtccccggttacccgttagggttaaccggggtttacctacggtccggttcttccgtcgtaccgtcctacgtagtccgtacgacccgtaacggcctcccgtcctacacgtctccgtccgtccgtccgaccgtccgacgtacggaacgcggtactcggtattaacgttnttacgtcgtcttactattacagtacgtgaagtacgttaagttacgttacggtttaagttcggggtacggggtacgggaccgggtaggacggttaccggtaccggtggtaccgtctaaccgggtaccgacccgttccccgaccggtaccccgtcgtacccgttaccgttcccgtccccgtaccccg

SEQ ID NO: 228020 - DNA, 776 bp, Homo sapiens
  misc_feature: GYAE6OF01CVVJH.23.21.B10.1.454.CMB.1.raw
  modified_base (227)..(227): a, c, t, g, unknown or other
  misc_feature (227)..(227): n is a, c, g, or t
  modified_base (491)..(491): a, c, t, g, unknown or other
  misc_feature (491)..(491): n is a, c, g, or t
  modified_base (529)..(529): a, c, t, g, unknown or other
  misc_feature (529)..(529): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcgaggacacgtacgggtccgtcgggccctagtcgtcgcccgtagacctcgacgcctcgccttcgtgtcgtcggtcctcgagactagtcgtactccnccgttctacgtcgactaccgtacggaccgacgtagttgtagttgggtttaacggttaacttttaaggtcgttcggtccgttaggtaccgtaactaacttcccgaccgaggaacccaaaccccacccctaaattcgtaacgttttaacgttacgacggaccgacctaacggacggtcccgtaaccttagggttaccgggttctacgtccgttctcgtccgtacgtacctacgtactcgtaccgacgtaaccgccggtccctaacncgtacctcgtccgacgtccgccaccgtgaccgtacggngtacggtagtacgttacgttattattcgtgtacctcgtactaactagtacgtacgtacgtaacggttagtaaacgggtttacgttaaggtcggggtttaaccgggggtaccggggtaaccgggtaaggttaacccgggcccggttaaggtaaccgggttccggaacccgtttaccggaacccggtccggtaaccccgttcccggtccccggtgtacccccgttatcccccgttacccgttacccccg

SEQ ID NO: 228021 - DNA, 869 bp, Homo sapiens
  misc_feature: GYAE6OF01DLPSS.23.21.B10.1.454.CMB.1.raw
  modified_base (239)..(239): a, c, t, g, unknown or other
  misc_feature (239)..(239): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgagggtcctgggcccagtctgccctgactcacgcctgcctcgtgtcgtgggtcctccgtggacagtcgactccaccgtctcctgctacgtcggaacccgntaacggtgtacgtaggttacgggttaaaccttttttaaaagtcgtcggttacgttaccggttaggtaaccctaaacttacccgttacccaagggacctaaaaccggaccccctaaaatctaacttacgttttaagagggaaccgggtacaaccttaaacgggccggttaccccgttagttaacggggtttctacggtaccttcctttacgtccgttacgggacctttaaccgtaaaggtcccgttacgggaaaccgtaaacccgtaaccgggttccccctaccccggttacggaaacccctttaaccgttcccggttaacggttaccccggggtacccctaccctaaccgggcccgttaacggaacccggggaaccggtacgggttaacggttaattaacgttttacgttacgttacgttcgtcggtaacctaacgtaagttacgtacggaccgttaaagtaagtttagtaagttttaacccgttggggttaacgggtacggggtaaccggggtaacgtaacggtacggttaccgggtacgttaaccgggacgtaaacccgtcgggaaaccggttccgtacccgttccccggtaaacggtttccaacccgtttccgtaaccgttaccccg

SEQ ID NO: 228022 - DNA, 827 bp, Homo sapiens
  misc_feature: GYAE6OF01BURBE.23.21.B10.1.454.CMB.1.raw
tcagacgcgagtatcacgaccggtgctcgatttagtgtcgtcgcaagagaggaggggggggtcacaagaggcagcgctctcgggacgtctccaccatggcctgggctctgctgctcctcactctccctcactcaggacacgacgggtccgtcggccctagtctcgccctgactcacgtcctcgtcctccgtgttccgtggtcctcgtaggacacgtcgactcgtaccgttctccgtacgacgtacgtccggaaccgcgtagtcgtagttcgttacggttacttttaatcgtcgtcgttcggtacgtaacctaacctacccgtaccgaacgacctaaacccgtaacccctaactacttaacgtttacgtttacggacggtacggtaccgtaacggtaccggtccggtaccggttacggtttacgggtttaccgtcgttccgtcttcgtccgtcgtaccgtacgtacgtcgtaccgtactaaccgtcccgtacccgtaccgtactaccgtcgttaccgtaccgtaccgtacccgtaccgtaccgtaccgtacggtaaccgtacggtacgttacggttaagtttacgtttacgttacgtaccgttaccgttacgttaccgtaaccgttacgtacgttaacgtacgtaacgttacgttaaggtttacgtttagggttacgggttaccggggtaccggggtaaccgggtacggttaccggtaccggttaacggtaccgtaccgggtaccgtaaccgggtacccggtaaccggttcccggttacccgttacccgtacccgttaccgttacccgttcccggttaccccggtccc

SEQ ID NO: 228023 - DNA, 742 bp, Homo sapiens
  misc_feature: GYAE6OF01DY1I3.23.21.B10.1.454.CMB.1.raw
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
  modified_base (249)..(249): a, c, t, g, unknown or other
  misc_feature (249)..(249): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (479)..(479): a, c, t, g, unknown or other
  misc_feature (479)..(479): n is a, c, g, or t
tcagacgcgagtatcacgaccggtgctcgatttagtgtcgtcgcaagagaggaggggggggtcacaagaggcagcgctcgtcgggacgtctccaccatcggcctggctctgctgctcctcactctcctcactcgacggacacgacggtccgtcgggacctagttccncgtccctgactcacgtctcgcctcgtgtcgtcgctcgnggactgtcgactccgaccgtctcgtgaccgacgtaccggaccgngtagtagtaggttacggtttaggttaactttagtcgttcggttactaccggttaacgaaccttactaaccccgagtaaccggaacctaaacccgacccctaattccgtaaacgtttagttacgaggtaccgacttaacgccggtcctaccgttagggtacgttcacgtccgttctactgccgttacacgtntcgcaccgaccgcgtctcganacctntcgcgtctacccngaccgtccgagacggtacggtctctaacgttagtttccacggtctacgttacgtaacttagtaccgttgacgtttaagaacgttacgtttacggtttaaacggtccgggttttagggacccggggttacgggtcccggtaaaaggttccggtaacccggtacgttaaccgggcggttacccgaacccgggtccgttacccgggtcccgttacccggccctttaaccgggaccctttccccgttcggttcccccgtaacccccg

SEQ ID NO: 228024 - DNA, 842 bp, Homo sapiens
  misc_feature: GYAE6OF01DX2V3.23.21.B10.1.454.CMB.1.raw
  modified_base (258)..(258): a, c, t, g, unknown or other
  misc_feature (258)..(258): n is a, c, g, or t
tcagacgcgagtatcacgaccggtgctcgatttagtgtcgtcgcaagagaggagggggggggtcacaagaggcagcgctctcgggacgtctccaccatggcctgggctctgctcgctcctcacctctcctcactcgacgacacgacgggtcctcgggccctagtctcgccctgactcacgcctgtcctcgtgtcgtcgggtcctccgtgactagtcgtactcctaccgttctccgtcgactacggtaccggaacccgngtaggtgttacggttaggtttacggttaacttttaagcgttcggttacgtacgtaacggtaacctaaccttaccggaccgtaacggaccctaaaacccgaccccttaaattctaacgtttacttaggacggtaacggacctaaaccgtaccggtccgtaccggtttaggttaacgggtttcgttacgtccgttctttacgaccggttcgtaacctaccgttacgtaccgtagggaacccctaaccgtccccggtaccctaccgtacaaccttcgttcccgtcgaccctacctaccggacgtccggacggtacgacggtgtcttaagtttaactttattcggtctacgttcggactttacgtaactttacggacgtacttaaaggtacgtttaacggttaccggttttaaacgggggtggggttaaccccgggggttacgggggaaacccggttaaccggttaagggttcccggttaaaccggggttaaccgggtcgttaccccggaaggttacccccgggtagttccccggtacccccggtcgtacccgttaccttaccccttcccggttcccccgttaacccc

SEQ ID NO: 228025 - DNA, 795 bp, Homo sapiens
  misc_feature: GYAE6OF01E18UG.23.21.B10.1.454.CMB.1.raw
  modified_base (193)..(193): a, c, t, g, unknown or other
  misc_feature (193)..(193): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (311)..(311): a, c, t, g, unknown or other
  misc_feature (311)..(311): n is a, c, g, or t
tcagacgcgagtatcacgaccggtgctcgatttagtgtcgtcgcaagtaggaggggggggtcacaagaggcagcgctctcgggacgtctccaccatggcctggctctgctgctcctcactctctcactcaggacacgtagggtcctgggccctagtcctgccctagtactcagcctgcctcgtgtcgtggtcncctaggacagtcgatccaccgtctcctgcacgtcgacccgngagtgagttgtaggtactttangtgtctcgtagtacctactaccgccgagacaacgcccctaagtctattacttagngacgtcactaacggccgtcccgtacgtcgggtttactacgttccgtaccttcgtaccgtggtacctaccgtaaaggttcccgttaggaccctaaacccggtaccgggtcccttacccgtacgggtaccccttagttcccgttccggtaccggtcccttaaccgacgttcccgtacggtaccgtacccggtaacgtcgtaaggtaacttttagtacgttacgtcgttcgtactacgtaacgttagacgtaagacggttaacttaacggtttacggttaacccggttttagggaacccgggggtttaccggggtaacccgggggttaacccgtaacggggtttaccggttacccgggttaacggttacccgggtacccgaaacccgggttacccggtaaaccgggttccccgttacccgggtacccccccgtttaggtacccccgttaaccggttccctttacccgggtccccccgtttaaccccg

SEQ ID NO: 228026 - DNA, 773 bp, Homo sapiens
  misc_feature: GYAE6OF01CCGS1.23.21.B10.1.454.CMB.1.raw
  modified_base (237)..(237): a, c, t, g, unknown or other
  misc_feature (237)..(237): n is a, c, g, or t
  modified_base (549)..(549): a, c, t, g, unknown or other
  misc_feature (549)..(549): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctcgccctgactcagcctgcctcgtgtctgggtctccgtggacagtcgatccaccgtctcctgcctacgtccggaacccncgtaggtgtacgttgggtttagggttaactttttaagtagttcggtccgttcggtaacggttaaccctaacgttacccctcccgagggtaacccaaacccgacccccctaaactccttaactttaaccgttttagtcgggaacggcctaaacggtacggcccggtaccctggttacgggtttctacggtctccgttactcgtcggtacctacgtagtccgtcggaacctaccgaccgtcccctaccgtcgaacctactcgttccgcggtacccctcgacccgtcgacgaccgcgcgtacgtgttaacgtttntcgttcgctcgtacttacgtattacgacgagtaacgtagttaacggttaagtttacgggtttcgggacgggttaccggggggtaccgggtaaggtaaccgggttaccggtaccgggttaccggtccgggtaccgtaccggaccccgggtaaggttcccccgtaccccgggttaccccgtaccgggttacccctccgtttcccgggttcccccgttaccccccgg

SEQ ID NO: 228027 - DNA, 728 bp, Homo sapiens
  misc_feature: GYAE6OF01DFNPC.23.21.B10.1.454.CMB.1.raw
  modified_base (128)..(128): a, c, t, g, unknown or other
  misc_feature (128)..(128): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (542)..(542): a, c, t, g, unknown or other
  misc_feature (542)..(542): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctnactcaggacacgaggtcctggcccagtctgccctgactcagcctgcctcgtgtcgtggtcctcgngacngtctatccgtaccgtctcgtnctacgtacggacccngagtcgtagttcggttagtacttttaagtgtcggttcgtcgtacgttaaccaacgttacccgtccgaacggaacctaaacccgaccccctaaacgttactaactttaaccgtttagcggacggaactaactacggtcccgtccgtacggttacggtttaccgtacgtccgttacttttccgacgttccgtacctacgtaacggtcgtacgaccgaaccgtaccggtccctaccgtacgaaccgttctccgtccgtacgacccttccgagtccgtagaccgtagtcgtacgtaagttacgtttatttacngtccgtcgaccttcgattggtacacgtagttaacgttacggttaacgttcgggttaggttaaccggggtccggggaaccggggtaaaccttgggtcgttacccgggtagggtaccggtactaaccggccggttacgtcccctcccggtaccgttcggaacctttcggtcccgttcccggtaccccc

SEQ ID NO: 228028 - DNA, 754 bp, Homo sapiens
  misc_feature: GYAE6OF01BOOM0.23.21.B10.1.454.CMB.1.raw
tcagacgcgagtatcacgaccggtgctcgatttagtgtcgtcgcaagagaggaggggggggtcacaagaggcagcgctcgtcgggacgtctccaccatggcctgggctctgctgctcctcactctcctcactcaggacacgagggtcctcgggcccagtctcgccctgactcacgcctgcctcgtgtcgtggtctccgtgacagtcgatccgtaccgtctccgtgccgacgtacggaacccgcgagtcgtagttcggttaggtaacttttaaagtgttcggtcgttacggttacggtaacctaacgttacccgtaccgaacggaaccaaaacccgtaccccctaaacttcctaactttacgtttacgtacggaccggactaacgtaacggtcccggtaacccgttcggttaacgggttccttacggttccgttaccgttcgtccggtacgtaccgttaacgtaacgtcgtacggtaccaaaccgtccgtaccctccgacgtaacctctccgtcgtccggacctacgacgtccgtacgaacggtacggacggtactttacgtattagttcttgccttacgacgttatacgtactacggataggttaagtacgttacgtttacgggtaggtccgggttacgggaccggtaacgtagggtacccgtacgggtacggtaccggtacgaaccgtcccggtaaggtcccgtaccccgtccccgttgtaccccgttacgttcccgtccccgttaaaccccg

SEQ ID NO: 228029 - DNA, 719 bp, Homo sapiens
  misc_feature: GYAE6OF01E5M5K.23.21.B10.1.454.CMB.1.raw
  modified_base (236)..(236): a, c, t, g, unknown or other
  misc_feature (236)..(236): n is a, c, g, or t
  modified_base (314)..(314): a, c, t, g, unknown or other
  misc_feature (314)..(314): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatccaccgtctcctgccactcggaacccgnagtgattggttaggactttttatatggtctcgtggtaccaactacctccaggacaaacgcccccaaactcatacttangaggacacgtaagccgtcctgtagggttctagtcgtcttctcgtcgtctactaagtcgtaggaccaacgtaccggtcccttcccgtacgacctactcctccgtcggtccctccgacgtccgtacggaccggtaccggtacggtaccttagttaacgtttacgtttaacgttccgtacgttcggacctttacaagtttagtacgacgtaacggtaatttaagggttacggtttacgtttacggggttacggggttaccggggggaaccgggggtaaccgtaagggttaccggtaaccgggttcggtaccgggtaccgtaaccggtacccccgggtaacggtcccgtaccccggttcccccggttaccggttacccgtcccgttcccgttcccgtttaacccccccg

SEQ ID NO: 228030 - DNA, 748 bp, Homo sapiens
  misc_feature: GYAE6OF01ADV9S.23.21.B10.1.454.CMB.1.raw
  modified_base (161)..(161): a, c, t, g, unknown or other
  misc_feature (161)..(161): n is a, c, g, or t
  modified_base (265)..(265): a, c, t, g, unknown or other
  misc_feature (265)..(265): n is a, c, g, or t
tcagacgcgagtatcacgaccggtgctcgatttagtgtcgtcgcaagagaggagggggggggtcacaagaggcagcgctctcgggacgtctccaccatggcctgggctctgctcgctcctcactctcctcactcaggacacgagggtcctgggcccagtcncgccctagacctcgacgcctcgcccgtcgtgttccgtgggtaccttccgtaggacctaggtccaacttccgaccgttcctcctcgactaccgtacggaaccccncaaggttcgtagttcggttggtaacttttaagtagtcgtcgtcgtacgtaaccaactacccgtaccgacgtaccaaacccgtaccccaaactacgtaacttacgtttagcggacggtaccactaacggccgtacccgtcgttaagggttctacgtcgtctcttccgtcgtaccgtactaacgtccgtacggaccaccgtaccggtccctacccgtacgtcctaaccgttcgtccgtaccgggccctaccgaccggtccgtaccggaccgacggtacgtacgttcgtacgttacttacgttcgactacgctaactacttaaccgcgtccgtaagtactaacggttaacgttaacggtttgggtacccgggtacgggtaccggggtaaccagggtacccgtaccggtacggtacggtaccgcggtacccgacggtccgtcccggtaccccgttacggtaccctccgtcccggtccgttaccccgg

SEQ ID NO: 228031 - DNA, 771 bp, Homo sapiens
  misc_feature: GYAE6OF01BRCIG.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcgagacacgacggtccgtcggcccagtctcgccctgactcgacgcctcgccttcgtcgtcgtcggtcctaccgtgacgtacgtcgtactaccgtaccgttcctccgtcgaccgtaccgtaccggaacccgcgtagtagtagttggttaacggtttaacttttaagtacggttcggttaccgttacggtaccgttaacctaaccttacccgaaccgaacggaaaccctaacccgtaaccccctaaagttccttaactttacgttagacggtaccgaactacggtaccgtaccgtccgtacgggttcggttacgtacgtccgttacttcctcgtcgacttacgtaacgtcgtacgaacctaccggtaccgcccttccgaccgtactcttccgcgtccctaccgtaccgacgtccggtaacgacgtacggtaccgttagtaactttaacttgttcttacgcgttagacttctagtacgcgaagttacgttagttacgtacgtttacggtacggggttacgggaccggggtaccgggttaacgacggttccggtaaccggtaggtacgacccggacgttaccgcccgttacccggtccccgtccggtttcctaacccggtccgtttcccgtccccgtaccccg

SEQ ID NO: 228032 - DNA, 779 bp, Homo sapiens
  misc_feature: GYAE6OF01A1OLB.23.21.B10.1.454.CMB.1.raw
  modified_base (177)..(177): a, c, t, g, unknown or other
  misc_feature (177)..(177): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
tcagacgcgagtatcacgaccggtgctcgatttagtgtcgtcgcaagagaggagggggggggtcgacaagaggcagcgctctcgggacgtctccaccatggcctgggctctgctgctcctcactctccctgactcgaggacacgtagggtcctgggcccaggtctcgccctgactcngcctgcccgtccgtgtcgtgggtcctaccgtggacgtcgtcggtacttcccgccggttcctccgtacgtcctacgtaccggggaaccccctntagggagttnttggggttacgggttaacttttaangttacgggttcttcggtaccggtaccaaacgttccgacccgtaggaacctaaaccgtacccctaaactctaactttacgtttaggaggtaccgggacactaaaccggggtccaccgtttacggtggtttaacccgtggttaacgtccgtttcgtaaccgttcggacgttaacctaacggtaaccgtggaaccgtacgtaccggaccttacccgtaccggacctacttccgtttacggacggtacccgtcctaacggtctaacgaccggtacggtacgtcggtactacgtacggttatcgtcgtcactacgtgtactcgaacgtagtaacgttcgttaacgttacggttaggttaccggggtacggggacggtacgggtacgtaaccggtcgtacgggtaccggtacgacgggtcctaccgggtacccgtaccggtcccgttaacgggtccctaccggtccttcccgggttacccc

SEQ ID NO: 228033 - DNA, 903 bp, Homo sapiens
  misc_feature: GYAE6OF01B28JY.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacggtccgtcgggccagtctcgccctgactcagcctcgcctcgtcgtcgttcggggttccttccgtggacctacggtaccgactccgtacccgttccttcctcgacctaccgtaccggaaccccgtcgaggttacgtagttacggggttttaggtttaaacctttttaagttagttcggttacctacgggttaccggtaaccctaaaccgtccccgtacccgaagggaaccaaaaccccgtacccccaaaacgtccttaacgtttacgtttaacggtgggtaacgggacctaaccggtaaccggtcccggtacccgtttacgggttacggggtttacctacgggttccttccggtttactccggtacggtccttacccgtaacgttcgacgggaaccctaccggacccggtccttaccccgtagaacccttcttcccgttcggtcccgtaccctccggttacgtcccgtacggaacccggacggacgttacgttagttaccttttaagtttcgtcgttccgtacgttcttagttcttagacgtccgttaagttaacgttaagtttaaccggtttacgggtttcggggttacccggggggtcggggggtaaccgggtaaaccgggtacgggggttcctaaaacccggggtttggacccgggtagaaccccgggtccccggttaacgggcccccggttacccccgttaccggttaccccggttacccgtaaccccgttttccccgggacccgtttcccccccgg

SEQ ID NO: 228034 - DNA, 701 bp, Homo sapiens
  misc_feature: GYAE6OF01DCA5C.23.21.B10.1.454.CMB.1.raw
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (507)..(507): a, c, t, g, unknown or other
  misc_feature (507)..(507): n is a, c, g, or t
tcagacgcgagtatcacgaccggtgctcgatttagtgtcgtcgcaagagaggaggggggggtcacaagaggcagcgctctcgggacgtctccaccatggcctggtctctgctgctcctcactctcctcactcaggacacgagggtcctcggcccagtctgccctgactcagtcctgcctcgtgtctgggtctaccgtggacagtcgatcgaccgtctccgtgctacgtacggacccntacggtgagttggttacggtaattttaacgngttcggtctcggtcgtaaccaacgttaccctcgaggaccaaacgtccctaactctactactttagcggacgtacaacgtacggccgtcctagttacgggttctacgcgtcttctcgtcggtccaccgtagtcgtacggactaaccgccgtacctcctcgtaacctcgttactcgtaccgtccgtaaccgcttaccgcgacgtagaacggtttaaccgtatttaacgttcgtcgccgttntactactagtacgagtaacgtaacgttagttaagtttacggtttaacggtttcggggtaaccggggttaccggggtaaccggggtaaacgttcggttaaccggtacgggtaaccggtacgtaccgaaccggtaccgtacggtccccgttacccgtaccgggtaccctccttacccggttccgttcccctacccg

SEQ ID NO: 228035 - DNA, 798 bp, Homo sapiens
  misc_feature: GYAE6OF01CV0IV.23.21.B10.1.454.CMB.1.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagcctcgcctccgtgtcgtgggtcctcgtggacngtcgatccaccgtctcctgctacgtcggaacccnagtgtagtggttaggtactttaagtgttcggtctcggtcgtaacctaactacctaccgaggaaccaaaccgccccctaaactctaacttacctttagtcggaacggtacctaacggtaacggccgtaccgttaggttacgggtttactacgttccgtccttcgtacgtcggtacctacgaacggttctacggacctaaaccgccggtacccctcctacggaaccctgttaccctaccggtcgtacccttaccgaccgtaccggtacgaaccggtaacggtcggtacttaagtacttttaacgttacgttcgtacgttaccggtaccttactagttaccgtacgaacgtaacgttacgttaaacgggtttacgtttaccgggtttacggggtaacgggggttaccggggtaaccggggggttaaaccgtaaccggggttaccgggtaacccgggttcggttaaccgggtaaccggacccggtacccgggtaaccggtcccgttacccccggtacccggtttaccggacgtttacccccgttcgttacccccgttacccccg

SEQ ID NO: 228036 - DNA, 711 bp, Homo sapiens
  misc_feature: GYAE6OF01AN69E.23.21.B10.1.454.CMB.1.raw
  modified_base (209)..(209): a, c, t, g, unknown or other
  misc_feature (209)..(209): n is a, c, g, or t
  modified_base (275)..(275): a, c, t, g, unknown or other
  misc_feature (275)..(275): n is a, c, g, or t
tcagacgcgagtatcacgaccggtgctcgatttagtgtcgtcgcaagagaggagggggggggtcacaagaggcagcgctcgtcgggacgtctccaccatggcctgggctctgctgctcctcactctcctcactcaggacacgagggtccgtcgggcccagtctcgcctgacctcacgcctcgcctccggtgtcgtggtctccgtggacngtcgatcctaccgtcctctcgcacgtaccggaccgtcagtgtagttggttacggttacttttaagngttcggttctcggtacgtaacctactaccctaccgacggaaccaacccgacccctaactactactttacgttgacggacgactacgtacggcccgtccgtacggtacggtttctacgtccgtcttcgtcgcggtctacgtagcgtacggacaccgcgtccctcgcactcgtccgtacgcgtcctccgtacgcgtacgtacggacgtacgtctagttattactcgttacgcgttacgtactatacgtcgtacgacgttaagtaggttacgttacggtttacggttcggggttacggggtaccggggtaccggggtacggtacgggtacgtaccgggtacggttacggaccggtaccggtacccggtaaccggttcccgtacccgttaccccgggttaccgttacccgtccggtttccccgttccccggtttcccccg

SEQ ID NO: 228037 - DNA, 805 bp, Homo sapiens
  misc_feature: GYAE6OF01C8GRI.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctcgccctgactcagcctgcctccgtgtcgtgggtcctcctggacagtcgatccgaccgtctcctgaccacgtcggaacccgcaggtgtagttggttagggttacttttaatagttggtacttcggtacggtaacctaacttaccctacccgaacggaaccaaaccgtacccccaaactctaacttacctttaagcggacggacctaacgtaacggccgtacccgttacgtaggggtttactacggtccgttcttcgtcgtcggtacctacgtaacgtccgtaggaacctaaaccgtccggtccctaccgtaccgacctacttcccgtcgtccggcccttacccgacgtaccgtacggaacccggtacggtaccggtacgttaagtttaacgttttactttaagttccggtacgttacgtaccgttaacgtaacttacgtacgtaaccgtaagttaacgtttaacgggtttacgttaccggtttaggggtaccggggtttccgggggaacggggttaaccgtaacggggtccggttaacccgggttggtaaccgggtacccgtaccggtacccggttaacggtccccgttaccccggtccccggttaccggttacccttacccgttccggttaccccgttaccccccg

SEQ ID NO: 228038 - DNA, 788 bp, Homo sapiens
  misc_feature: GYAE6OF01BH16C.23.21.B10.1.454.CMB.1.raw
  modified_base (206)..(206): a, c, t, g, unknown or other
  misc_feature (206)..(206): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctcgggcccagtctgccctgtcctcagcctcgcctccgtgtcgtgggtctccgtggacngtcgactccaccgtctcctgcacgtcggacccgcaggtgtagttggttacgggttaactttttaatagttcgggttcgttcggttacggtaaccctaacttacccgtacccgaacgggacctaaaaccgtaccccccaaaactcctaaactttaacttttaagtcgggaagggtacctaacggtaacggcccgggtaccccgttacgggttacggggttttacgtacggtcgttctttcgtcgttcggtaccttaccgtaacgtccgtacggacctaaaccggtaccggtccccttcccgtaaccgtaccctacttccgtcgtaccggtcccttccgaaccgtccggtacggaaccggtaacggtcggtacgttacgttaactttactttacgttcgtcgttaccgtcttactattacgtcgaacgtagtacgttaaggttactttaacgggttcgggtaaccgggggttccggggaccgggggtaacgtacgggttcggtaaccgggttacgtacgggtaccgaccggccgaggtccccgtccggtcccccgtcgtaccctccggtcctcccggttacccc

SEQ ID NO: 228039 - DNA, 777 bp, Homo sapiens
  misc_feature: GYAE6OF01AI74M.23.21.B10.1.454.CMB.1.raw
  modified_base (204)..(204): a, c, t, g, unknown or other
  misc_feature (204)..(204): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgagggtcctcgggcccagtcctcgccctgacctcagcctgcctcgtgtctggtcctccgtggacncggtcgatccgaccgtctccgtgaccacgtacggaacctcgagtgacttggttacggttaacttttaagtagttcggtccttggtacggtaacctaactacccgtccgacgaccaaaccgaccccctaaacgttctaacttacgtttacgaggtaacggacctaacgtaacggccggtacccgttcggttacgggtttctacgttccgtaccgttcgttccgtcggtacccgttacgtaacgtcgtacgaccaaccgaccggttccctacccgtacgtaccctacttcccgtcgttaccgtcccgtcccgtaccggtaccgtacggtaccggtacggacgtacgttacgttattacgtttacgttcgtcgttcgttacgtactagtacttacgtacgtaacgttaacgttaacggttacgtttacggtttacgggttaccggggtaccggggtaccggggtaacggtacgggttaccggtaccgggtacggtaccggtacggaccggtagtacccccccccccccccggtgtccccgtcccgtaccgtacctccgttccgttccgttaccccg

SEQ ID NO: 228040 - DNA, 783 bp, Homo sapiens
  misc_feature: GYAE6OF01AYQ2W.23.21.B10.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (485)..(485): a, c, t, g, unknown or other
  misc_feature (485)..(485): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacgggtcctcgggaccagtctgcctgactcagcctgcctcgtgttctggtctccgtggacngcgactcnccgtctccgtgcctacgtacggacccgnacgtagtacgttggttacgttaatttaacgtcgttacggttccgtacggtaacgtaacctaaccgttaccctaccgaacgaaccgaaaccccgtacccctaaactccgtaaatttaccgttagacggacggtacgaaccgtaacggcccgtacccgtacgggttacggtttcgtaacgtccgttacttcgtcgtcggtacctacgtaggtcctacggaaccgtaacggaccccggtccttacccggnttaaacccgtctaccgttcgaccggtcctaccgtacgaccggacgtaccggtaacgcggtacttaagttaactttagtttcgtcgttcgtacgtacctcgtaatacgtagtacgtaagtttacgttacggttacggttttaacgggttaggggtccgggggttaaccgggtaaccggggtaacggtaacgggttccggtaaccgggttccgtaacgggtaccgaacgggtaacccgaccggtccggtaccccggttccccgtagggttaccctccgttacccgttccccgtaaccccg

SEQ ID NO: 228041 - DNA, 866 bp, Homo sapiens
  misc_feature: GYAE6OF01DPUY6.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtccgtcgggcccagtctcgccctgactcacgcctgcctcgtgtcgtggtcctcgtgacagtcgactccaccgtctcctgcctacgtacggaacccgcgtaggtgtagttaggttacggttacttttaagtacgttcggtccgttcggttacggtaaccctaaccgttacccgtacccgaacggacccaaaacccgacccccctaaaagttcctaaacgtttacgtttaacgagggaaccgggtacctaaaccggtaaccggtcccggtaccccttacgggtttaacggggtttaccttaccggtccgttccgttttccgtacgttcggtacccttaccgtaacggttcgtaccgggaaccaaccggtaccgtccctacccgtacgacctcgttacctccgtccgtccctacccgtaccgtaccgtcggaaccggtacggacgtacgtaacgttacttttagttacgttcgtcgtacgtactacgtacgttactacgtaacgtacggtaacgttttacgggttacgtttacggtttacggggtaaccggggttaccgggggggtacccgggtaaacggttaccggggtaccggttacccgggttacgtaacccgggttaacggaccgggtaccccgtaaaccgggtccccgttacccccgggttacccccggttaccggttaccccgttaacccgtttccccggtttccccggtaaccccccg

SEQ ID NO: 228042 - DNA, 875 bp, Homo sapiens
  misc_feature: GYAE6OF01ATB5G.23.21.B10.1.454.CMB.1.raw
  modified_base (262)..(262): a, c, t, g, unknown or other
  misc_feature (262)..(262): n is a, c, g, or t
  modified_base (680)..(680): a, c, t, g, unknown or other
  misc_feature (680)..(680): n is a, c, g, or t
tcagacgcgagtatcacgaccggtgctcgatttagtgtcgtcgcaagagaggagggggggggtcgacaagaggcagcgctctcgggacgtctccaccatggcctgggctctgctgctcctcactctcctcactcaggacacagggtcctcgggccctagtctcgccctgacctcgacgccgtcgtcccttcgtgttcgtcgggttcctccgtaggacacggtcgactcctaccgtcttcctgacctacgtacgggaaccccngtagtcgtacgttgggttttacgggtaactttttaaattcggttcggttccgttacggtacggtaacctaaactaccccgttacccgaacggtaaccgaaaacccgtaacccccctaaacttaccctaacgttttaacctttaaagtcgggtaaccgggttaccaacgggtaaaccggtccccgggttccccgttaacggggtttaacccgggggtttttcttaccggttaccgttccgttttccctcggttcggtaccccgaacgttaacgtcgttacggaaccctaccggaaccgtccccgtaccgtaccgtaccttacgtccgtttccggtccgtacccgttccgaccgtcccgtaacgccgggtaaccggacggtccgttaacgttaacgtttacttacgttccgtaaccgttntccgtactacgttacgaactcgtaagtacgtttaacgttacggtttacgtttcggggaacgggttaccgggggaccgggtaacgtcgggtaccggtaccggttaccggtaacggttaccgaccggtcccgggttaccgaacccgttcccggtacccggtaccgttccggtaacctttcccgtaccggtccccccg

SEQ ID NO: 228043 - DNA, 705 bp, Homo sapiens
  misc_feature: GYAE6OF01CZ1B4.23.21.B10.1.454.CMB.1.raw
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (507)..(507): a, c, t, g, unknown or other
  misc_feature (507)..(507): n is a, c, g, or t
tcagacgcgagtatcacgaccggtgctcgatttagtgtcgtcgcaagagaggagggggggggtcaacaagaggcagcgctctcgggacgtctccaccatggcctgggctctgctgctcctcactctcctcactcaaggacacgagggtccgtcggccctagtctcgccctgactcgacgcctcgccgtcgtgtcgtcggtctccgtgacngtcgactccgtaccgtcctccgtnaccgtacgtaccggaacccgcgtagtaggtacggttaggttacggttaacttttaagtagttcggtaccttacggtagtaaacctactacccgtaccgaggaaccaaacccgacccctaaatccgtaatttacgtttagcggacggactaacggtaccggcgtaccgttaggttcggttactcgtcttcttcgcgtgtcctacgaagtcgacgaaccgacgccgtccctcgacgtacctctcgcgtccgcctaccgcgtccgtacgagtacgnggttctagtttattacgttctacgtctagtctatattaaccgcggttataagttaacggttacggttacttacgggttaggtacggggtaccgggggacgtaaggtacggtccgggtacggaggttccggaacgtaccggtccacgggtccctccggttccccggtaactccggtcctccccgggttacccttccccg

SEQ ID NO: 228044 - DNA, 772 bp, Homo sapiens
  misc_feature: GYAE6OF01D4UXS.23.21.B10.1.454.CMB.1.raw
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (317)..(317): a, c, t, g, unknown or other
  misc_feature (317)..(317): n is a, c, g, or t
  modified_base (503)..(503): a, c, t, g, unknown or other
  misc_feature (503)..(503): n is a, c, g, or t
  modified_base (546)..(546): a, c, t, g, unknown or other
  misc_feature (546)..(546): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcacggacacgacgggtcctcgggccctagtctcgccctgacctcacgcctcgccgttcgtgtcgtggtcctcgtggacacgtcatccgtaccgtctcgcncgtacgtacggaacccgngagtgtagttcggttagttaaacttttaagtacgttcggtcgttcgtacgtaacctaacgttacccncgaacggaaccgaaacccgtaccccctaaagttcttaactttaacgttacgtacgggaacggtaacctaacgtaaccggtcccggttaccgttaacgggttacgggtttacgttacggtccgttcttccgtcgtacggtctacgtacgtcgtacgactaccggccgtcctaccgtacgactcgtcncgtccgctcgtacgcgtacgacggacgacgtcgttagtacttnttacgtcgtctacgtatcgtattaccgagtcctaagttagtttacgttacggtttacggtacgggttaacgggggtccgggtaacggggggtaacctaacgggggttaccggttaaccgggttacgggttaccgacccggttaaccgggacccggtacgtccccggttacccccggttacccgtaccggtacctttcccgttccccgttaaccccgtttacccccg

SEQ ID NO: 228045 - DNA, 795 bp, Homo sapiens
  misc_feature: GYAE6OF01AYCHR.23.21.B10.1.454.CMB.1.raw
  modified_base (245)..(245): a, c, t, g, unknown or other
  misc_feature (245)..(245): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgacgggtcctcgggcccagttctcgccctgacctcgagcctcgcctcgtgtcttcgggtctcctaggacagtccgatccaccgtctcctggccacgcggaacccgntagtcgagttcggttcggtaattttaactagtcggtactcggttacgtaaccaacttacctaccgacggaccaaacgtaccccccaaacttctaacttacttacgtacggacggactaccgtaaggcccggtctacgttacggggttctacgtcgtactttccgtacgtcggtccctacgaacgtcgtacggactaacccgtccggtaccccttcccgtacgtaaccctcgttaaccgccgttcgggaccccttccgaaaccgtccggtaaaccgggtacccgttaccggaaggttacccgttaaaggttactttaaacgttttcgtacggttacgtccgtacgtactagtttacaggacgttaacagttaaacggtttacgtttagttacgggttacggggttaccggggaaccgggtaaccgtacgggtacggtaacccgtttaacggggtaacgttcccgggaacgtaaaccccgggtcggtaacccgttacccgggttccccccggtacgttacggtccccttttacggtaccccggttcccccgg

SEQ ID NO: 228046 - DNA, 892 bp, Homo sapiens
  misc_feature: GYAE6OF01DKVLZ.23.21.B10.1.454.CMB.1.raw
  modified_base (520)..(520): a, c, t, g, unknown or other
  misc_feature (520)..(520): n is a, c, g, or t
tcagacgcgagtatcacgaccggtgctcgatttagtgtcgtcgcaagagaggaggggggggtcacaagaggcagcgctctcgggacgtctccaccagtggcctgggctctgctcgctcctcactctcctcactcaggacacgacgggtccgtgggccctagtccttcgccctgactcacgcctagcctcgtgtcgtggtcctccgtgacgacgtcgactccaccgtctcctgcacgtcgaacccgctagtgtacgttggttacggtaactttaagtacgtcggttacgtaccggtcgtaaacctaacgtacccttaccgacggtaacccaaccgaaccccctaacgttactaacgttacttttacgacgggtaacggcctaaacggtaccggtaccggtcccgtaggtttacgggtttccgtaacggttcccggtctttacctcggtaccggttcctaaacgtaccggttcggtacggaaccaaaccggtaccccggttaccctcccggtaacgaacctnttcccgtccgttaccgtcccttccgaccgtaccgttaggaacccgggtaacggtccggtaacgtttagttaaccgttttactttacgtttaccggtcgttaccgtaacccgttagttaacttcgttaacgtcgtaacggttacgttttaaacgggttacggttttaccgggtaaggggttttcccggggtaacgggggggttaacccggggaaaccggttaaccggggttacccggggtaaacccggtttcggggaaaccggttacccgaaacgggttaccccggtaaacgtttcccccgggttacccccggttaaccccgttccgggaaccccgttttcccggttacccccggtcccctttaaaccccccg

SEQ ID NO: 228047 - DNA, 781 bp, Homo sapiens
  misc_feature: GYAE6OF01E39NO.23.21.B10.1.454.CMB.1.raw
  modified_base (241)..(241): a, c, t, g, unknown or other
  misc_feature (241)..(241): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacagggtcctcgggcccagtctcgccctgactcagcctgcctccgtgtcgtgggtctcctggacagtcgactccaccgtctcctgcaccgtcggaaccccgnagtgtagttaggtttacggttaactttttaagtgtcggtccttcggtacggtaacctaactaccctacccgaacggaccaaacccgaccccctaaacttctaaactttactttagaggaacggaccgtaacgtaacgggcccggtaccccgttacgggttacgggtttactacggttccgtccttctccgtcggtaccctaacgtacggttccgtacggaaccaaccggccccgtccctacccgtacgaccctacgttccctcgtccgtaccctccgacgtaccgtacgacggaccggtaggtctagttaacttcttagttcgccttcgacttacgtaattcgtgtaacgtaagttaagttaacgggttacgttttaacgggttacggggtaccgggggttacggggaacccgggggttacgaacggggttaccgaacccgggtttacggtaccggtacgaacccggtcccggtaacgggtcccctccccgggttaccccgtcggtaccccgttcgttcccccgttcccggttccccccg

SEQ ID NO: 228048 - DNA, 873 bp, Homo sapiens
  misc_feature: GYAE6OF01AS38S.23.21.B10.1.454.CMB.1.raw
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacgggtccctgggcccagtcctcgcccctgactcacgccctcgcccgttccgtgttcgttcggtccgtccgtaggacncgtcgactccgacccgttcctcctcgcacgtaccggaacccgngacggtgtacgttggtttacggttaacttttaagtagttcggttccgttaccggtacggtaaccctaacgttaccccgtacccgaacggaacctaaaccccgaccccctaaacgtaccttaactttacgtttaggacggtaccggtaacctaaccggtaaccggtcccggtacccgtttacgggttacgggttttaccgtaccgttccgtttaccgtttccgttccggtcggttacccctaaccggtaacgttcccgtaacggtacccgtaaaccccggtcccgtcccccgttacccggtaccgttaaccccttaccggtttacccgttaccggtccccgggttacccctacccggtacccggtacccggttaaccgggaacccggtaacggtacgggttcgttaacgtttaaagttttaccgttacgttccgtccggttactacgttacctagtaccgtcgtaacgttaagttaacgttagttacgggttacgtttacggggcgggtacgggaccgggtaacggtacgtccggtacgtcggtaccgtacgaccggtaccgtccgtccctaccggtcccgttacgtaccttccggttccctccggtacccc

SEQ ID NO: 228049 - DNA, 623 bp, Homo sapiens
  misc_feature: GYAE6OF01E44XQ.23.21.B10.1.454.CMB.1.raw
  modified_base (320)..(320): a, c, t, g, unknown or other
  misc_feature (320)..(320): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgcagtgatggttacgggtactttttaatagtggtctcgtcggtaccaatacctccaaggcaaacgccctacaaactctatactttagngaggcactagcgtcctcgtacgggttctagtcgtcttctcgtggcctcgaagtctaggcaacgcgcccttcccagacctatcctctacggtccctccacgcctcgaccgacgcggtctagtactttattagttcgtctcgtactactactatcgtactaagtataacggttacgttacgtttaggtacgggttccgggaccggggggtaaccgtaacgggttcggaaccggttcggtacggtaccggacggaccccgtaacggcccgtaccggtcccccgtacggtcctccgtccgttccccg

SEQ ID NO: 228050 - DNA, 845 bp, Homo sapiens
  misc_feature: GYAE6OF01D4EB6.23.21.B10.1.454.CMB.1.raw
  modified_base (66)..(66): a, c, t, g, unknown or other
  misc_feature (66)..(66): n is a, c, g, or t
  modified_base (530)..(530): a, c, t, g, unknown or other
  misc_feature (530)..(530): n is a, c, g, or t
tcagacgcgagtatcacgaccggtgctcgatttagtgtcgtcgcaagagaggagggggggggtcanaaggaggcagcgctcgtcgggacgtctccaccatggcctgggctctgctgcctcctcactctcctcactcacggacacgtcgggtcctcgggaccctacgtccgtcgcccgttacgactcgacgccctcgtccctccggttcgttcgttcggttccttccgtacggtacgtacggtaccgtacctaccgtaccgttcctctaccgaccgtacgtaccggaccccgagtacggtagttaggtttaggttacggtttaaacttttaagtggttcgttacggtacggtacgtaaaacctacctacccgtaccggaccgaaaccgtaaaacccctaacccctaacttacgttaactttacggttacggaacggaccgttacaacggttaaccggtccgtacggtttacggttaacggtttctaagtccgttctccgtccggtactcgtaccgtacgtcgacgtaaccnccggactcccgtaccgactacgttctacgttcgccgtaaccctcgtaccgtacgacggtacggtacggtacggtcgttaattaactttcgttacgtacgttctacgtactaagttactaacgacgtactaagggtttactacgggttacgtttaggggttaacgggttacggggaccgggggttacgtaacgggtaccgggtagtacccggggttagtacccgggttaggaacccggtacccgttcggggaaacccccttccgggtaccccggttacgtacccccggtttacttccccgtcccggttaaccccgg

SEQ ID NO: 228051 - DNA, 808 bp, Homo sapiens
  misc_feature: GYAE6OF01A7O04.23.21.B10.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
tcagacgcgagtatcacgaccggtgctcgatttagtgtcgtcgcaagaggagagggggggggtcacaagaggcagcgctctcgggacgtctccaccatggcctgggctctgctgctcctcactctcctcactcaggacacagggtcctgggcccagtctcgccctgacctcaggcctcgtcctccgtgtcgtcgggtcctccgtggacngtacgatccaccgttctctgacacgtcgaacccgtnagtnagttggttcggtaacttttaangtcggttcttacggtagtaacctaataccctaccgaacggaaccaaaccgaccccaaactctaactttacttagtcggaacggactaacgtaacggccgttaccgtaggttacggggtttactacgtcgttccttcgtcgtacgaccgtacgtaacggtccgagaacctaaccgccggtccctaccgtagtaaccctacgttcgtaccgtcggtaccctacgtaccgtactacggaacccggtaacgtacggtactaagttaacgttttaacttacgggttacctacgttaccgtacttaacctaacggttataaccgttacgaaaggttaacgtttaacgggttaaggtttacccgggtttaaggggtaccggggggtttaacccgggggaccggggttaaaaacccgttaggggtaaccccgggttaaccgggttacggtaacccgggtaccgtaaccgggtacccggtacggtaccccgtccccggtaccccttacgggtaccctaactttcccccggttaacccttccccccg

SEQ ID NO: 228052 - DNA, 593 bp, Homo sapiens
  misc_feature: GYAE6OF01B0OCW.23.21.B10.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (414)..(414): a, c, t, g, unknown or other
  misc_feature (414)..(414): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcacgtggaaccccnagtgatgtggtacttttaanatggtctggtgtaccaatacctccaggcaaacnccccaaatcatacttangaggcacgtagcggaccctgtagggtttctacgtctcttctctgctacaagtcgtagcaacgccgcctccagaccatcctacgtcgcctcagctgacacgagctagatttatnttgctgactcatagtgactagtactaggttacgtacgtttggtacgggtcgggacggggaaccgtagggtaccgtaccgggttcgtaacgggtacctaaccggcccgtaaaccgggtccttaccccggtacccccgttacgggtaccctacccggttcccgtacccgtttacccccccg

SEQ ID NO: 228053 - DNA, 839 bp, Homo sapiens
  misc_feature: GYAE6OF01BQ0AY.23.21.B10.1.454.CMB.1.raw
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacgacgggtcctcgggcccagtcctcgccctgactcacgtcctcgcccgtccgtgtcgttcggtcctccgtggacagttcgactcctaccgtcctccgtcgcctaccgtaccggaacccgcgtaggtagtacgtttgggtttacgggttaacttttaagttacggttcggttcgttacgggttaccggtaaacccttaacttacccccgttacccgaacggaaccgtaaaaccccgtacccccgtaaaccttacgtaaacttttaaccgtttaggtacgggtaccggaccgtaaccgtacgggacccggtcccgttacggttacggggtttaccgtacgttaccgttccgttcctcgtccggtaccgtaccgtaacgttcggtaccggaccgaacccggtaccgtccccgtaaccgtccgtaacctccgttacctccgggtccgtacccgtcctaccggaccgtacgggtacggaacccggtacggtacgttagttaactttaagttacttcggtccttccgtactataacgtcgtacgtacgtacgtttaaagttaggttaccgtttacggttcgggttacggggtacggggtaccgggtaacggtacgggtacggtaacgggtcggtaacggtacgtaacggacgcccggtccgtccccggtccccgtgttacccgtaccttcccgtccgttcccccg

SEQ ID NO: 228054 - DNA, 864 bp, Homo sapiens
  misc_feature: GYAE6OF01CHYF4.23.21.B10.1.454.CMB.1.raw
  modified_base (204)..(204): a, c, t, g, unknown or other
  misc_feature (204)..(204): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactcctcctcactcaggacacgacgggtccgtcgggcccagtcctcgccctgacctcacgcctcgcctcgtgtcgtggtctcgngacagtcgactccaccgtctctgacctacgtaccggaaccgcagtgtacgttggttacggttacttttaatagttcggtctacggtacgtaacctaacctaccgtccgacgaccaaaccgaccccctaaatctaactttacgttagacggtacggactaaccgtaacggtccgtaccgttcggttacgggtttacctacggttccgttaccgttcgttccggtcgtacctacgtaacgttccgtacgaaccgaacccggtacccgtccctaccccgtacgtaccctacgttccgttacccgttccgacccttaccgacccggttaccggtaccggaaacccgggtacggtacggttacgttaatttacgttttacgtttacgtacgtcgtacgtaccttaacgtattacgtacgaacgttaacggttaagttaacgggtttacgtttaacgggtttaggggtaacccgggggttccggggggtaaccggggtaaccgggttaacggggtaccccggttaaccgggttacggggttaaccggtaccgggaaaccccgggtaccggtaaacccgggtcccccgttacccccggggttcccccgtttaacccgggttacccgtttaccccgtttcccccgggtttccccgttaccccccccgg

SEQ ID NO: 228055 - DNA, 953 bp, Homo sapiens
  misc_feature: GYAE6OF01DGQPO.23.21.B10.1.454.CMB.1.raw
tcagacgcgagtatcacgaccggtgctcgatttagtgtcgtcgcaagaggaggaggggggggtcacaagaggccagcgctcgtcgggacgtctcctaccatggcctgggctctgctgctcctcactctcctcacctcaggactacgacgggtcctgggcccctaggttcctggtcccctgtaccttacgacgtccctgtcccttccggtggttcgttcgggtcctccgtggactaggtccggacttccgaccgtctcccgtggtccacgtaccggaacccgtcgtacggttaggtacgtttgggtttaccgggtttaacctttttaaagtcgtttcggttcccgtttaccgtaacgggtttaaaccccaaactttaaccccgttacccgaaggtaacccaaaaaccggtaccccccctaaaacgttcctaaaacttttaacccgttttaaggcgggaacggggtaacccgaaccgttaaccgggtcccggtcccgtttaggtttacgggggttttcctaaagttccccggtacttttcgtccggttcggtacccttaaccgtaacgttccgttacgggaccctaaacccggcccgttaccccgttccccgtacggaacccttattacccgttccgggttcccggtaccccttacccggtaccggttaaccccgtaacgggaacccggtaaaccggttaccggaaccgtttaaacgtttaaccgtttttaagttaacgtttccggtacttacgggttacctttaactaacgttctacggaaccttaaggtaacgtttaacgtttacggtttacggtttacggttacggggttccgggtaaccggggtacctaagggttccggtaccggtaggtaccggtccaacggtccgaaccgttccggtacccgtacccccggtgttacccgttacccggcccgtttcccgtaccccccgg

SEQ ID NO: 228056 - DNA, 870 bp, Homo sapiens
  misc_feature: GYAE6OF01CVQRV.23.21.B10.1.454.CMB.1.raw
tcagacgcgagtatcacgaccggtgctcgatttagtgtcgtcgcaaggagaggaggggggggtcacaagaggcagcgctctcggacgtctccaccatggcctgggctctgctgccttcctcactctcctcactcaggacacgagggtccctgggcccagtctcgccctgactcgacgtcctcgcctccgtgtacgtcgggtcctaccgtaggacctaggtccgtactccgtaccgtccgtccgtcgaccgtaccgtaccgggaaccccgtgtaacggttaggtacgttacggttacgggtttaaccttttaaaagtcgttacggtacgttacggtaacgtaaccgtaactacccgtaccgtaaggaacccctaaaccgtaccccctaaactctaacgttaaccgttagtacggacgggtacctaacgtaaccggcccggttacctaacggttacggggttacctaccgtcgtaccttcgtaccgtcggtaccctacggtaacgttccgtacggaccttaaaccggcccgttaccctccgtacgtacctacgtacctcgtacgcccgtacgtacggtaccgtagtaaacgtccgtacgtacgttaacgttacgtttaataccgttcggtacctaaccggtcttaacgtaacgttaacgtcgggttaaactagggtaaacccgtttaagggttaccgttaacggtttccggggtaaggggttcccggggaaacggggttaacgtaccgggtaacgggtcccgggttaacgtaccgggtaccggaccggtaaaccggtacccggttccgtaaccccggttcccccggttaaacggttccctaaacccggttccgtcccccggtttaacccccg

SEQ ID NO: 228057 - DNA, 788 bp, Homo sapiens
  misc_feature: GYAE6OF01ER3L2.23.21.B10.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (536)..(536): a, c, t, g, unknown or other
  misc_feature (536)..(536): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctcactcgaggacacagggtcctcgggcccagtctcgccctgactcacgcctcgcctcgtgtcgtggtctcgtggacnggtcgactccaccgtctcctgcacgtcggaacccgnagtcgtagttggttacggttaattttaagagttcggtcgttacggtacggtaaccctaacgttccctaccgaagaccaaaaccgcccctaaatcttaattacttagacggtacgacacgtacgtccggcccttggtaggtttctacgtcgtccttgtcgtcgtctacgacggtctcggaacctaccgaccggtccctaccgtactacctactccgtcgtcccggtcctcccgacgtccgaacggacgaacggtcgtacgttacggttaactttagttaccggttctccggttacncccgttaagttaacgttactaaccgggtagttaaacgtttaacggttaacgttttacgggttaaccgggtttttacggggacccggggggttacgggggaacccggggtaaaacggttaccgggttaccgggtaccccggggtttaagtaaccccggggccgtaaacccgggtcccggtaaaccggtccccgggttcccccgttaacccggtcgttaacccgttcccgttacccgttcccccggttaacccc

SEQ ID NO: 228058 - DNA, 847 bp, Homo sapiens
  misc_feature: GYAE6OF01DERAA.23.21.B10.1.454.CMB.1.raw
tcagacgcgagtatcacgaccggtgctcgatttagtgtcgtcgcaagagaggaggggggggtcacaagaggcagcgctcttgggacgtctccaccatggcctgggcctctgctcgctcctcactctcctcactcacgacgacgacgggtccgtcgggccctagtcctcgccctgactcgacgcctcgcctcgtgtcgtcgggtcctccgtggactagtcgactcctaccgtctccgtgcctacgtaccggaaccgcgtaaggtgtacgttgggtttaaggtttaaccttttaaagtcggttcggttccgttaccggttaaccggttaaaccctaaaccgtttaccccgaacccgacgggaaacccctaaaccccgtaaccccctaaaacgtacctttaacgtttaaccgtttacggtcggaaccggaccttaaccgtaacggtccccgtaccgttagggttacggtttcgtacgtcgttcttccgtcgtcggtcctaacgtacgtcgtacgacgaacccgccgtccctccactaccgtcttccgtaccggtcgtacccctacgacccggtaccgacggtaaccggtaaccggtacgttcgttaaacgtttacttttacgtttcggtaccgttcgtacggttactaacgtagttacctgggtaaccttaaggttacgttacggtttaagtttaccgggttacgggggttaccggggtacccggggaacgggggttaccgaacggggttaccggtaccggtacggtttacccggacgacccggtacgttcccgggtcccgtccccggtaccccggttcgaacccgttcctttcccggacccgttccccc

SEQ ID NO: 228059 - DNA, 811 bp, Homo sapiens
  misc_feature: GYAE6OF01A4SU0.23.21.B10.1.454.CMB.1.raw
  modified_base (603)..(603): a, c, t, g, unknown or other
  misc_feature (603)..(603): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtccgtcgggcccagtctcgccctgactcagcctgccctcgtgtcgtcggtctccgtaggacaggtcgactcctaccgttctccgtcgacctaccgtacggaacccgtcgtagtgtagtttggtttacggttaactttttaagagttcggtaccgttccggttaacggaaaccctaaaccgtacccccgacgaacgaaaccgaaaccccctaccctaaactctaacctttaacgtagaggaacgtctaacccgtaacgacccggtccgtaccggttagggtttaccgttacgaccgttccgtccttcgtccggtccgtaaccctaggtacgtcggaccaccgtaaccgtcccgtacccgtacacgactacgtcctccgtccacgtaccgcgtaccggtacgaccggtcgacgttcgtaagttctttaacgtcgttactcgtaacgttctaaccttaagnggtaacctaaggtaacttagggtttaaacgtttaggtttcggggtaacggggtccggggtaaccgggggaacccggtagggttacccgggtaacggttcggtaaacccgggtacggtacccgaaacccgggttacccgccccgggtttacccgtaccccgttacccggtacccttcccgggttttaaccctccccgggttaacccccc

SEQ ID NO: 228060 - DNA, 879 bp, Homo sapiens
  misc_feature: GYAE6OF01DOSSN.23.21.B10.1.454.CMB.1.raw
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
tcagacgcgagtatcacgaccggtgctcgatttagtgtcgtcgcaagagaggaggggggggtcacaagaggcagcgctctcgggacgtctcccaccatcggcctgggctctgcctgcctcctcactcctcctcactcaaggacacgaggtccgtcgggcccagtctcgccctagactcacgcctcgcctcgtggttctcgggtctccgtggacctcgtcgactcctaccgtctccgtnaccgtaccgtaccggacccngtacgtgtcgttaggttacggttaatttaatggtccggttcgtcggttaaccgtacctaaccgttacccgaccgaacggtaacccaacccgtacccccctaaatttctaacgtttaccgttaggaccgggtaccggaacttaacggtaaccggtcccggtacccgttcgggttaaccgggttttccacggttcccttcgtttaccgtcgtcgtacccgtacgtacggttccacggaacctaacccgtccggtcccttccccgtagtaccctagttcctaccgtcccggtcctaccgtacccggtctacgggaccggtaaccggtaccgtggttactttaaccgtttgttcgttacgtcctacggttacccttagtacccttagtacgtacgttaaacggtttaattagggttttaccggtttaacggtttaccgggggttaacgggggtacccgggggaaaccgggggtttaaaccggtacggggttaccgttaaccggggtttacccggggtaccggtaccccgaaacggttccccgggtaaaccggttccccccgttaaccccggcccccggtttacccgttaccgttccccgtttaccgttcccccccggttaccccc

SEQ ID NO: 228061 - DNA, 723 bp, Homo sapiens
  misc_feature: GYAE6OF01ERV7B.23.21.B10.1.454.CMB.1.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
tcagacgcgagtatcacgaccggtgctcgatttagtgtcgtcgcaagagagagaggggggggtcacaagaggcagcgctctcgggacgtctccaccatggcctgggctctgctgctcctcactctcctcactcaggacacagggtcctgggcccagtctgccctgactcagcctgccctccgtgtctgggtctccgtggacagtcatccaccgtcncctgcactcggaacccgnagtgatgttagggtaacttttaatagtgtctcgtaggtacctaactacctccaggacaaacgaccccctaaatcattactttatgacggactaactagccgacctagtacgggtttcagtccgtcttctcgtggtcctaccgtaagtccgtacggacaaccgacggccccttaccgtacgaacctactcgtaccgtcggtacccttaccgacgtaccctaggaccggaacggtacgacttagtaacgtttacttaattcgacttacgtaccgttagaacttagtccgtaacaaggtaacgtttaacggttaacgtttacggtttagggtaacccggggtttaccgggggaccggggggtaaaccctaaggggttaaccggtaccgggttaacggttaacgggtaaccgaccgggaaccccgtaaacgggtcccgttacccgggacccccccgtttaagggtaccccttaacgttcccgttaaaccccgg

SEQ ID NO: 228062 - DNA, 835 bp, Homo sapiens
  misc_feature: GYAE6OF01ARDJA.23.21.B10.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (607)..(607): a, c, t, g, unknown or other
  misc_feature (607)..(607): n is a, c, g, or t
  modified_base (644)..(644): a, c, t, g, unknown or other
  misc_feature (644)..(644): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctcactcaggacacgagggtcctgggcccagtctcgccctgactcacgcctgcctcgtgtcgtggtctcgtggacngtcgatccaccgtctcctgccgtacgtacggaacccgntaggtgtacggttgggtttacggttaacttttaagtgttcgggtccttacgggttaccggttaaaccctaaccgttaccccggtaacccgaacgggtaacccaaaaccccggtacccccccttaaaactcttaaccgttttaacgtttaggtacggggtaaccgggtacctaaccggttaaccggccccggtacccggttacgggttacggggtttactacggttccgttcctttaccgcgttcgccgttacgtacggtacgttcggaacctaaccggtcccggtaccctcccgtacgtacctacgttccgtaccgtccggtacccttcgaccggttaccgacgggtacccgtaacgggtacgttntaaggttaaactttcgttacgtgtacctcgtaacctntacgtacgcaagtaacgtagtttacgttacggtttggtaccggggtacggggttacccggggaagggtaccggtagggtacccggtgggtaaaccgtcggtaaccgggacccgtacccggttaccggccccgttaccccgggttccccgttaggaccccttacgttccccccgggtttccgtaccccccgg

SEQ ID NO: 228063 - DNA, 854 bp, Homo sapiens
  misc_feature: GYAE6OF01ES3UT.23.21.B10.1.454.CMB.1.raw
  modified_base (242)..(242): a, c, t, g, unknown or other
  misc_feature (242)..(242): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgccctccgtgtcgtgggtctccgtggacagtcgactccaccgttctcctgccacgtacggaaccccgngagtgagttggttacgggtaactttttaagtagttggttcttacggtacggtaacctaactaccctacccgaacggtaaccaaacccgacccccctaaattacctaacttaccgtttagtacgggaacggtacctaaccgttaacgggcccggtaccccgttacggttacggggtttccttaacggttccgtacctttccgtccggtacggtcccttaccggtaacggttccggtacgacccgtaaccggtcccggtccccgttcccgtaacgtaccctacgttcccgttccgtacgtccccgtacgaccggtccgtaccggaaccggtacggtaccggttacgtaacgttaattttacgtttacgttgttacccgtgttaccctactaagttcgtacgtactaaggttacgtttacgttaacgtttacgggtttacgggtaacggggttaccgggggtaaccggggttaacgtaccggggttaccggtaccgggtttacgggttaaccggtacccggtaaccggtaacccgggtaaccgggttcccgtacccccgggttaccccgttccggttacccgttaccggtttccccgttccccggttaccccccg

SEQ ID NO: 228064 - DNA, 828 bp, Homo sapiens
  misc_feature: GYAE6OF01DKIJ2.23.21.B10.1.454.CMB.1.raw
  modified_base (141)..(141): a, c, t, g, unknown or other
  misc_feature (141)..(141): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgngggtcctgggcccagtctcgccctgactcagcctgcctccgtgtctgggtcctccgtggacngtcatccaccgtctcctgacacgtcggaacccnagtgatcggttaggtactttaagtagttcggtctcggtacgtaaccctaactacccgtccgaggaccaaaccgacccccaaatctaactttactttagcggacggactaaccgtaacggcccggtcccgttacggttacggggtttcctacggttccgttctttccgttcgtcggtaccttacccgtaaaggttccgtacggaacctaacccggacccgttcccctacccgtacgaaccttctccgtcgtcccggtccctaccgaccgtccgtaacggtacggacggtacggtaccgttaagtacgttttaacgtagtttaccgtcgttacgtcttaaccgagtttacgtacgtaacgtaacgttaacgtttaacgggttaacggtttaaccggtttcggggtaaccgggggtttacggggaacccgggggttaaacccgtacgggggttaacccgttaccgggttacggggttaaaccggtacccggaaaccgggttcccccggtaaacgggtcccccgttacccccggttacccccgggttacggtttaccccgtaacccgttttccccgggttccccgttaaccccccg

SEQ ID NO: 228065 - DNA, 733 bp, Homo sapiens
  misc_feature: GYAE6OF01ADWH0.23.21.B10.1.454.CMB.1.raw
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (350)..(350): a, c, t, g, unknown or other
  misc_feature (350)..(350): n is a, c, g, or t
tcagacgcgagtatcacgaccggtgctcgatttagtgtcgtcgcaagagaggagggggggtcacaagaggcagcgctctcgggacgtctccacatcggcctggctctgctgctcctcactctcctacgactcacggacacgtcgggtcctcgggcccagtcctcgtccctagacctcgacgtcctgtcccttccgtgtcgttcggtacctccgtaggactgtaccgngtacccnccgtctccgtagtcaccgtcggaacccgntagtnacgttggttacggttaacttagtagtcgtcgtcgtacgtaccactctccgacgtacaaccgcccaactctacgtttctacgngaacggacctacgttaacgccgtaccgtacgtgggttcacggtctactccgtcgcgtccacgttacgtcacggtaccacggtacccgtcccttaccgacgtaccgtacgtccgtacccggtccggtccccttaacggacccgtttccgggaaccggttaccggaaacgttcccggtaggttaaccgtttattaccgttacgttcgtaacctcgtcctaacgtactagtctaaccgtagtaacgttacggtcgttaacggttcgggtacggggtacccggtaacgggtaaccggtacgtacggttacctacgggtccgaacggtcctccgggtaccctcggacccgtcccgtacggtacctcccgttccgtcccgtttccccgg

SEQ ID NO: 228066 - DNA, 764 bp, Homo sapiens
  misc_feature: GYAE6OF01D0IVG.23.21.B10.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcagacacgagggtcctgggcccagtctcgccctgactcagcctgcctcgtgtctgggtctcgtggacngtcgatccaccgtctctgactacgtacggaacccnagtcgtagtgttaggtaacttttagagttcggtcgtacggttacggtaacctacgtacccgtaccgaaggaccaaacccgaccccctaaactcctaacgttactttagacgggtagacctaacggtacgcccggtcctacggttaggttctagtcctcttcgtcgtacgcctacagtcacggctaacgccgtccctccgtacgactctacgttcaccgtccgaccgtacgtccgtacgacggtacgtacggtcttacgttaagttttacgtaccttcgtcgtacgtaccgttaagtaacttcgtagtaaccgtaggttaaccgttaggtttaacggtttaccggttaaacggggttcggggttaacccgggggggtaaaccggttaacccggggtaaggggttaccccgttaccgggggttaaccgttacggggaacccgtaacccggtacccgggacccggttcccgtcccccgggttaccccttaaccggttcgacccttttcccggtaccttaacccccccccggg

SEQ ID NO: 228067 - DNA, 774 bp, Homo sapiens
  misc_feature: GYAE6OF01DN31Y.23.21.B10.1.454.CMB.1.raw
  modified_base (188)..(188): a, c, t, g, unknown or other
  misc_feature (188)..(188): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
tcagacgcgagtatcacgaccggtgctcgatttagtgtcgtcgcaagagaggagggggggggtcacaagaggcagcgctctcgggacgtctaccaccatggcctgggctctgctgcctcctcactctacctcactccaaggccaacgcgggttcctcgggcccctagtcctcgccctcggactcgacnccctcgccgttccgtcgttcgtcgggttcctcctggactagtacgactcctaccgttcncctgaccacgtaccggaaccnctagtggtcgtcggttttaggttaactttaatacgttcgtacgttcggtacgttaacccgtaacctaccgtccgaaccggtaacccgaaaccaccccctaaacgtacctaactttaacgttaggacggacggactaaccgtccggtaccgcgttacggttacggttcgtacgtccgttctacgtcgtcgttacctataaccgcgttacggtaacccgaaacgtcccggtaccctcgtacccgtaaccttctccgtacgtccgtccgtaccgacccgtacgtaccgacggtcggtacacgttatagttacgtcttccgcgttagtcctatacttcgtacgtaacgtaactagttaagtttacggttaacgttacgggacgggggtttcggggaaccgggtaacggtaccggttacggtacgttcggtaaaccgtccgtaacggtcccgtcggttaccccgaccccgttcccgacggttacccttacctcgttcccccgttaaccccg

SEQ ID NO: 228068 - DNA, 669 bp, Homo sapiens
  misc_feature: GYAE6OF01A2AYI.23.21.B10.1.454.CMB.1.raw
  modified_base (128)..(128): a, c, t, g, unknown or other
  misc_feature (128)..(128): n is a, c, g, or t
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctnactcaggacacagggtcctgggcccagtctgccctgactcagcctgcctccgtgtctggctctggacngtcgatcaccgtctcctgctacgtacggaacccnagtgagttgtagggtacttttatagtgtctcgtgtaaccattaccctccgaggacctaacgacccctaaactctaattacctttagtgacggtacacgttaaacgccgtacccgtacgtagggttctacgtcgtccttcgtccgtacggtcctacgtacgtccgttacgccgtaaccgaccggtcccgtacccgtacgtaccctacgtacctcgttccgaccgtccgactaccgtcgacgacggcggacgttataacgttattactcgacgttgtaccgttataacttagtcgacgtaagtacgttaagttaacgttaccgttgggtaacggttcgggaccgggtaaacgtagggtccgtacggtaccggtaggttacccaggacccgtacggtacgccccgttacccggtcgtacctacgttccgttccgtacccccg

SEQ ID NO: 228069 - DNA, 749 bp, Homo sapiens
  misc_feature: GYAE6OF01B3K21.23.21.B10.1.454.CMB.1.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
tcagacgcgagtatcacgaccggtgctcgatttagtgtcgtcgcaagaggagggggggggtcacaagaggcagcgctctcgggacgtctccaccatggcctgggctctgctgctcctcactctcctcactcgaggacacgacgggtccgtcgggacccaaggtcctcgacccgtgacctcacgcctcgccttccgtcgtcgtcgggtcctccgtggactcgtcactccgaccgttcctcncgccgtacggaccgaccgntaggtagtagttcggtttacggttaactttagacggttcgtcgtacgttaacgtaacctaccgtacccacgaacgtaacctaaccaccctaactacttatttaacgtacggacggtacgacgtaaccggaccggtccggtaccgtacggttcggttactcgtcgtcttcgcgtcgtaccgtacgtcgtcgaccgaccgtacggccgtcctcgtaccgtacgtctccgtccggtccgcccgtccgtaccgacggacgtacgtcgtcgtaagttacgttagtacgtcgtctacgtacttacgtacgtacgtactaagtacgttaggttaacgttacggttacgggttacggggttaacggggtcccggggtaacgggtaccggtacggttaccgggtcggtaacggtaccggtacgtaacccggtcggtaccgtccccgtacccggttcccggtcgttaccgtccgttcccgttccgttccccgtccgtacg

SEQ ID NO: 228070 - DNA, 784 bp, Homo sapiens
  misc_feature: GYAE6OF01AFOOR.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctggcccagtctcgccctgactcagcctcgcctccgtgtctcgggtcctccgtggacagtcgattccaccgtcctcctgcctacgtcggaaccccgcgtaggtgtagtttcgggtttagggttaactttttaagtacgttcggttccgttacggttacggtaacctaacctacccctaccgacggtaaccaaaccccgaaccccctaaactacctaagtttaccgtttagacggacggtacctaacggtaaccggtcccggtcccgttacgggttacgggtttaccgttacggttccgttacctttcgtccgttcggaccttaccggtacgtcgtacggacctaaccggtacccggtccccttacccgtacgtacctacgtttccgtccgtacccgtccctccgacgtcccgtacggtaacggtaccgtacggttctagtttaacttcgtttacgttcgtccgttgtccgtacttatacgtacgtacgtaagttagtaacgtttgtttaccggttggggtacccggggtcgggtaaccgggtacgtaacggtccggtcggttacggtccgtacggacggtcccgacggtcccgttcccgggtcccttcggaccttcccggttccgttcccgtcccccg

SEQ ID NO: 228071 - DNA, 858 bp, Homo sapiens
  misc_feature: GYAE6OF01AU45V.23.21.B10.1.454.CMB.1.raw
  modified_base (199)..(199): a, c, t, g, unknown or other
  misc_feature (199)..(199): n is a, c, g, or t
  modified_base (248)..(248): a, c, t, g, unknown or other
  misc_feature (248)..(248): n is a, c, g, or t
tcagacgcgagtatcacgaccggtgctcgatttagtgtcgtcgcaagagaggaggggggggggtcacaagaggcagcgctctcgggacgtctccaccatggcctggctctgctgctcctcactctcctacactacgaggacacgacgggtccgtcgggcccagtctcgccccgtgacctcgacgcctcgccctccggtntcggttcggtcctccgtacgggacctagtcgactccgaccgtccttccncgactaccggtacggaaccgtcgaggtgtaagtttcgggttacggggtttaacttttaagtcggttcggttccggtttaccggtaccggtaacctaaccttccctacccggaacggaccaaaaccccgtaccccctaaaactacttaatttaccgttttaaggacggggacggtacctaacggtaaccggccggttaccccgttaggggtaaccgggttttccgttaacggttaccggttcctttccgtcggttaccggtacctaacgttaacgtcgttacggaccgtaaacccggtacccgtccccttacccgtacgacccttacttccccggtccgttaccgggtacccttaccggaccgttccggaaaccggttccggaaggttaaccgtcgttaacgtttaaattttacgttcttaacgggttcctttacggtccttaacgtatacgggtccaagttaacgtaacgttaagtttaccgtttggttaggggtaaccgggttcggggaaacgggaccggtacggtacggtccggttacggtcgaaccgacggcggtacccggttcacccgggtcccgaccgttagcccgtcccgttaccccggtcccc

SEQ ID NO: 228072 - DNA, 769 bp, Homo sapiens
  misc_feature: GYAE6OF01E0S27.23.21.B10.1.454.CMB.1.raw
  modified_base (250)..(250): a, c, t, g, unknown or other
  misc_feature (250)..(250): n is a, c, g, or t
  modified_base (513)..(513): a, c, t, g, unknown or other
  misc_feature (513)..(513): n is a, c, g, or t
  modified_base (585)..(585): a, c, t, g, unknown or other
  misc_feature (585)..(585): n is a, c, g, or t
tcagacgcgagtatcacgaccggtgctcgatttagtgtcgtcgcaagagaggaggggggggtcacaagaggcagcgctctcggacgtctccaccagtcggcctgggctctgctgcctcctcactctcctcactcaggacacgtagggtcctgggcccagtctacgccctgactcacgcctgccctcgtgtctaggtcctcctggactacgtcgactccgaccgttctccgtgacctaccgtcggaacccngtaagtggtacgttcggtttacggttaactttttaagcggttcggtttaccgtcggttaccggaaaccttaacgttaccccgtcccgaagggtaacctaaaacccgtccccccgaaaattaccgtacgttaacgtttagacggtaaccggacctaacggtaacggtcccggtccgtttaggtacgggtttcctacggttcgtccttcgtccgtacgtcctaacgtagttcgacggacctaaccgtcggccctacgtacacctntacccgtcgcgtctcgagtcacgtcgagtcgtcacgttctaattcgtacgcgttacgacttaagtcgtaacngtaacgacggttaagttacgttagttaaccgggtttgggtaccgggggttacgggtaaccgggtaaccggttaccgggtaccggtaaccggttgggtaccggtaccgttacccgggccgttaccgggccttacccgggtaccccgttgtaaccccgttcgtaaaccccttcccggtaacccccg

SEQ ID NO: 228073 - DNA, 943 bp, Homo sapiens
  misc_feature: GYAE6OF01E3HGO.23.21.B10.1.454.CMB.1.raw
  modified_base (92)..(92): a, c, t, g, unknown or other
  misc_feature (92)..(92): n is a, c, g, or t
  modified_base (122)..(122): a, c, t, g, unknown or other
  misc_feature (122)..(122): n is a, c, g, or t
  modified_base (635)..(635): a, c, t, g, unknown or other
  misc_feature (635)..(635): n is a, c, g, or t
  modified_base (656)..(656): a, c, t, g, unknown or other
  misc_feature (656)..(656): n is a, c, g, or t
tcagacgcgagtatcacgaccggtgctcgatttagtgtcgtcgcaagagaggagggggggggtcacaagaggcagcgctcgtcgggacgtcnccaccatggcctgggctctgctgctcctcncctctccctcactcgacggacacgacgggtcccgtcgggccctagtcctccgcccgtgaccgtccgacgtcccgttcgtcccgttccggtcgttcggttccgggttcctaccggtacggacgtacggtacccgtaactccgtacccggttacctccgttcggaccgtaccggtaccggaacccggtacgttaggttacggttaacgggttacggtttaaacggttttaacctttttaaggtcggtaccggttaccgttacccgggtaaaaccttaaacccgtaacccgttaacccccggaacccgaaaacggtaaccccgtaaaaccccgtaaacccttaaaggtaagttaaccggtttacgtaacgacggtacccgttaaacggtacccggacccggtttccgtacggttaacggtttcgtccgtccgtcggttaccctaggtccgttaacccgactaaccgggtcgacgtacccgtaccgacccgttacccgtcctaacggtcctttaacncccggttagtccccgggtaanacggtacccgttaccgacgggtaaacgttacggtacctaagggttactaacgtttaaggtctacgttacgacgttagaaccgttaacgtcgtaaacgtggtaaacgttagggttaccgtaccgggtttacggggaccgggttacgggtaccgggtaaccgggtaaccgggttcgaacccgggttaccgaccgggttacaaccgggtaccctcccgggtaccgtaccccgaccggttcccccggtaacgttccccaccggttccccgtaacccgttccctaaccccgg

SEQ ID NO: 228074 - DNA, 814 bp, Homo sapiens
  misc_feature: GYAE6OF01AI0B1.23.21.B10.1.454.CMB.1.raw
  modified_base (211)..(211): a, c, t, g, unknown or other
  misc_feature (211)..(211): n is a, c, g, or t
  modified_base (533)..(533): a, c, t, g, unknown or other
  misc_feature (533)..(533): n is a, c, g, or t
tcagacgcgagtatcacgaccggtgctcgatttagtgtcgtcgcaagagaggaggggggggtcacaagaggcagcgctctcgggacgtctccaccatcggcctgggctctgctgctcctcactctcctcactcacggacacgacgggtcctcggcccagtcctcgccctagacctcacgcctcgcctcgtgtccgtggtcctcgtaggacngtccgtactaccgtccgtcctctcggactacgtacggaacccgctaggtgtacgttaggttacggtaacttttagtagttcggtccgttacggtacctaacctaaccgttacccgtaccggaaacggaaccaaaaccccggtacccctaaaacgttaccgtaactttaccggtttaggacgggacgtaacctaaccggtacgacccggttaccttacgggttaacggtttcgtaaccgtccgttaccgttccgttcgtacggtaccttaaacgtacggttcgaccgaaccgtaccgaccggtcctaccgtacactcgttacncgtaccgtccgactacgcgtacgacgtacgacgtcctaattacgtacgttacggtacgtcttaacgcttaacggtaactacgttacggctttaaacggtacgttaaaccgggtttacggtttacgggtttaaccggggtaccgggggttaacccgggtacgggttaaaccgtccgggtaacggttaaccgtaccgggtcgggtaacgaccggtaccccgtaggtcccccgttacgtacccggtttaccggcctttacccgggtcccttcccggttaccccc

SEQ ID NO: 228075 - DNA, 761 bp, Homo sapiens
  misc_feature: GYAE6OF01E1C3V.23.21.B10.1.454.CMB.1.raw
tcagacgcgagtatcacgaccggtgctcgatttagtgtcgtcgcaagagaggaggggggggggtcacaagagacagcgctctcggaacgtctccaccagtggcctggctctgctgcctcctcactctcctcacgtcaggaccacgagggtccgtacgggccctagtcctcgccctagactcgagcctcgcctccgtgtcgtgggtctcgtcggactacgtcgactccgtacccgttctccgtcgcctacgtaccggaacccgtacgaggttgtagtttagggtttacgggttaaacctttttaaatcggttcggtttaccgtaccgggtttaccggaaaccttaaccgttaacccccgtacccggaaggaaaccccgtaaaaacccgaacccccctaaaaaccgtattaactttaacggtttacggtacgggtacggtaacccaaccgggtaaccggtcccggtccccgtttacgggtttaaggggtttaccttaccggttcgtacctttccttcggtacgtccctaacgtacgtcggtaccgtaacgaacccgtcccgtacctacccgtagcctacttcgtcgtcctaccgctacgccgacggacgagacgtcgtaatacgttattacgtctcgtatactagtatcagtacgaattacgtagttacgttagggttcgtagggttacggggaccggttacgacgtacgtacgtacggtgtacgcgtcgaccgctccgtccgtctacctctcgtcccgtccc

SEQ ID NO: 228076 - DNA, 775 bp, Homo sapiens
  misc_feature: GYAE6OF01ETTQ9.23.21.B10.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctgccctgactcagcctcgcctcgtgtcgtggtctcgtgacagtcgatcaccgtctcctgacacgtacgaacccgngagtgagttggttacggtaacttttaagtgttacggtccgttacggtacgtaaccaacttacccgtaccgacggaacctaaaccgacccccaaaacttcgaactttaccgtttagagggacggtacctaacgtaacggccggtcccgttacggtggggtttacctagtccgtctttaccgtcgtcggtacctacgtaacgtcgtacggaaccaaccggtcccggtaccccttccccgtagtaaccccgtagttcccgtccgtacccggtcccttacccgtaccggtacccgtacgggaaacccgggtaccggtacggtaccgttaagtttaattttaacgtttacgtttaccggacttccggtactattaacgttacgtcgaaacgtacggtaagtttaacgttacggtttaaggttacgggtacgggggttaccgggacggggtaaccgtaggtaccgggtacggttaccggtaggtaccgaccggacgacggtcccgacccggttcccgtagtacccgttcgtccgttcccgtaccccg

SEQ ID NO: 228077 - DNA, 728 bp, Homo sapiens
  misc_feature: GYAE6OF01D6GSI.23.21.B10.1.454.CMB.1.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (514)..(514): a, c, t, g, unknown or other
  misc_feature (514)..(514): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggccccagtctcgccctgactcacgcctgcctccgtgtcgtgggtctccgngacagtcgatccaccgtcctcctgcaccgtcgaacccgnagtgtagttggttaggtacttttaatagtgtcgtcgtacggtaaccaactaccctaccgaaggaccaaaccgaccccctaaattcctaattacctttagaggacggtacaaccgtaacgcccggtacccgttcggtacgggttttacacggtccgtactttcgcgtcgtccttaccgaagttccgtaggaaccaaccgtccggccctcccgacgaccttactccgttacgtcccgtaccctaccggacgttaccggtacggaccggtaaccggnggttaccttaagttaactttagtttagtccgacgttctacgtactagttagccgtaagtagttacgttaggttagtttacgttcggggtaggggtccggggaaccgggttaccgaagggtcccggttacggttaccggtaacgtcccggacggacccgaacggtccccgtccccgtcccgttacgccctttacgtcccggtaccccgttccccg

SEQ ID NO: 228078 - DNA, 794 bp, Homo sapiens
  misc_feature: GYAE6OF01D8V9L.23.21.B10.1.454.CMB.1.raw
  modified_base (210)..(210): a, c, t, g, unknown or other
  misc_feature (210)..(210): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcgaggacacgagggtcctcgggccctagtctcgccctgactcacgtcctcgtcctcggtgtcgtgggtctccgtggacngtcgtactcctaccgtctccgtgaccgtaccgttacggacccgtcgtaggttgtagtttacgggttacgggtttaaacttttaaagtcgttcggttccgttacggtacggtaaccctaacttacccgtaccgaacggaaccaaaacccgtacccctaacgtactaactttaccgttaggtacggtacggactaaccggtaacggccggttaccccgttagggtacgggttttccgtacgttccttaccgttccgtacggtcgtacccttagtaacgtccgtacggaccgtaaaccggtccgtacccctccggtaccacgtattcccgtcgtccggtcctaccgtcgtaccgtacgaccgggacgtacgtacgttattaattacgttacgtcgtctacgtctacgtaactacgtacgtaacttaagtaacggttcgtttaacggtttcggttaacggggtcgggtaaccggggacgggtacggtaccggtcggttaaccgggttgtaccggtacggaacctcccgggtacgtccccgtaacccggtcccgttacgacccgtccgttccccggttccgtacccccg

SEQ ID NO: 228079 - DNA, 808 bp, Homo sapiens
  misc_feature: GYAE6OF01B6WUV.23.21.B10.1.454.CMB.1.raw
  modified_base (164)..(164): a, c, t, g, unknown or other
  misc_feature (164)..(164): n is a, c, g, or t
  modified_base (647)..(647): a, c, t, g, unknown or other
  misc_feature (647)..(647): n is a, c, g, or t
  modified_base (665)..(665): a, c, t, g, unknown or other
  misc_feature (665)..(665): n is a, c, g, or t
  modified_base (787)..(787): a, c, t, g, unknown or other
  misc_feature (787)..(787): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactcctcctcactcaggacacgacgggtcctgggcccagttccncggtaccctgacttcacgtccgtcgtcccgtccggtggtcgttcgggttcctccgtggaccgtagtcgtactcctaccggtcctccgtagccgtacgtacccgggaacccgtcgtaaggttaccgtaaggtttcggggtttacggttaaacctttttaagtcggttcggttccgttacgggttaccggtaaaccctaaccttacccgttacccggtaacggaaccctaaaaccccgtaacccccctaaacttaacgttaacgtttaaaccgtttagggtacggggtaacgtaccctaaacggtaacgggtcccggtaccgttcgggttaacggtttccgtacgtacggttcttaccgtctcgtacgtacctggtctacggaccctaacgcccgtccgtcctacgaaccgttctcgtccggttccaccgtcggtacctacggtcgaacgttcggaccgtagtaccgtttaagtttagtccggtnttcggtccctagttactntagtacgctaaggttcttacggttagttacgttcgggacggggttaccgggacggtacggcggttaacggtcgttaacgtacgtaccgcggtccgacggtccgttaccccgtcgcgtaaccncggttacctcccccgtacccg

SEQ ID NO: 228080 - DNA, 1200 bp, Homo sapiens
  misc_feature: GYAE6OF01EF7PI.23.21.B10.1.454.CMB.1.raw
  modified_base (256)..(256): a, c, t, g, unknown or other
  misc_feature (256)..(256): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctcactcaggacacgagggtccgtgggccccagtcctcgccctgtactcacgcctgtcctccgtgtcgtcgggtctccgtggactagtcgactcctaccgtctcctcgcctacgtaccggaaccccgtnagtcgtagttcggttacggttaacttttaatagttcggttccgttaccggttacggtaaaccctaacgttaccccgtacccgaacggtaacccgtaaaaccccgaccccccctaaaacgttacccttaagttttaaaccgtttttaccggtaacggggtaaccggggtacctaaccggttaaaacccggccccgggttaccccggttttacgggtttaaacgggggtttttaccttaaccggggtttcccgtttaccgttttacccgttaccgggttacccgggttacccgttaaccccgggttaaaacgggtttaccgggttaccgggacccgttaaaaaccccggggttacccccggtacccccgtttaaccccccgggttaaccggtaacccccgttaacccgtttccccgggtttacccgggtttaaccccggggttacccccccgttaacccggtaaccccgggtttaaacccccggtccggggtaaaaacccggggtaaaccccgggttacccggggtacgttttacgggttttaaaaccgtttttacgtttttaaaccggttttcccggttaccgtttaacgtttaaccccttttacgttaaaccggtttaccggttaacggtaaccgggtttaaaacgggtttaaacgttttaaccgggggttttaaaccgggttttacgggttttttaacggggggttaaccccggggggggtttacccggggggggtaaaccccgggggggtttaaaacccggggttaaaccggggggtttacccccggggtttaaaccgggggttttaaccgggggggtaaaacccgggttttaccccgggtaaaacccccgggtaacccccccggggggtttaacgggtacccccccggtttaacccccggggtttccccccccgggtttaaccggtttaccccccgtttta

SEQ ID NO: 228081 - DNA, 777 bp, Homo sapiens
  misc_feature: GYAE6OF01AL4BG.23.21.B10.1.454.CMB.1.raw
  modified_base (559)..(559): a, c, t, g, unknown or other
  misc_feature (559)..(559): n is a, c, g, or t
  modified_base (580)..(580): a, c, t, g, unknown or other
  misc_feature (580)..(580): n is a, c, g, or t
  modified_base (602)..(602): a, c, t, g, unknown or other
  misc_feature (602)..(602): n is a, c, g, or t
  modified_base (611)..(611): a, c, t, g, unknown or other
  misc_feature (611)..(611): n is a, c, g, or t
  modified_base (636)..(636): a, c, t, g, unknown or other
  misc_feature (636)..(636): n is a, c, g, or t
tcagacgcgagtatcacgaccggtgctcgatttagtgtcgtcgcaagagaggaggggggggtcacaagaggcagcgctctcgggacgtcctccaccatcggcctgggctctcgctcgctcctcactcctcctcactcaggacacgacgggtcctcgggcccaggttcctacgcccctgacctcacgtcctcgccctccgtgttccgtcgggtcctccgtcgggactacggtcggacttccgacccgttctacctggacctaccggtaccggaacccgctaggttacgagtttcgggtttaggttaaacctttttaagcggttcgggtcctacgggtttaccggtaaacctaaaaccttccccgtaccggaaacgggtaacccaaaaccccgtaaccccccctaaaactttacccgtaaacttttaacccgtttaaggtcgggaacggaaccgttaccggtaaacggccccggtacccgtagggtttacgggttttaccacggttcgtaccctttcgtccgtcggcctacgtaatcgtacgacctaacgccgccttaccncgtacctacgtcctacgtccnccgtacacgcgtaccgagacgnggctacgtnttattctacgcgtacactcacgtanaggtctaacgttattacggtaaccgttaggttcgggtacgggtacgggtaaccgggacttacggtaccggtagtaccgggttcaccggttacggcttaacgcctccgggtacccttgactcccttcggcccggtttacccc

SEQ ID NO: 228082 - DNA, 887 bp, Homo sapiens
  misc_feature: GYAE6OF01BDVCE.23.21.B10.1.454.CMB.1.raw
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggaccacgacgggtccgtcgggcccagtctcgcctgactcacgcctgtcctccgtgtcgtcgggtcctcgtaggactacgtcgactccgtacccgttcctaccgtcgactaccgtacggaacccgtctaaggttcgtagttagggtttacgggttaacttttaagtacggttcggttccgttacggtaccgtaacctaacgttacccgtaccgaacggaacctaaaccgaccccctaaatctactttaacgttagtaggaccggtactaacggtaacggtccggtacccgttagggttaacgggtttctacggttccgttcgttaccgttccggtacgttacccgttaaccgtaacgttcccgtaacgggaaccaaaccccggtcccgggttaccccttaccccggtacaaccccttcgttacccgttaccggtcccggtaccccgttacccggaaccgttccccgggtaacgggtaacccggtaacgggttacggtacgtttaaacgttaaccgtttttacgtacggtttccgaccgttaccggtacctacggttatacgtcggtaaacttaaggttacgttacggtttacgtttaacgggttcggggacgggtttacccggggggaaccgggtagttaccggggttacgtacccgggttacggacggtaccggaaccgtccccggttacggttccccgtaccccgggttacccgttacggttaacctcccggttcccgttcccctacccccg

SEQ ID NO: 228083 - DNA, 866 bp, Homo sapiens
  misc_feature: GYAE6OF01EBJYV.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcacctctcctcactacgacgacgacggtcggtccggtccggaccgtcgtcgtccgtccgtacgtaccacgtccgtccgtccgtccgttcgtcgttcggtcgtcctcgacggacgtcgtacgtacctacccgttccttcctcgtccgtaaccgttaccggaacccggtaccgacggttacggtacgttggttaacgggtttacggtttaacttaaggttcggttcgttaccggttccggttaaaccgaaccgtaccttaccccggaacgggaaccaaaccccggtaaccccccaaccttaacgttacttaacggtttacgttgggaacgggactaccgtaacggcccggtccttaccggttagggttttaccgtctacggttccttacgtcgtcggacctacgtaacggtacctcgggtaaccaacccggtaccggttcccctacgttccgtaacccgtacttaccgttcgtacgggccccttaccgacgtccgtacggtccgaaacggtcgtattcgttacttaagtttcgtacgtcgacttagtacctattacgtgacctaagttaaggtaggttttaaccgttggtttaaccggggttaggggaccgggggttacccggggaaacgttccgggtaacggtccgttaagggtaaccggtccctaaacgggaccggtacccggtaccggtcccccgtccccggggtaccctctaaccccggttcccgttccccgtaccccgttaacc

SEQ ID NO: 228084 - DNA, 763 bp, Homo sapiens
  misc_feature: GYAE6OF01CBTW0.23.21.B10.1.454.CMB.1.raw
  modified_base (251)..(251): a, c, t, g, unknown or other
  misc_feature (251)..(251): n is a, c, g, or t
tcagacgcgagtatcacgaccggtgctcgatttagtgtcgtcgcaagaggagagggggggggtcacaagaggcagcgctctcgggacgtctccacatggcctgggctctgctgcctcctcactctcctcgactcgacggacacgtagggtcctgggccctagtctcggccctgactcagcctcgcctccgtgtcgtgggtcctccgtggactagtcgactccaccgtctccgtgaccacgtacggaacccncgtaggtcgtacttcgggttacggttaacttttagtcgtcggttccgtcggttaacggtaacctaacgttaccccgtaccgtaacgggaaccctaaaccgaccccccgtaaatctaactttacgttagacggacggacctacgtaacggccgtaccgtcggttacgggtttactacgtcgtctttcgcgtcgtctacgtacgtcgacgacacgtccgtcctaccgtcactctcgtcgtccgcccgttacgccgtccgtacggacgtagtaacgttcgtaattacgtttatacgtcgacttcgacctagtacgtagtcgtaacgtagttaacggttcggttttacgttacgggtttcgggtaacccggggtttcggggaaccgggttaccggttaagggcccgggtttaacggtcgggtaacccgtacgtacccgggtacggttacccggtcccggttaccccggttacccgtacggttaccctaccgtttccccgggttccctaacccccgg

SEQ ID NO: 228085 - DNA, 771 bp, Homo sapiens
  misc_feature: GYAE6OF01EBJHW.23.21.B10.1.454.CMB.1.raw
  modified_base (247)..(247): a, c, t, g, unknown or other
  misc_feature (247)..(247): n is a, c, g, or t
  modified_base (553)..(553): a, c, t, g, unknown or other
  misc_feature (553)..(553): n is a, c, g, or t
  modified_base (576)..(576): a, c, t, g, unknown or other
  misc_feature (576)..(576): n is a, c, g, or t
  modified_base (594)..(594): a, c, t, g, unknown or other
  misc_feature (594)..(594): n is a, c, g, or t
tcagacgcgagtatcacgaccggtgctcgatttagtgtcgtcgcaagagaggacggggggggtcacaagaggcagccgctctcgggacgtctccaccatggcctgggctctgctgctcctcactctcctcactcaggacacgagggtcctgggcccagtcctgccctgacctcagcctgccttccgtgtccgtagggtcctaccgtggactagtcgactccaccgtctctgcacgtacgaacccgtnagtgtacgttgtaggttacttttatagtcggtcgttcgtacggtaaccaagttcctaccgaggacctaaaccgacccctaactactaacgtttacgtttagacggacgggtacctaaccgtaacggcccggtacccttagggttacgggtttaccgtaacggttccggttactttccgtctcgggtaacccttaccgaacttccggttaggacccttaaaaccggtccggtacccttacccggtactaccgtacttccgtaccgttcggacccttcgacggtaccctaggaccgtacggtacggtnttacgtagtttaacttgtacgtntcgtactacttaacggtntacgtacgtaaggtaccgttaggttacgtttacgggttacgggtaaccgggtttacggggaccggggttaccaacgggttacgaaccgggttacggtacgggtacgaccgtacccggaaccggttcccacccggttccccgacgggttacccctcggtttcccgtcccggttccccc

SEQ ID NO: 228086 - DNA, 874 bp, Homo sapiens
  misc_feature: GYAE6OF01A17S4.23.21.B10.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacgggtcctgggcccagtctcgccctgactcacgctcgcctcgtntcgtcgggtctccgtgacngtcgatccaccgttcncctgctaccgtacggaacccncagtgtagttggttaggtacttttaagacgttcggtcgtcggtagtaccaactacctaccgagaccaacccgacccctaactctaactacttacgacggacggactacgacgtccggtaccgttacggtacgggtttactacggttccgtaccttcgtaccgtcggtctaaccgtacgtccgtcggaaccaccgtacccggtcccttacccgtacgtaccctacgttccgtccggttaccgtaccctaccggtaccgtcccggtaacggaaccggtacggtaacggttaccgttaacgttactttaacgttacgtttcggtaccttacggtacccttacgtaacgttccggtaacgttaaccggtaacgttaaacggtttaagggtttacggttttaccgggtttaaggggggttaaccggggtttacccggggggaaccggggggttaaacccgtacggggtttaccgggttaaaccccggggtttaccgggtaaccggggtttaaacccgaacccggggttaaacccccgggttaaccgggtacccccggtttaccccgggttaccccccgggtacgtttaccccggttaacccggtttcccggggtttcccccgggtttaaccccccgg

SEQ ID NO: 228087 - DNA, 715 bp, Homo sapiens
  misc_feature: GYAE6OF01EAK59.23.21.B10.1.454.CMB.1.raw
  modified_base (486)..(486): a, c, t, g, unknown or other
  misc_feature (486)..(486): n is a, c, g, or t
tcagacgcgagtatcacgaccggtgctcgatttagtgtcgtcgcaagagaggaggggggggggtcacaagaggcagcgctctcgggacgtcctccaccatggcctgggctctgctgctcctcactctcctcactcaggacacacgggtcctcgggcccagtccgtcgccctgactcagtcctcgcctccgtgtcgtcgggtcctcctgggactacgtccgactccgaccgttcctcccgtgtcctaccgtacggaaccccgctagtgtacgttggttagggttaacttttaatagttcggttacgttccggttacggtaacctaacttacccgtacccgacggtaaccaaacccgaccccctaaaactctaacttactttagtcggaacggtactacgacggccgtccgtacgtacgggttctacgtctcgttctgtcgtcctactacgtctacggaccaccgtaccggtccctccgtagaccctnttcctccgtcgtccctaccgacgtccgtaggaccgacgtacgggtactagttaacgtttattaacgttcgacttacggccttactagtactacgacgtaataacggttagtacggtttacggtagggttaccgggtaccggggacgggtaacgtcggtaccgggtacgtacggtccgaacgtccggaccgcgtccgccctcccgtactcggtactccgtccgttccccg

SEQ ID NO: 228088 - DNA, 741 bp, Homo sapiens
  misc_feature: GYAE6OF01A4DKL.23.21.B10.1.454.CMB.1.raw
  modified_base (115)..(115): a, c, t, g, unknown or other
  misc_feature (115)..(115): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (566)..(566): a, c, t, g, unknown or other
  misc_feature (566)..(566): n is a, c, g, or t
tcagacgcgagtatcacgaccggtgctcgatttagtgtcgtcgcaagagaggagggggggggtcacaagaggcagcgctcgtcgggacgtctccaccatggcctgggctctgctnctcctcactctccctacactcaggacacgtagggtcctcgggccctagtcttcgccctgtacctcagtcctcgtcccttcggtcgtcgtcgggttctccgtaggactcggtcgactccnccgtctctgcaccgtcggacccngacgtgtagtgttacgtacttttantgtctacgtctaacacttaccaccgagtaaccaacctacccctaactctaagttactagtcgaacgtcgtacgacggtccgtcccggttaggacggtttccgtagttccgtcctttacggtcccgtcggtacctacgtaacggtcgtaccgaaccgtacccgtaccggtacccttccgacctacgttcttccggtaccgtccgtcctacccgacgttacggccggaacgacggtaacggtacttacggtttactttaacggttgtaccttcgtcgattaccgtntacgcgtacgtagttacggttaaggttactttagggttcggtttaacggggtcgggggttaccggtacggttacccggtacggtttccgggttaacggtaccgtacggtacgtacccgtaccggttccgacccgtcccggttctacccgggttctacccggtttcccgtaccccg

SEQ ID NO: 228089 - DNA, 639 bp, Homo sapiens
  misc_feature: GYAE6OF02G60KE.23.21.B10.1.454.CMB.1.raw
tcagacgcgagtatcacgaccggtgctcgatttagtgtcgtcgcaagaggagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttggacttttaatatggtctcgtggtaccaatacctccaggcaaagccccaaatcatacttatgaggcactaagccggcctcgaggggtttcagtcgcttctctggctcaagtctggacaacgacggtccctccgtagacctattctctcggccctccagcctagaccgacggaggctacgtatttattagttgtccttagtccttcgtaattacgtggtactaaggtaacttaacggttagtttaaccgttttggtaacggggtttccgggaccggggggtaacctaacggggttcggtaacccgggttacggtaacgggtaccgtaacggtaccccggtaaggcccgttaccggtcccccgttaccggtacccgtacctttccgtacccgtttcccccc

SEQ ID NO: 228090 - DNA, 532 bp, Homo sapiens
  misc_feature: GYAE6OF02GFGLO.23.21.B10.1.454.CMB.1.raw
  modified_base (361)..(361): a, c, t, g, unknown or other
  misc_feature (361)..(361): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatacttatgaggcactaagcggccctgaggggtttctagtcgcttctctggctcagtctggcaacncggcctcctgaccatcctctcggcctccacgcctgacgacgaggctgattattattgcttgctctatatgcagtatagtagttactttgaggttcggacgggggacaggtcgaccgtggtaggtcacggcccgaaggcctcggccccgtcggtcctacgttcgtcgtcccc

SEQ ID NO: 228091 - DNA, 636 bp, Homo sapiens
  misc_feature: GYAE6OF02IHM0V.23.21.B10.1.454.CMB.1.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagacgcgagtatcacgaccggtgctcgatttagtgtcgtcgcaagaggaggggggggggtcacaagaggcagcgctctcgggacgtctccaccatggcctgggctcttctgctcctcactctcctcactcaggacacagggtccgtcgggcccgacgtctgccctcgactcacgcctcgccctccgtgtctgggtcgtcctggacagtcgatcaccgtctcctgcactcggaacccgcagtgatgttggtactttaatatgtctcgtggtacaactacctccacggacaaacgacccccaaacctacactactttatgagggacgacaacgacggcctcgtagggtttcgtagtcgtcttctntcccccgntccagtctgcacacggcctccncgacactctcgtcgcctccgacgccgtcgacgacgacggctcgtattattattgtctcgtctactatactgactagtagtaagttagttacgtttggtacgggttacggggaccggggggaacgtaacgggtacggtaccggtacggtacggttccgaacggtacccgaacgggtccgttccggcccccgttccgggtccgtacccgttcccgttcccgttcccccgtaccccgttacccg

SEQ ID NO: 228092 - DNA, 574 bp, Homo sapiens
  misc_feature: GYAE6OF02H8QB9.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtgtaccaatacctccagcaaagccccaaatcatacttatgaggcactaagcggccctgtaggggtttctagtcgcttctcgtgcctcaagtctggaccaacaccggccctccctagaccctatccgttcgtcggcctaccctacgcctgacgacgagctagtatttattattgctgtctctataagtcgcagattagtagttacgttgtaagggttcgggacggggtacgagggtcgaccggttcggtaaggttacacggacccgaacgggtcctacggtcccccgtggtcctaccttaccgtcgttcccccg

SEQ ID NO: 228093 - DNA, 743 bp, Homo sapiens
  misc_feature: GYAE6OF02JZ3AO.23.21.B10.1.454.CMB.1.raw
tcagacgcgagtatcacgaccggtgctcgatttagtgtcgtcgcaagagagaagggggggtcgacaagaggcagcgctctcgggacgtctccaccatggcctgggctctgctgctcctcactctcctcactcaggacacagggtcctgggcccagtctgccctgactcagcctgcctccgtgtcgtggtctcctggacagtcgatcaccgtctcctgacactggaacccgcagtgacttggttcgggtactttttaatacgttggtctcgtggtacctaataccctcccaggacaaacgcccccctaaatccgaatactttataggacgggcaacttaacgccggtacccttcgaacggggtttctacgtcgtcttctcgtcggctccaagttctagggaccaaacgaccggtccctacccgtcgaacccgattccgttccgtccgggtccctaccgtacgtccccgttacggaaacccgaccggtacgggcgttaacgtacgtttaacgtttaagttcggtacttcggtaccttacgtaacttagtacgcgtaagtaacgttttaagttacgttacgtttttacgggtaacgggggttaccggggtaccggggggtaacccgtaaggggttccggtacccgggtttaacgggtacgggttaccgacgggtaccccgtaaagggtcccgttacccggaccccggttccgggtaaccctacgttcccgttcccgttaccccccg

SEQ ID NO: 228094 - DNA, 788 bp, Homo sapiens
  misc_feature: GYAE6OF02H9TRG.23.21.B10.1.454.CMB.1.raw
  modified_base (230)..(230): a, c, t, g, unknown or other
  misc_feature (230)..(230): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
tcagacgcgagtatcacgaccggtgctcgatttagtgtcgtcgcaagaggagagggggggtcacaagaggcagcgcgtctcgggacgtctccaccatggcctgggctctgctgcctcctcactctcctcactcgacggacgaccaggggttccctgggccccagtcctcgaccctgacctcagtcctgcctccgtgtctggtctcctggacagtcgatccaccgtctccngaccacgtcggaaccctcaggttgagttggtttacggtaactttttaagtgttacggttcttcggttacggtaacccaaacgttacccctacccgaaggacccaaaaccgaccccctaaaactnaactttaacttttagngggacggactaacgtacgccggtcccttacggtaggggttcctacggtccgtacttccgtcgtccggtcccttacgtacggtccgttacgaccgtaaccgacccggtccctacccgtacgacccgtcttaccgtccgttaccgcccttaccgaccgtccctaggacccgaacgtcgggacctaggtatttacgttagttcgtcttacggcttacgtatcgtagtacgtaagttactacggttacgttacgttttacgggacggggttaccgggtaccggggtacgttaacggggttcggtaacccggttacgggtaaccgggtaccggacccggttaacccccggtaagggttccccgtcccgggtaccccccggtcggttacccctaacccgtttcccgtaccccggtttccccccg

SEQ ID NO: 228095 - DNA, 910 bp, Homo sapiens
  misc_feature: GYAE6OF02HPO2U.23.21.B10.1.454.CMB.1.raw
tcagacgcgagtatcacgaccggtgctcgatttagtgtcgtcgcaagagagggaggggggggtcacaagaggcagcgctcgtcgggacgtctccaccatggcctgggctctgctgctcctcactctcctcactcaggacacgagggtcctcgggcccagtctcgccctgactcagcctgcctccgtgtcgtgggtcctccgtggacagtcgatccaccgtctcctgccacgtcggaacccgcagtgtagttggttagggttaacttttaatagttggttcttcggttcggtaacctaattaccctcccgtaggacaaacgaccccccaaactcacttactttatggacggacaacgtaacggccggtacccttcggtaacgggggttttcctaacggttccgttcctttccgttccgtcgggtacccttaccgaaagttccgtacgggaccctaaaaccgacccgggttaccccttaccccgttacggaacccctaacttccgtttcccgttccggggtaccccttaccccgtaccggtaccccgtttacggggaaacccggtaacccgggtacgggtacccgtttagggttaaacttttttaaacgtttaacgttttaccggttccgtttaccgggtacccttaaccggtaactttaacgttaccggtaacgtaaacggttaacgtttaacggttaacgttttaaccggtttttaggggtaaccgggggttttacccggggggaccgggggggttaaacccgtaagggggtttacccggtacccggggtttaacgggttaacgggtaccgtaaccgggtaaccccggtaaacgggtcccgttacccgggtcccccccggttcgggttaccctaccccggtttaccgttaccccggtttaaccccccccg

SEQ ID NO: 228096 - DNA, 541 bp, Homo sapiens
  misc_feature: GYAE6OF02I0T0F.23.21.B10.1.454.CMB.1.raw
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
tcagacgcgagtatcacgaccggtgctcgatttagtgtcgtcgcaagaggaggaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaanatggtctcgtggtaccaatacctcccaggcaaagcccccaaatcatacttangaggcactaagcgccctnagggtttcagtcgcttctctggctccaagtctggcaacacggcctcctgaccatctctggccctccagcctgacgacgagctagattattattgctgctcatatgcagtatagtagtactttgaggttcggacgggggtactaaggtcgaccgtcggtaggtcaggccccgtaaggtccgtacggccccgttacggtccaccgttccgtacgttcccccg

SEQ ID NO: 228097 - DNA, 573 bp, Homo sapiens
  misc_feature: GYAE6OF02HROFB.23.21.B10.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgcctcctcactctcctcactcaggacacagggtcctgggcccagtctgccctgactcagcctgcctccgtgtctgggtctcctggacagtcgatcaccgtctcctgcactggaacccncagtgatgttgggtacttttaatatggtctcgtggtaccaatacctccaggcaaacgccccaaactcatactttatgaggcactaacgccggccctcgacggggtttctacgtcgtcttctctggctcctaagtctggacaacgaccggtcctccctgaccactctcgtcgcctcctacgtcctgaccgacgaggctgtattattattgctgtctctatatgacgagtatagttagttacgtttaggtagggttacgggacgggggtacgtaaggcgtacggtcggtaggtcgacgccgaacgcgtccgtcccgtcggtaccacgttccgtccgttacccc

SEQ ID NO: 228098 - DNA, 554 bp, Homo sapiens
  misc_feature: GYAE6OF02H6M5E.23.21.B10.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
tcagacgcgagtatcacgaccggtgctcgatttagtgtcgtcgcaagagaggagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcactggaacccgnagtgatgttgggacttttanatggctcgtgtaccaatacctccaggcaaagccccaaatcatactttangagcatagcgcctgtaggttntacgtcgtcttctcgtcgtctactaagtcgngacaacgaccggtcctcctagacctntctcgtgcctcagcctgacgacgagctagtattattatgtctacgtctatatgtgacaagtatacgttagttacgtttgacggttcgggacggggtaacgaaggtacgaccgttacggtaaggtaccgacgacccgtaacggcgtccgccccgttcgtacgaccttccgttacctcccc

SEQ ID NO: 228099 - DNA, 584 bp, Homo sapiens
  misc_feature: GYAE6OF02FLTFW.23.21.B10.1.454.CMB.1.raw
  modified_base (252)..(252): a, c, t, g, unknown or other
  misc_feature (252)..(252): n is a, c, g, or t
tcagacgcgagtatcacgaccggtgctcgatttagtgtcgtcgcaagaaagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaanatggtctcgtggtaccaatacctccaggcaaacgcccccaaatcatactttatgagggcactaacgccggccctgagggtttctagtcgcttctctggcctcaagtctggaccaacgcggcctcctgaccctatctcgtcggccctccagcctgacgacgaggcctagtatttattattgctgctcaattatgactagtattagtacgtttactttggtagggttcggggacggggtactaagggtcgaccggttcggtaggtcgacggtcccgaaggtcctaccggtcccccgttcggtaccctaccttccgttaccgttcccctaccccg

SEQ ID NO: 228100 - DNA, 704 bp, Homo sapiens
  misc_feature: GYAE6OF02H3K20.23.21.B10.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
tcagacgcgagtatcacgaccggtgctcgatttagtgtcgtcgcaagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccgtctcctgctactggaacccgnagtgatggttggacttttaantgtctcgttacgtaaccaatacctccaggtacaaacgcccccaaactctaatactttaangacggacacgtaacgccggtccctacgtacggggtttcacggttccgtctttactcgtggacccttaccgtaaggttcgtacgggacctaaacccggtaccggtccccttcccgtacgaaccctacgttccgttcgtccggtacccttaccgacggtcccgttacggaaccggacgggtacggtccttagtaactttagtttacgtcgttcgttcgcttactaatgtacgataacgtagttacgttagttacgttagggttaacgggttcccggggacggggtaaccgtaagggttccgaccggttcggtacgggtccgtaaccggtcccgaacggttcccgtccggtcccccgttacgggtccctacggtcttcccccggttaccctcccccg

SEQ ID NO: 228101 - DNA, 575 bp, Homo sapiens
  misc_feature: GYAE6OF02GXX9N.23.21.B10.1.454.CMB.1.raw
  modified_base (251)..(251): a, c, t, g, unknown or other
  misc_feature (251)..(251): n is a, c, g, or t
  modified_base (438)..(438): a, c, t, g, unknown or other
  misc_feature (438)..(438): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctccaggcaaagcccccaaactcatacttatgaggcactaagcgcctcgagggtttcagtcgcttctcgtggctccaagtctggacaacgacggccctacccgtgacctatctctggccctaccagccctgaaccgacggacgctagtatttacgtattgctgctnatagtcgactagtatagtacttacgtttggacgggttcgggacggggtaacagggttcaccggttcggtaggtccgaacgtacccgaaggccgttacggcccccgttaggcctaccgtccgttacgtcccccgtccc

SEQ ID NO: 228102 - DNA, 660 bp, Homo sapiens
  misc_feature: GYAE6OF02IE498.23.21.B10.1.454.CMB.1.raw
  modified_base (306)..(306): a, c, t, g, unknown or other
  misc_feature (306)..(306): n is a, c, g, or t
tcagacgcgagtatcacgaccggtgctcgatttagtgtcgtcgcaagaggaggggggggggtcacaagaggcagcgctctcgggacgtctccaccatggcctgggctcttctgctcctcactctcctcactcaggacacagggtcctgggcccagtctgccctgactcagcctgcctccgtgtctgggtctcctggacagtcgatcaccgtctcctgcactcggaacccgcagtgatgttgggtacttttaatatggtctcgtggtaccaatacctccaggcaaacgccccaaactcattacttangacgggcactaagccggccctcgtagggttctagtcgtcttctctcggctccaagtctaggctaacgcggtcctcctgacccatcctctcggtccctaccgacgtcccgtagaccggacggtacggtcttagtaactttaattacttgacttgaccttcaattacgtgactagaagttacggttaacgttacgtttagggtacgggtttaccggggaccgggggtaacctaaaggggttccgaacccgggttggtaacgggttaccgacgggtaccccgaagggtcccgtacccggtacccccgttcgggtacctaaccgttcccgtttacccgttccccctacccttacccgg

SEQ ID NO: 228103 - DNA, 666 bp, Homo sapiens
  misc_feature: GYAE6OF02JHNFO.23.21.B10.1.454.CMB.1.raw
  modified_base (304)..(304): a, c, t, g, unknown or other
  misc_feature (304)..(304): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgacctcagcctgcctccgtgtctgggtctcctggacagtcgatcaccgtctcctgcactggaacccgcagtgagtggtaggacttttaatatggtctcgtggtaccaatcctccaggcaaacgccccaaatcactacttangacggctacgtaagccggtcctagtacgggtttctagtcgtcttcgtcgtcggtcctactaagtcgtagacaacgaccggtccctacctcgacctactcgtcgtcggcctccgacgcctacggacgacgacggctagtattaacttgttagtccgtacgtccgttactaattcgtacgtaccgtagttaacgtttaacggttagtttaaccgttttagggtaacggggtttaccggggaccggggggttaacccttaaaggggtcgtaacccggttgggtaaccggttaccgaccggtacccgtagggtcccttacccggtccccttacgggtacccctacgttcccgtcccgttacccccg

SEQ ID NO: 228104 - DNA, 631 bp, Homo sapiens
  misc_feature: GYAE6OF02ICW6E.23.21.B10.1.454.CMB.1.raw
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagaggaggggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgatgttagggacttttaantggtctcgtggtacaatacctccaggacaaacgcccccaactcatactttangaggacactaagccgcctgagttgttctagtctcttctctgctacaagtctggacaacgccggtcctcctacgacctatcctcgtcgcctaccgacgcctgaccgagcggctagtatttattacgttcgctgcctactatatcgactaagtattacgttagttaccgtttaggtacgggttcggggaccgggggtaactaacgggttacggtaacccggttacgggtaacggttaccgaacggtccccggtaacgggtcccgttacccgggccccccggtttacgggttccctacccggttttcccctaccggtttacccccccc

SEQ ID NO: 228105 - DNA, 584 bp, Homo sapiens
  misc_feature: GYAE6OF02GDDJ2.23.21.B10.1.454.CMB.1.raw
  modified_base (305)..(305): a, c, t, g, unknown or other
  misc_feature (305)..(305): n is a, c, g, or t
  modified_base (427)..(427): a, c, t, g, unknown or other
  misc_feature (427)..(427): n is a, c, g, or t
tcagacgcgagtatcacgaccggtgctcgatttagtgtcgtcgcaagagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaataccctcccagcaaacgcccccaaactcatacttangaggcactaagccgccctgagggtttctagtcgtcttctctggctccaagtctggcaacgcggcctccctgaccatctctcgcctccacgcctgacgacgagctgtattattattgctgctnatatgactagattaagttagttacgtttggtacgggttcggggaccgggggtaacctagggtacggtacccggttcggttaacggtccggaacggtacccggaagggtcccgtaccggtccccccgttaccgggtacctaccgttcccgttccccgg

SEQ ID NO: 228106 - DNA, 665 bp, Homo sapiens
  misc_feature: GYAE6OF02FO0H4.23.21.B10.1.454.CMB.1.raw
  modified_base (258)..(258): a, c, t, g, unknown or other
  misc_feature (258)..(258): n is a, c, g, or t
tcagacgcgagtatcacgaccggtgctcgatttagtgtcgtcgcaagaggaggggggggggtcacaagaggcagcgctctcgggacgtctccaccatggcctggactctgctgctcctcactctcctcactcaggacacagggtcctgggcccagtctgccctgactcagcctgcctccgtgtctggtctcctgacagtcgatcaccgtctcctgcactcggaaccccgcagtgattggttagggtaacctttttaanagttggttccttcggttaggtaacccaattacccttcccaggacaaaccgaccccccaaactcatacttttatggacgggacaacgtaagccggtccctcgtagggtttctagtcgtcttctcgtggcctacaagtcgtcggaccaacgaccggtccctacccgtgacctactcctccgtcgccctccacgcctcgacgacgacgctgtactttattagttcgtctcgtctcgtattatacgtcaagtattagttagtttaacgtttggtacggtttcggggacgggggtaaccgtaagggtacggtacccggtacggttacggtacgtacctaaccgggggggtactcccggtcgtccccccgttacggtcccgtaccgtccgttacccgttccccgttacccccg

SEQ ID NO: 228107 - DNA, 719 bp, Homo sapiens
  misc_feature: GYAE6OF02I5S91.23.21.B10.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtcctgccctgactcagcctgcctccgtgtctgggtctccgtggacagtcgatcaccgtctcctgcactcggaaccccnagtgattggttgggtaacttttaagtattggtcttcggtcggtaaccaacttacctcccaggccaaacgcccccaaatcaacttactttatggacgggactaacgtaacggccggtcccttacggtacggggtttactacgtcgtcctttctctcgggctaccgtaagtcctgggaccaacgtaccggtccctacccgtacgtaccctcgttcctcgtccggccctacctacggtccgtacggaaccggaccgtacggccttagttaacgttttacttaggtttcaccgttcgtaccttactaattacgtacgctaagtacgttaaggtttacttacggtttcgggtaacggggttccgggtaaccgggggtaccgtagggttcggttacccggtacgggtccggttaaccaccggaccgtaacggtccgtcccccggtaccccggttcgggtacccttacccgttccggttacccctacccccg

SEQ ID NO: 228108 - DNA, 755 bp, Homo sapiens
  misc_feature: GYAE6OF02JOAHP.23.21.B10.1.454.CMB.1.raw
  modified_base (219)..(220): a, c, t, g, unknown or other
  misc_feature (219)..(220): n is a, c, g, or t
  modified_base (258)..(258): a, c, t, g, unknown or other
  misc_feature (258)..(258): n is a, c, g, or t
  modified_base (580)..(580): a, c, t, g, unknown or other
  misc_feature (580)..(580): n is a, c, g, or t
tcagacgcgagtatcacgaccggtgctcgatttagtgtcgtcgcaaggagagaggggggggtcacaagaggcagcgctctcgggacgtctccaccagtcggcctgggctctgcgtgctcctcactctcctcactcgaggacacgaggtcctgggcccagtctgcctgactcacgcctgcctccgtgtcgtggtctctggacagtcgatcaccgtctccnncacgtcgaacccgcagtgagttggtaggtacttttaanagttggtacgtcggtggtaacctaacgttacccgtaccgtaggacctaaaccgcccccgtaaaatcgtaattaacctttagtacggacggtactaacgtaacggcccgtacccgttacgggtacgggttttaacctacggttccgtactttccggtcggttaccggtccttacggtaacgttccggtacgggtaacctaaaaccggtcccggtccgttaacccgtagtaccctaacttccgtctaccgggcccctactacgtcccgtggtaaccccggagtacgtacctagtacgtttaattacggtcgtacgtcgtacctntaactagttcgaaacgttacgtagttaccgggttaattaccgggttttaggaaccggggttccgggtaaggggacctacggggtcgtaaccggttacgggaccgttccgaccggaccggtaacggcccgttcgaaccccggttccgtccggtaacttcccgtacccgttccccgg

SEQ ID NO: 228109 - DNA, 604 bp, Homo sapiens
  misc_feature: GYAE6OF02JM5X5.23.21.B10.1.454.CMB.1.raw
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccacgtcggaaccccnagtgattggttggtacttttaanttggtctcgtggtaccaatacctccaggcaaacgccccaatcattacttangaggcactaacgccgcctgtagggttctagtctcttctcgtgctacgagtctggacacgacggcctccagacctactctcgtcgcctccacgtccgtagaaccgacgacgtctagtacttattntgccttcgacttacacttancgaacgtagtacttacggtagtttcgttagggtacgggttccggggaggggaacctagggtcgttacgtcgtaacgggtcaacggacccggtaggtacccgtcccggtaccccgttacggtccctacgttcccggttacccgtcccccgtccg

SEQ ID NO: 228110 - DNA, 826 bp, Homo sapiens
  misc_feature: GYAE6OF02G867R.23.21.B10.1.454.CMB.1.raw
  modified_base (132)..(132): a, c, t, g, unknown or other
  misc_feature (132)..(132): n is a, c, g, or t
tcagacgcgagtatcacgaccggtgctcgatttagtgtcgtcgcaagaggaggggggggtcgacaagaggcagcgctctcgggacgtctccaccatggcctgggctctgctgctcctcactctcctcactcnggacacaggtcctgggcccagtctgccctgactcacgcctgcctccgtgtcgtgggtccttcctggacagtcgatcaccggtcctcctgcactacgacccgctagtgagtgttagggtactttttaagtagttggtccttcgtaggtaacctaattaccctccccgaaggacaaaaccgcccccctaaaactcctaagttaactttatggaacgggacctaacgtaagtacccggcccttacggtaagggttttctaggtcctccgtttctcgtcggaccttaccgtaaagtccgtacggtacctaacccgtaccggtaccccgttcccctaacgaacccgtaagttccccttcggttcccggtcccttacccgaccggttaccccttcgggaaacccgacgggtaaccggacgtttacggtaattttaacgttagtttaccgcgttccgtcttacgtacgttactaggtacctaagttacgttaagttaaccgttttccgtttaagggttacggggttttaccgggggaaccggggttaacccgaacggggttaccggtacccgggttacgggttaacccgggttacgtacccgaaccccgggtaacgggtcccgtttaacccggtcccccccggtttacccgggttaacgttcccgtttaccccggttccggttacccccccttaacccccg

SEQ ID NO: 228111 - DNA, 586 bp, Homo sapiens
  misc_feature: GYAE6OF02G4MR8.23.21.B10.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (380)..(380): a, c, t, g, unknown or other
  misc_feature (380)..(380): n is a, c, g, or t
  modified_base (417)..(417): a, c, t, g, unknown or other
  misc_feature (417)..(417): n is a, c, g, or t
tcagacgcgagtatcacgaccggtgctcgatttagtgtcgtcgcaagaggaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaanattggtctcgtggtaccaagtacctcccaggcaaagcccccaaatcattactttatgagggcacgtaagccggccctcgtagggtttctagtcgtcttctctggctccaagtctggcaacacggcctccngaccagttcctcgtcgcctccacgtcctgaccgacgngcgtgtattatattgctgtctcaattagtcgactaggtatagttacgttacgtttgaacgggttccggggacggggtaccgtagtcggtaccggttcggtacgggttcacgtcccgaaaggtcgtcccgtccccgttcggtcctaccgtcgttccggttcccgtacccg

SEQ ID NO: 228112 - DNA, 842 bp, Homo sapiens
  misc_feature: GYAE6OF02IR8O3.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacacgggtcctcgggcccagtctcgccctgacctcacgcctgccctcgtgtcgtgggtctccgtggacagtcgatcaccgtctcctgcacgtcggaacccgcagtgagttggttacggtaacttttaagtagttcggtcctcggttacggtaacctaactacccgtacccgaggaacccaaaccgaacccccctaaactcctaactttaacctttagacggacgggtacctaaccgtaacggcccggtacccttacggtaacggggttttcctacggtccgttcttccgtcggtacggtaccttacccgtaaggttccgtacggaacccaacccggtaccgtcccctacccgtactaacccgtacttcccgtcggtcccgtacccttaccgacgtcccgtacgaacccgggtacggtacggtcgttaacgttaacgttttacgtttacgttccggtccgtttcgaccttacgtaactaacgttcgtaaccgtaaagtttacgttaaacgtttaacggttacggtttacggggtaacggggtttaccggggaaccggggggtaacgtaaccggggttccgttaccgggttaccggttaaccgggtacccgtaacccgggtaacccggttacggtacccggttcccccggttacccccggttccggttacccggtacccgttttcccggtccccggttaccccccg

SEQ ID NO: 228113 - DNA, 664 bp, Homo sapiens
  misc_feature: GYAE6OF02G4PPG.23.21.B10.1.454.CMB.1.raw
tcagacgcgagtatcacgaccggtgctcgatttagtgtcgtcgcaagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattggttagggtacttttaatatggtctcgtggtaccaatacctccaggccaaacgccccccaaactcaattactttagtggaggcaactaagccggcctcgtagggtttcacgtcgctttctctcggcctcgaacgttctcggaccaacgaccggccctcccgtacgaccctacttcctcgtcggccctccgacgtcccgtacgaccggacggacggtctagtaactttattagttcgcttcgtctactaattcgtcgactaagtagttagtagtttacgttttgggacggggtttcggggaccgggggtaactaaggggtccgtaccgggttcggttacgggtcgaaccggtacccgtaacgggtcccgtcccggtccccccggttcgggttaccctacccgtttccgttacccgttccccctaccccg

SEQ ID NO: 228114 - DNA, 650 bp, Homo sapiens
  misc_feature: GYAE6OF02G6ROG.23.21.B10.1.454.CMB.1.raw
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (315)..(315): a, c, t, g, unknown or other
  misc_feature (315)..(315): n is a, c, g, or t
  modified_base (448)..(448): a, c, t, g, unknown or other
  misc_feature (448)..(448): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactcctcctcactcaggacacagggtcctgggcccagtctgcccctgacctcagcctgccctccgtgtctgggtctcctggacagtcgatccaccgtctcctgccactcggaacccncagtgatggttggtacttttaangttgtctcgtcgtaccactcctccaggaccaaccgaccccaatcacttacttanggacggcacgtacgccgtcctcggtacgggtttctacgtcgtcttctcgtcgacctcgtacggtctcggacctaaccgaccgtccctcccgcgacctcttcctcgtcgccctccgacgtcctcggacgaccgngtactgttacttattgttcgtctctctactntancgtatagtagttacgttagtttccggttgggttaaccggggttcggggtaaccggggtaccgttagggtaccggtaccggttagggtacggtaccggacggtacccggtaggtcccttaccccggtccccgttacgtcccgtacggttccccgtcccgttacccccgg

SEQ ID NO: 228115 - DNA, 779 bp, Homo sapiens
  misc_feature: GYAE6OF02H7EMF.23.21.B10.1.454.CMB.1.raw
  modified_base (128)..(128): a, c, t, g, unknown or other
  misc_feature (128)..(128): n is a, c, g, or t
  modified_base (525)..(525): a, c, t, g, unknown or other
  misc_feature (525)..(525): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctctcactctcctnactcaggacacagggtcctgggcccagtctgccctgactcagcctgcctccgtgtcgtcgggtctcctggacagtcgatccaccgtctcctgccacgtcggaacccgcaggttgaacgttgggtttacgggtaaccttttttaaaagtagttcgggttccttcggttacgggttaaccctaaacttacccgtaccccgaagggtaaccaaaaccgaccccccctaaaaacttccaaactttaacctttttaagtcgggaacgggtaccaaccgttaaacggccccgggtaccccttacgggttaacgggggttttctaacggttccgtactttccgtacgttcggaccctaccgaaaggttcgtacgggaccaaacgacccggtcccttacccgtanaaccctactccttacggtccggtacccctaccgagccccttaggaacccgtacgggacggcttaaggtaattttaagtttattcggtattcgcttacattactgactaagtagttagttacgttacgtttagggtaccgggttcggggacggggtaactagggtacggtcccggttaggtcgttaaccgacggtacccgaacggtccctacccggtccccgtaggtccctaccgtttccgtacccgttcccccg

SEQ ID NO: 228116 - DNA, 844 bp, Homo sapiens
  misc_feature: GYAE6OF02JGLHX.23.21.B10.1.454.CMB.1.raw
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcgagcctgcctccgtgtcgtgggtctcctggacagtcgatcaccgtctcctgcactcggaaccccnagtnagttggttaggtacttttaanagttggtcttcggtcgtaccaatccctccagaccaaacncccccaaatcacttacttatcggaggcctaacgtaacgccgtcccttggtacggggttttcctacgttcgtacctttccgtacgtcggtcctaccgtaacggttccgtacggaccaaaccgtaccggttcccttaccccgtacggaacccctagttacccgttccgtaccgggtaccccttcccggaaacggtccccttacggaaacccggttacggacgggttaccgttacgtaatttttacgtttaacggtttcggtaccgtttacggtcccttaaacgtctttacgtacgtaaccgtaaaggttaccgtttaaagggtttacggttttacccggtttaggggttaccggggggtttaccccggggtaacggggggttaacccgttaacggggtttaccggttaccccgggtaaggttttaacccgggtacccgggtaaccgggtaacccccgttaggggtaacccctttaccccgggttccccccgggttaaccggtttccctaccccgggtttacccgttaccccccggttttcccccccggg

SEQ ID NO: 228117 - DNA, 803 bp, Homo sapiens
  misc_feature: GYAE6OF02J1W9U.23.21.B10.1.454.CMB.1.raw
  modified_base (256)..(256): a, c, t, g, unknown or other
  misc_feature (256)..(256): n is a, c, g, or t
  modified_base (321)..(321): a, c, t, g, unknown or other
  misc_feature (321)..(321): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacagggtcctgggcccagtctgccctgactcagcctgcctccgtgtcgtggtctcctggacagtcgatcaccgtctcctgcacgtaggacccgcagtgattggttacggtacttttaangttggtcctcggtggtaaccaactaccctccaggtaccaaacgccccctaaatctattacttagngacggtcaaccgtaacggccggtcctacggtacgggtttcacgtccgtctttcgcgtcgccttaccgaagttcctacggacctaaccgtacccggtccctcccgtacgtaccccgtacgttacccgttcccgtacggtccccgtaccgtaaccgtcccgtaacggtacccgggtaaccggtaacggtccgtttaaacgtttaacgtttaacgttttaacggttcgtaacccgtttcgtaccttacgttaaacgttacgttacggacttaaaggttaacgtttacggttttaaacggtttccgttttagggttaacgggggtttaccggggtaacccggggtaaccgggttaacgggttccggtacccggttacggttaaccggtccgtaccggttaccggtaaccggttaccgtcccggttacccccggttaccggtacctttacccggttacccgttttcccggtaccccccggttccccg

SEQ ID NO: 228118 - DNA, 727 bp, Homo sapiens
  misc_feature: GYAE6OF02IIB6Y.23.21.B10.1.454.CMB.1.raw
  modified_base (124)..(124): a, c, t, g, unknown or other
  misc_feature (124)..(124): n is a, c, g, or t
  modified_base (243)..(243): a, c, t, g, unknown or other
  misc_feature (243)..(243): n is a, c, g, or t
  modified_base (630)..(630): a, c, t, g, unknown or other
  misc_feature (630)..(630): n is a, c, g, or t
tcagacgcgagtatcacgaccggtgctcgatttagtgtcgtcgcaagaggagagggggggggtcacaagaggcagcgctctcgggacgtctccaccagtcggcctgggctctgcgtgctcctcnctctcctcactcaggacacagggtcctgggcccagtcctgccctgacctcacgcctcgcctccgtgtctgggtctccgtggacagtcgatccaccgtctcctgccacgtcggaacccgnagtcgattggttggtactttagtgtggtctcgtacgtacctaactaccgtaccgagaccaaaccgtccccaaacgtctactttacgtttacgtaggtacggtacacgtaacggcccggtacccttacggtaggggtttccttacggtccgttcgttaccgtggtcggtacctccgtaaggtcgtacggtaccaaccgtaccggtcccctaccgttacaccgtactccgtccgtcgccctcgtcgccgtggaccgtacgtacgtctacgttaacgttattcgtcggaccttacggtaccttacgattacgtccgtactaacgggttacttaacggggttacgttacggtttaacgggtaccgggggtttacgggacccgggggttaanaaccgggttacgtacccgggttggtaacggtccgaaccgggtacccgacgttccgtcccggccgttccgtaaccttcccgttccgtcccgttacccc

SEQ ID NO: 228119 - DNA, 683 bp, Homo sapiens
  misc_feature: GYAE6OF02JTLYC.23.21.B10.1.454.CMB.1.raw
  modified_base (653)..(653): a, c, t, g, unknown or other
  misc_feature (653)..(653): n is a, c, g, or t
tcagacgcgagtatcacgaccggtgctcgatttagtgtcgtcgcaagaggagaggggggggtcgacgaagaggcagacgctctcgggacgtctccaccatggcctgggctctggctgctcctcacgtctcctcactcgaggacacagggtcctgggcccagtctgccctgactcagcctgcctccgagtctgggtcacctggacagtcgatcaccgtctccgtgcactcgggaaccccgcgtagtcgattcggttggggaacctttttaaagtacgtcggttcgtcggttacggtacctaacgtaccctccacggacaaaccggcccccaaaacttccgtaacttaccgtttactacggtacggaccgaaccgttaacggccggtacccctacgtacgggggttttacctaaggtccgtccgttctccgtcgggtcccttccgtaacgtccgttcggtaccgaaaacaccgggtccctcccgttacggacctatttccctcgtaccggtcccgttccggacgtccccgttacggaaccggtaccggtacgggtccgtaggttattacgtttaacgttcgtcgcgttctctagtacttcggctagtatagttacgtacgttgagggtcggacgggactaggcgtcgtgaacgtnacgccaagcacgccgatcacttcgatcccg

SEQ ID NO: 228120 - DNA, 834 bp, Homo sapiens
  misc_feature: GYAE6OF02HFI10.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtcctcgccctgactcacgcctgcctccgtgtcgtgggttctccgtggacagtcgatccaccgtctcctgccacgtcggaacccgtcaggttagtagttggttacggggttaacttttttaaagtagttcgggttcgttacggttacggtaaaccctaacgttaccccgtccccgaagggaacccaaaaaccccggtacccccctaaaaaccttccaacgtttaaccttttaaggtacggtaacggggacctaaccgtaaacggcccggtacccttacggttacggggtttctacggtccgtccgtttcgtacgtcggtaccttaccgtaagtccgtacggacccaacgtacccgtcccgttaccctacgtaccctactccgtacgttcccggaccccttccgaccgtaccgtacgggtaacccgacggtacgtcgttacgttagttttaacttacgtttcgcgtttacgccttacttaactacgtagacgtaagtaactttaggttaacggttttacgtttacggggtacggggttaccgggaacgggggttaacctaaggggttccggtaaccggtttcggaaacggttccgaaccggttacccgggaacgttcccggttacccgggtcccccgttacgggttacccttacccgtttcgtacccccggtttaccccc

SEQ ID NO: 228121 - DNA, 786 bp, Homo sapiens
  misc_feature: GYAE6OF02HPKVB.23.21.B10.1.454.CMB.1.raw
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcgtgggcccagtctcgccctgactcagcctgcctcgtgtctgggtctcctggacagtcgactccaccgtctcctgcacgtcggaaccgcagtgagttggttggtaacttttaatgtcggtctcggttacgtaacctaactaccctccgaaggaccaaaccgacccccaaaactctaattactttagtcggagggactaactaacggccggcccttaggtacggggtttctacggtcgtcctttcgtcgtcggtacctaccgtaacgttcgtacggaacctaaccgaccggttccctacccgtacgtaaccctacgttccgtaccggttccggtccctacccgacggttcccgtacgggaaccgtaaccgggacggttacgtacggtttaaacttttagtttacgttcggtacttcggttacctacgttaatacgttgacggttaaacgtagttaacggtttacggttacgttttagggggaccgggggtttcgggggaaaccgggggtaaccgttaacggggtcggttaaccccggtagggtttaaccgggtacgtaccgggtacccgtaaccgggtccgttaccccggttcccggtaccggtaccctacccgtttcccggttaccccgtttaccccccg

SEQ ID NO: 228122 - DNA, 832 bp, Homo sapiens
  misc_feature: GYAE6OF02FFPTQ.23.21.B10.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagaggagggggggggtcacaagaggcagcgctctcgggacgtctcaccatggcctgggctctgctgctcctcactctcctcactcaggacacaggtcctgggcccagtctgccctgactcagcctgcctccgtgtctcgggtctccgtggacagtcgactcaccgtctcctagcctacgtcggaacccncaggtagagttcgggttacgggttaactttttaagacgttaggttccgtacggttacggtaacctaactacccgttacccgacgggaacccaaaaccggtacccccctaaacttcctaacgtttaaccgttttagtacggacgggtacctaacgtaaacggtccccggtacccgtacggtacggggttttacctacggttccgttccgttacttccggtcggaccgttaccgtaacgttcgacggtaccaaccggtacccggtaccctcccgtacgacctacgttccgtacggccggtacctcccgacggccgtaaccggaacggtaaccgggtacggtaccgttaacgttacgtttaacttacgttgtacctcggttacctcgtagttacggtacgaccgtaagttacgtaacgttaacggtttacggtttaacggggttaccggggttaccggggtacgggggtaaccgtaacgggtaccggttacggtacggtacggtaaccggtacggaacccggtacgggttcccgttaccccggtaccccggttaccggttaccggtacccttaccggttaccccgttccccgttaaccccg

SEQ ID NO: 228123 - DNA, 815 bp, Homo sapiens
  misc_feature: GYAE6OF02JMC2N.23.21.B10.1.454.CMB.1.raw
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
  modified_base (469)..(469): a, c, t, g, unknown or other
  misc_feature (469)..(469): n is a, c, g, or t
tcagacgcgagtatcacgaccggtgctcgatttagtgtcgtcgcaagaggagagggggggggtcacaagaggcgagcgctctcgggacgtctccaccatggcctgggctctgctgctcctcactctcctcactcaggacacagggtcctgggcccaggtctgccctgactcacgcctgcctccgtgtctgggtcctccgtggacagtccgatcgaccgtctccgtgacacgtcggaacccncacgtgactggttggtaacttttanagtcggtctacggtcggtaccaataccgtccgacggacctaaacgcccccgtaaaactccgtaattaccgtttagtacgggacgggtacctaccgtaacggtccggtaacccgtcggtaacggggtttctaagtccggtctttacctcgcggtccttacgacgttccgagggcctaacggaccgtcttacccgtagacccgtntaccgtcggtccgtacccgtcctacggtcccctaacgggtaccggtaacgtaccggttaccggtaccgttaaccgttaaccgttttagtaccgggttaccttccgtaaccgttccgtaacgtttaacgtcgaaccgttaaggttacggttaccggttaacgttttacggttacgggtttaaccggggttccgggtaaccgggggggtaaccttaacgggttacggttaaccgggtttacggtaacccgggttaaggtacccggtaacccggttaacggtacccggttcccggttaaccccggttccgggtaacctttacccggttccgtttaccccgttacccccg

SEQ ID NO: 228124 - DNA, 681 bp, Homo sapiens
  misc_feature: GYAE6OF02JXNEF.23.21.B10.1.454.CMB.1.raw
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtccgtcgggcccagtctcgccctgactcacgcctgccctccgtgttcgtcgggtcctccgtggacagtcgactccaccgtctcctgcacgtacggaacccgcagtgagttcgttggtaacttttaatgtcggtcgtcggtacgtacctaactaccctaccgagaccaaaccgcccaaactctatactttagaggacggacctaacgacggtccgcccgttacggtaggtttcacgtcgtccttctcgcggtcctaccgagtcgngaccgaccgtaccgtccnctacactctcgtaccgcgtccnctacgcgtcgaccggacggacgtcgtagttacgtttaattacgttggtccgttcggtaccttacgttactactgtacgtaaggttacgttaaggtcgttacggtttacgggtacggggttaccgggaacggggtacgtaacggtcggtacgtacggtacgtaccggacggtacccggtacggtccgtacccggttcccgtccgttaccggtccgttccgttacccgttcccc

SEQ ID NO: 228125 - DNA, 705 bp, Homo sapiens
  misc_feature: GYAE6OF02JFKXH.23.21.B10.1.454.CMB.1.raw
  modified_base (77)..(77): a, c, t, g, unknown or other
  misc_feature (77)..(77): n is a, c, g, or t
  modified_base (129)..(129): a, c, t, g, unknown or other
  misc_feature (129)..(129): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
tcagacgcgagtatcacgaccggtgctcgatttagtgtcgtcgcaagaggagaggggggggtcacaagaggcagcgntctcgggacgtctccaccatggcctgggctctgctgcctcctcactctcctnactcaggacacagggtcctgggcccagtctgccctgactcagcctgccctccgtgtctcgggtcctcctggactagtcgatccgacgtctccgtgcactcggaacccnagtcagtggtgtaacttttancgtcgtaccgtgtaaccaattaccctcgagacaaaccgccccaaagtctaacttacttagcgtacggacacgtacgtccgaccttcggtaagggtttcacgttccgtccttcgtcgttacggtcctactacggtctacggtacacgtaccggtccctacctgaacctacgttacctcgtccgtaccctccgtaacctccgtacgtaccccggtaggtaacggttctacggttaatttacgttacttgtaccgtcttacgtacttagtacgttgaacgtaggtaactttaacggtagtttaacggttacgggttaccggggttaacgggaccgggttaaaccgaccgggttacgttaaccgggttcggtttacgaccggttaaccgaccggtaagtccgtacccgtcccgttaacggccttaccgtttccggtacccgtcccgtcccg

SEQ ID NO: 228126 - DNA, 827 bp, Homo sapiens
  misc_feature: GYAE6OF02JUN8O.23.21.B10.1.454.CMB.1.raw
  modified_base (594)..(594): a, c, t, g, unknown or other
  misc_feature (594)..(594): n is a, c, g, or t
tcagacgcgagtatcacgaccggtgctcgatttagtgtcgtcgcaagagaggaggggggggggtcacaagaggcagcgctctcgggagtctccaccatggcctgggctctgctgctcctcactctcctcactcaggacacagggtcctgggcccagtctgccctgactcagcctgcctccgtgtctgggtcctccgtggacgagtcgacgtccaccgttcctcctgcctacgtacggaaccccgcagtcgagttggttacgggtatttaactgtgtctcgtgtacactcctccaggacaacgaccccaactctactacttagtggacggacaacctacggtccggtaccccgttacggtacgggggtttacctaggttccgtacctttccgtcggtcgtaccgttacccgtaaacgttccgccggtaaccgaaccggtacccggtaccctccccgtacggtaaccctacgttccgtttccggtacccgtcccgtacccacgggttccccgtaaggacccgggtaaccggtacgtacggttaattaacgtttaaacgtttaccggttctttaccggtaccgttacctaaacgttnttaacgcggttaaccggtaagttaacgttaacgggtttacggtttacgtttacggggtaaccgggttacccggggggaacgggggttaaccctagggggtttacccgggaaccgggtttaccggggtaaccggttaaccggaacccgggttaccctaacgggttaccccggtacccggttcccccgggttaacggttaccctaacccgggttcccttccccggtttacccccg

SEQ ID NO: 228127 - DNA, 762 bp, Homo sapiens
  misc_feature: GYAE6OF02HIO1R.23.21.B10.1.454.CMB.1.raw
tcagacgcgagtatcacgaccggtgctcgatttagtgtcgtcgcaagaggagggggggggggtcacaagaggcagcgctctcgggacgtctccaccatggcctgggctctgctgctcctcactctcctcactcaggacacgagggtcctgggcccagtctcgccctgactcagcctgcctccgtgtcgtgggtctccgtggacagtcgatccaccgtctcctgcacgtcggaaccgcagtgtagtggttaggtatttaatgtggttctcggtacgtaaccaactacctccgagtaccaaaccgaccccccaaatctaattacttagaggacggacaacgtacgccggacccttggtacgggtttctacggtctccttactcgtgtacctactacgtcgtggacctaaccgccggtccctacccgtacgacctacttcctaccggtccggcccttacccgcgtacccgtcgggaacccgacggtacgtactacggttaatttactttagttcggtacttcgtacctatacttagacgtacgtaagtaacgtttaggttacgtttacggtttaggggttaccgggggttaaccggggggaccgggttaaacgggacgggttccggttacccggggttacggttaaccgggccgtaacccggggtacccgttaacggggaccccccgttacccccggggttcccccgttaccgggtaccttacccggttttccccggttcccccgtttaaccccccgtacccccg

SEQ ID NO: 228128 - DNA, 764 bp, Homo sapiens
  misc_feature: GYAE6OF02I4JAC.23.21.B10.1.454.CMB.1.raw
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacgagggtcctgggcccagtctgccctgactcagcctgcctccgtgtctggtctccgtggacagtcgatccgaccgtctcctgccacgtcggaacccgcaggtgtagttggttacggtaacttttaagtcgttcggtctcggtagtaaccaacttacccgtaccgaaggtaaccaaaaccgtaccccctaaaactcctaacgtttaacgttagtacggacggtaccgtaacgttaacggccgtacccgttacggtacgggttttactacgttccgtcgttccgtcgtacggtacctaaccgtacgtcgtacggacctaaacgccggtcctaccgttacgaccgtcttacctccggtacgtaccctaccgacggtaccgtacgaacggacgtagtcgttagtactttagttagtcgtacttacggcctataacgtagacgtaccgaagttaggttaacgttaggttacgtttaggaccggggtttacgggaccggggttaaacacggggttacgtaacccgggttaggtaaccggtaccggtaaccggtaccggtaacccggtacccgttacccggtaccccgttaacgtacccggtttaccgtacccggtttccccgttacccccgg

SEQ ID NO: 228129 - DNA, 676 bp, Homo sapiens
  misc_feature: GYAE6OF02GENJM.23.21.B10.1.454.CMB.1.raw
  modified_base (141)..(141): a, c, t, g, unknown or other
  misc_feature (141)..(141): n is a, c, g, or t
  modified_base (236)..(236): a, c, t, g, unknown or other
  misc_feature (236)..(236): n is a, c, g, or t
  modified_base (459)..(459): a, c, t, g, unknown or other
  misc_feature (459)..(459): n is a, c, g, or t
  modified_base (511)..(511): a, c, t, g, unknown or other
  misc_feature (511)..(511): n is a, c, g, or t
  modified_base (525)..(525): a, c, t, g, unknown or other
  misc_feature (525)..(525): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacngggtcctgggcccagtctcgccctgactcagctcgcctcgtgtcgtgggtctccgtggacagtcgactcaccgtctcctgccacgtcggaacccncagtgagttcggttaggtaacttttatagtcggttcgtacggtacgtaacctaacttacccgtccgaggtaccaaaccgacccctaaaatctaacttacgttagacggacggtacaacgtaacgccggtacctggttacgggtttcacgtcgtcttcgtcgtcggtctaccgacgtcgtcggacaaccgtccgtccctcctacgacctatccgtcgtccgccnctacggcctacggaccgagtcggtacttgtaatttacgttacgtgcgttacncttacgtatttcgngtaactagttacgtagtttacgttcggttacggtacggggtccggggtaacgggaacgttggtaccgtacggttacggtaacgaccgtacggacccgtaggtcccgtccccggtacccgttgacccgttacgttcccgttacccctccccg

SEQ ID NO: 228130 - DNA, 754 bp, Homo sapiens
  misc_feature: GYAE6OF02F702M.23.21.B10.1.454.CMB.1.raw
  modified_base (240)..(240): a, c, t, g, unknown or other
  misc_feature (240)..(240): n is a, c, g, or t
tcagacgcgagtatcacgaccggtgctcgatttagtgtcgtcgcaagaggagaggggggggtcacaagaggcagcgctctcgggacgtctccaccatggcctgggctctgctgctcctcactctcctcactcaggacacgagggtcctcgggcccagtctcgccctgacctcagcctgcctccgtgtcgtgggtcctccgtggacagtcgatccaccgtctcctgcacgtcggaacccgnagtcgattggttacgggtaacttttaagtagtggtcgtcggttacggtaaccaacttaccctaccgaacggaaccaaaccgaccccctaaactcctaacgttacgtttacgtacggaacggtaccaacgtaacggccggtcccttaggtacggggtttactaacggtccgtcgttcgttcgtacggtacctacgtaacgttccgtacggacctaacgtacccggtaccctaccgtacgacccgtactccgtacgtccggtaccctaccgtacgtccgtacggaccggacgtacgtacgtagttaacgttacgtttacgcgttacctcgtaccttagtacttaacgcgtacgtaagtaacgtttacgtaagtttcggttaacgggtccgggtttacggggaaccggggtacttacgggtaccgtccggggttaacgtcgggtaccgaccggtaaccggtaccgtaccgtcccggtacccgtacggttcctaccgggtttcctcccgttacccccg

SEQ ID NO: 228131 - DNA, 656 bp, Homo sapiens
  misc_feature: GYAE6OF02G1GPP.23.21.B10.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagacggggggggtcacaagaggcagcgctctcgggacgtctccaccatcggcctgggctctgctgctcctcactctcctcaatcaggacacagggtcctgggcccagtctgccctgacctcagcctgccttccgtgtctgggtctcctggacagtcatcaccgtctctgcacgtcgaacccnagtgagttggttacggtacttttatatgtctcgtgtacaactcctccagtacaacgaccccaactctatacttatgaggcactaacgcgcctagtacgggttctagtcgcttctcgtcgtctcaagtctcgacaacgaccgtccttccagcctatcctcgtcggtaccctacgacgtccgtacgaccggtacggacgtctacgtaatttacgttagttacgtccttacgccgttactacgttcgtacgtaaccgtaagtaacgttaaccgttaagtttaccgtttacgggtacggggttccgggaaccggggaacccgttaagggtaccgtaccggtacggtacggtaaccgaccggtacccgaacggtcccgttacccggtaccccgttaccggtaccgtacgtttccggtcccgttacccccg

SEQ ID NO: 228132 - DNA, 815 bp, Homo sapiens
  misc_feature: GYAE6OF02HOVB6.23.21.B10.1.454.CMB.1.raw
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
tcagacgcgagtatcacgaccggtgctcgatttagtgtcgtcgcaagaggtaggagggggggggtcacgtaaggaggcaggcgcgtctcgggacgtcctccaccatggccctgggcctacgtcgctggccttcccctcgacctcctccctcaactcgacggaccacgagggggtcctcgggcccaggtcctggcccctggaccttcgacgccgtgcccttccgtgtcgtgggtctccgtggacnggtcgagtccaccggtctctgcncgtaggacccncagtgagtggttcggttaacttttaatagttggtctcggtggtaccaactacctaccgaggaccaaaccgacccccaaactactattacgtttatacggacggacaacgtaacggccggtcccttcgggtacggggttttctacgttccggtactttccgtcgtcgcctactaaggttcctacgggacaacgtaccggtccttcccgtcgaccttactccgttccggtaccgtcccgtaccgtacggtacccgttacgggaccggtaaccggtacggttcgttacgttaagttttacgtttaagtttcgttaccgttcggttaccttacgttaacttacggttagaaccggttagttaacggtttaaagtttacggttttaacggttttacgggggtttacgggggtttacggggtaaccgggggtaaccgggttaagggtaccggttaaccgggttcgggtaacggtaccgacgggtacccgtaacgggtcctcccggtcccggtaccgttccgtaccttcggttacccctacccg

SEQ ID NO: 228133 - DNA, 696 bp, Homo sapiens
  misc_feature: GYAE6OF02JR5KE.23.21.B10.1.454.CMB.1.raw
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgactcaccgtctcctagcactggaacccgnagtgatggttggtacttttaantgtctcgtgtacaactcctccgaggacaacgcccctaaaatctactacttanggacggacacgtaacgaccggtccctaggtacggggtttactacgtcgtactttctacgtcggtcctaccgtaaggtccgttaggacccaaacgtaccggtccttacccgtacggaccctacgtccttaccgtcggtcccctccgacgtcccgtggtaaccggtacggtacggtcgttacgtaacgtttaacgttacttacgtcgtacgtaccttacgtaacttaacggtcgaacgtaagtaacgttaacggttagttaaccgtttgggtacgggttacgggaccggggtaaccgtaagggtccgttaacggtacggtgggtaccacgggtacccgaaggtcctacccgggacccgttccggtactaccgtttaccgtccgttaaccccg

SEQ ID NO: 228134 - DNA, 744 bp, Homo sapiens
  misc_feature: GYAE6OF02F8WUH.23.21.B10.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccgtctcctgcactcggaacccgnagtgattggttgggtacttttaatagtggtctcgtcgtaccaatacctcccgaggacaaacgcccccaaaactctaacttaactttagtggacgggacaacgtaacggccggtcccttcggtacggggttttctagtccgtcttccgtcgtcggtacctaccgaagtccgtacgggacctaaccgccgggtcccttcccgtacgaacctacttccgtctccgggtcccttaccgacgtcccgtacggaacccgggtacggtacgggtacgttagtaacttttaagtttacgttcggaccctttggaccttactagtttacgtacggaccaggttaacgtttaaggtttacggtttacggttttaggggaaccggggtttaccgggggaaccggggggtaaccgtaaagggttccggtaaccggttccggggtaaggtaccgaaccggtaccccgtaaggtcccgtcccggtacccccgttggtaccctacgtttacccggttcctcccccgg

SEQ ID NO: 228135 - DNA, 775 bp, Homo sapiens
  misc_feature: GYAE6OF02I2FGL.23.21.B10.1.454.CMB.1.raw
  modified_base (176)..(176): a, c, t, g, unknown or other
  misc_feature (176)..(176): n is a, c, g, or t
  modified_base (288)..(288): a, c, t, g, unknown or other
  misc_feature (288)..(288): n is a, c, g, or t
  modified_base (368)..(368): a, c, t, g, unknown or other
  misc_feature (368)..(368): n is a, c, g, or t
  modified_base (538)..(538): a, c, t, g, unknown or other
  misc_feature (538)..(538): n is a, c, g, or t
  modified_base (574)..(574): a, c, t, g, unknown or other
  misc_feature (574)..(574): n is a, c, g, or t
tcagacgcgagtatcacgaccggtgctcgatttagtgtcgtcgcaagagaggagggggggtcacaagaggcagcgctcgtcgggacgtctccacatggcctgggctctgctgctcctcactctcctcactcgaaggacaacgacgggtcctcgggcccagtcctcgccctgacctnacgtcctcgcccgtccgtgtcgtcgggtcctcctagggaccaaggtcactccgtacctctccgtagcctaacgacggaaccctgagttgaagttggttaggtaactttaagngtcggttcacggtacgtaactaactcccgacgaacgaccaaaccgacccctaatacgaacgttacttagcggagacctanaaccggccgaccgttggtacggttactacggtctccgttcgtcgtcgacctaccgtaagtccgttacgaaccgtaacggcccggtccctaacctacgtacctatcccgttcgacccggtacctacggaatccgtaacgaaccggtacgaccggtattaggttaaactttnttacggtacgactacggttaaccaagtagttaaacnccggtaaacgtaagtttagttaaacgggttaccgtttacgggttaaacgggggccggggtttacccggggaaccgggggtaaactacggttacccgggacggttacggtacccgggtaaaccaccggtaacccggtacccgttggtacccccccgtttacggtacccttagggacccctttaccggtccccgttaaccccc

SEQ ID NO: 228136 - DNA, 709 bp, Homo sapiens
  misc_feature: GYAE6OF02HNGUT.23.21.B10.1.454.CMB.1.raw
tcagacgcgagtatcacgaccggtgctcgatttagtgtcgtcgcaagagaggaggggggggtcacaagaggcagcgctctcgggacgtctccaccatggcctgggctctgctgctcctcactctcctcactcaggacacagggtcctgggcccagtctcgccctgactcagcctcgcctccgtgtcgtgggtctccgtggacagtcgatccaccgtctcctgcacgtcggaacccgcagtgagttggttaggtaacttttaatagttcggttcttcggttacggtaacctaacgtaccctaccgaaggaaccaaaccgtaccccctaaaacttactaactttaactttagtacgggacgggtacctaacgtaacggccgtacccgttacggtacgggtttctacggtccgttcttcgtcgtcgtctacgtagtccgtacggacaacggtccgtaccctaccgtaccgacctacgttccgtcgtccgtccctacccgacgtccgtaacggaccggtacgtcgggtacctagttactttattacgttcgtacttgtctacgtatcgtcgaactagtacgttaagttacgttacgttgggtacggggtacgggaacgggtacgtacgggtacgtacggttacggacggtccgacgtaccgtacggtccgtcccgtacccgtcggtaccctacggttcccgtcccgttccccg

SEQ ID NO: 228137 - DNA, 733 bp, Homo sapiens
  misc_feature: GYAE6OF02GLH0L.23.21.B10.1.454.CMB.1.raw
tcagacgcgagtatcacgaccggtgctcgatttagtgtcgtcgcaagaggagggggggggtcacaagaggcagcgctctcgggacgtctccaccatggcctgggctctgctgctcctcactctcctcactcaggacacagggtcctgggcccagtctcgccctgactcagcctcgcctcgtgtctcgggtctccgtggacagtcgatccgaccgttctcccgtgcctacgtcggaacccgcgtagtgtagttggttacggttaacttttaagtcgttcggttctcggttacggtaacctaactacccgtaccgaggaccaaaccgcccctaaatcgtaacttactttacgaggacgactaacgtaccggccgtaccctaggttacgggtttctacggtccgtactttcgcgtcggtcctacgtagtcacgacaacgccgtcctcgtacgacctctccgtacgtccgacctcgaccgtcctacggaccgtaacgcggttatacgttacttaacttcggttcgtacgtactccgtaactaagtcgttacggaacttaggtaactttaggtttaaccgtttacgggttcgggtaacgggggttccgggaaacgggtaccgtaaggttcccgggttaacggttcggtaacgtccggaaccgtacccggtacggtacccgtcccggttaccccgtcggttaacctccggtttcccggttacccggtccccgttacccg

SEQ ID NO: 228138 - DNA, 682 bp, Homo sapiens
  misc_feature: GYAE6OF02G2HMX.23.21.B10.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
tcagacgcgagtatcacgaccggtgctcgatttagtgtcgtcgcaaggaggagagggggggggtcacaagaggcagcgctctcgggacgtctccaccatggcctgggctctgctgctcctcactctcctcactcacggacacagggtcctgggccccaggtctcggccctgactcgagcctgcctccgtgtctgggtcctccgtggacngtcgactcaccgtctcctgcactcggaccgcagtgntggtaggtactttaatgtcggtctcggtcgtacctaactcccgtccgagaccaaaccgaccccctaaacgtctacgttaaccttagtaggaacgggcctaacgtaacggccggtaccgtcggtagggtttcgtacggtccgtacttctcgtcggtcctacgtaagttcgtacggacctaacgaccgggtcctcccgtcgacctcgtccgtcgaccgtccctaccgacgtccgtacggaccgacggtacggcttagtatttacttagttcgcttcgactagactagtcgacgtagtacgtagttacgttacgttgggtacggtcggggacggggtaacctaggggtaccgtaccggttacggtacggtaccgtacgtaccggtaacggtcccgtacccggtcccgtcggtaccgacccgttcggtccccgttaccccg

SEQ ID NO: 228139 - DNA, 766 bp, Homo sapiens
  misc_feature: GYAE6OF02IHPEP.23.21.B10.1.454.CMB.1.raw
  modified_base (175)..(175): a, c, t, g, unknown or other
  misc_feature (175)..(175): n is a, c, g, or t
  modified_base (249)..(249): a, c, t, g, unknown or other
  misc_feature (249)..(249): n is a, c, g, or t
  modified_base (739)..(739): a, c, t, g, unknown or other
  misc_feature (739)..(739): n is a, c, g, or t
tcagacgcgagtatcacgaccggtgctcgatttagtgtcgtcgcaagagaggaggggggggtcacaagaggcagcgctcgtcgggacgtctccaccatggcctgggctctgctgctcctcactctcctcactcgaggacacgagggtccgtcggcctagtctcgccctgacctcncgcctcgcctccgtgtcgtggtcgtcctggacagtcgatccgaccgtctcctcggacaccgttacggaacccgngtaggttgtacgttcggttacggttaacttttaagtgttcgttcgtcggtacgtacctaacgtacccgtaccgacgacaaaccgacccgtaaactctattaacttagacggtacggacctaacgtaaccggcccggtacccgttacggtttaacggggtttcctaacggttcccgtcgttaaccggttcgtaccggtactaccggttaacgtcgtacgaccgaaaccggtcggtccctccgtaacaccgttactccgtccgaccggtccctctaaccggccttacgggaaccgacggtacgtacgttacttaaccggttattaccgtggtaccgtacgtcctaagtaccgtagtacgacgttaaagtacccgtaagggttttaaccgtcggtttacggggtccggtcgggggaaccggtacttacgggccgttaaccgggtcgtacggttaccgaacccgcggtaacttcccggaccgttacccggtacncccgtttacgtccgttacccgtaaccc

SEQ ID NO: 228140 - DNA, 740 bp, Homo sapiens
  misc_feature: GYAE6OF02J2YSL.23.21.B10.1.454.CMB.1.raw
  modified_base (139)..(139): a, c, t, g, unknown or other
  misc_feature (139)..(139): n is a, c, g, or t
  modified_base (277)..(277): a, c, t, g, unknown or other
  misc_feature (277)..(277): n is a, c, g, or t
tcagacgcgagtatcacgaccggtgctcgatttagtgtcgtcgcaagaggagaggggggggtcacaagaggcagcgctctcggacgtctccaccatggcctgggctctgctgctcctcactctcctcactcaggcacgngggtcctgggcccagtctgccctgactcagtcctgcctccgtgtctgggtctccgtaggacagtcgtatccaccgtctcgtcgctacgtacggaacccgtgtaacggtgacgttcggttacgggttaactttttaagngttcggtccgtacggttaccggtaacctaacgttcccgtaccgtaggaaacctaaacccggtaccccctaaaattccgtaaactttaccgtttaagacggacgggtacctaacggtaacgccggtccctcggttacgggtttactcgtacgtcttacgttcggcgtctaacgtacgtcgttacgacctaaccggcgtccttaccgacgtaactcgtctcgtaccgctcgacgtcctaggaacgaccgtgtaccttaacgtagttttactagttccgtactacgtccttaagtacttacgtgaaccggttaattacgtttacgggtaacgttttacgacggggtccgggttaccggaaccgggttactagggtccggttaacttcggaacggtaccgaccgtaacggtcgtcccgttcccggtaacccgtagttcccaaccggttttccgtacccgttaccccg

SEQ ID NO: 228141 - DNA, 944 bp, Homo sapiens
  misc_feature: GYAE6OF02HGZSH.23.21.B10.1.454.CMB.1.raw
  modified_base (263)..(263): a, c, t, g, unknown or other
  misc_feature (263)..(263): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacgagggtcctgggcccagtctcgccctgactcagcctgcctcgtgtctgggtcctccgtggacagtcgatccaccgtctcctgcctacgtcggacccgcagtgactggttacgggtacttttaanagtcggttctcggtacggtaacctaactacctcccgtaaggacaaacccgacccccctaaatccgaactttaacctttaagtcggaacgggacctaaccgttaacgggcccggtaccccgttacgggttaacggggggttttaccttaacgggttcccgttaccgttttcccgttacggttaccgggtacccgttaacccgtaaacggtttcccgtaacgggggtaacccaaaccggtaccccgggtacccccttaccccgttacggaccccttaaccgttcccgtttcccggttccgggtacccctacccgtaccggtacccgtaccggggaacccggtaaccggggtaaaccggtccgttacgttaacgttttaaacgtttacgttaacggttccttaccggtaccgttacgtaagtttacgtaacgggaactaaacgggttaacgtttaaccggtttaacgggtttacggttttaacggggtaccggggtttaccggggggggaaccggggttaaaccgggaacggggtttaccggggtacccgttacggggtttaacccggtaccgtaaccccggggtaacccgtaaaccgggttcccccgttaacccgggtcccccggtttaccgggtacccttacccggtttccccgtttacccggttacccccttaacccccgg

SEQ ID NO: 228142 - DNA, 854 bp, Homo sapiens
  misc_feature: GYAE6OF02IDI4L.23.21.B10.1.454.CMB.1.raw
  modified_base (254)..(254): a, c, t, g, unknown or other
  misc_feature (254)..(254): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgactcacgcctgccctccggtgtcgtcgggtcctccgtggacaggtcgactccgacccgtctcctgacctaccgtacgggaaccccgntaggtcgtagtttcgggttaacgggttaactttttaaagtggttacggttccttcggttacggtaaccctaacttacccgtacccgaaggaccaaacccgaccccctaaactcgtaactttaactttagacggaacggacctaacgtaacggcccggtacccgttacggttacgggtttacctacggttccgttccgtttaccgtcggttaccggtccgttaccgtaacggtcgttacgaaccgtaaccgacccgggttcccctacccgtaccgtaacctacgttcgttccgtccggtaccctccgtacggtacccgttacgggaccggacgttacggtacgttaacgttaacttttagttacgttcgtaccgttacggtaccttagtacgtactggtaaacgtaacggttagttaaacggttacgttttacggtttaggggtaaccgggggttaccggggaacgggggtaaaccgtacgggttaccggtaaccgggttaccgggtaggtaacccgtaccggtaacccggtacggtccggttacccccggtcccggttacggtacccctttacccggttccgttaccccggttacccccg

SEQ ID NO: 228143 - DNA, 791 bp, Homo sapiens
  misc_feature: GYAE6OF02J1JO3.23.21.B10.1.454.CMB.1.raw
  modified_base (256)..(256): a, c, t, g, unknown or other
  misc_feature (256)..(256): n is a, c, g, or t
  modified_base (647)..(647): a, c, t, g, unknown or other
  misc_feature (647)..(647): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctcgggcccagtcgtcggccctgactcagcctgcctcgtcgtctgggtcctccgtggactagtacgtctccgccgttctccgtgaccgactcggaaccctcgagttcgngttggttacggttaacttttaagtacgttcggttccgttcggtacgttaacctaaccttaccccgtaccgaaggaaccctaaaacccgacccccgttaaactacttacgttaaccgttttaaggcggaacggtaccaagttaccggtcccgtccggttacgtacggggtttctacggttccgtaccttcgttcggtacgtccctacggtaaccgttggtaccggaacaacccggttacccggtccctacccgtaactaacccgttccggaccctttacggtcccggtacccgtccgtaacccgtaccggttaccggacccgggtaaccggtaacgtaccgttagttaacgttaacgttcgttctaacgtcgtccgtactaacgtcgtacgntaacgtagttaacgtacggtttacgtacgggttacgggtaccggggtacgggacgttaacggtcggttacggacggttccgaacgtcgtaaccgtaccgcggtcccggttccgtaccggtcgtacccgttcggtcccgtccccg

SEQ ID NO: 228144 - DNA, 845 bp, Homo sapiens
  misc_feature: GYAE6OF02HPVL5.23.21.B10.1.454.CMB.1.raw
  modified_base (381)..(381): a, c, t, g, unknown or other
  misc_feature (381)..(381): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgacgggtcctcgggccagtctcgccctgactcacgcctcgcctccgtgtcgtgggtctccgtggacaggtcacgttccaccgttctaccgtgcctacgtaccgggaacccgtcgtagtcggtagttggggtttacggttaacttttaagtcgttacgggttccgttacggtaacgtaacctaaactccccgtaccgaaggtaaccaaacccgacccctaaatccgtaatttacgttacggnggacgactaacgtaaccggccgtaccgttgggttaacggttctaggtccttacgttctacgtcgacctacgtaagtcggtacggacaacggtccgtccctaccgtacgaacttctccgtccgttccgtaccgtactaccggtccgaacgaccgggtaggtaccgtacgttacgttaacttgttacggtacggttcaacgttccgtaatacgtaaggtcctaacggtaagtttaacttaacggggtttaaccgtttaacgggtttacgggggttaaccgggggttaccgggggaaccggggttaacgggtaccggttacgggtaacccgggttttaaggtaacccgggtacccggaaacggtttaaacccccggggtacgtaccccggttaccccggggtttacccccgtacggtttaaacccgggttccctttaccccggggtttccccgtttacccccccggg

SEQ ID NO: 228145 - DNA, 883 bp, Homo sapiens
  misc_feature: GYAE6OF02F8BPO.23.21.B10.1.454.CMB.1.raw
  modified_base (277)..(277): a, c, t, g, unknown or other
  misc_feature (277)..(277): n is a, c, g, or t
  modified_base (577)..(577): a, c, t, g, unknown or other
  misc_feature (577)..(577): n is a, c, g, or t
  modified_base (812)..(812): a, c, t, g, unknown or other
  misc_feature (812)..(812): n is a, c, g, or t
tcagacgcgagtatcacgaccggtgctcgatttagtgtcgtcgcaagagaggagggggggggtcacaagaggcagcgctcgtcgggacgtctccaccatggcctgggctctgctgctcctcactctcctcactcgaggacacgacgggtccgtgggccctagttctcgccctgtacctcgtacgcctcgcccttccggtgtccgttcgggtcctccgtaggactaggtccgacgttcctaccggttccttccgtcgtaccgaccgtccggaacccgngtacggtgtaacggttcggttaggttaacttttaagtcgttacggttccgtccggttaacgtaacctaacctacccgttaccggaacggtaaccgaaacccggtaaccccccttaaacgttctaaccgtttacggtttaacgacgggtaacggtacctaaccggtaccggtcccgggtaccccggtttagggtttaacccggggttttctaaccggttcgttcctttccggttccggtaacgtcccgttaaccggtaagtccggtacggccctaaacggtcctcccgtacctccgtaacnccgtttacgtccgtacccgtccgtacccgtactaccggtacgtaaccggaacggtcgtaccgtttagttaacctttagtttcgtacgttacgttcgtaccgttagtacgtacgtacccggtataaaggttaccgtttaaacgttggtttaaccgggttacggggttccggggtacgggttaaccgggacgggttaccggttacgggtaacccggttacgggttccaccgggtacnccgggttaactcccggtacccggttccccggtaccgttaccgtccggtttaccccgtacccggttcccccg

SEQ ID NO: 228146 - DNA, 825 bp, Homo sapiens
  misc_feature: GYAE6OF02ILK6F.23.21.B10.1.454.CMB.1.raw
tcagacgcgagtatcacgaccggtgctcgatttagtgtcgtcgcaagagggaggggggggggtcacaagaggcagcgctctcgggacgtctccaccatggcctgggctctgctgctcctcactctcctcactcaggacacgagggtcctgggcccagtctcgccctgactcagcctgcctccgtgtctggtctcgtggacagtcatccaccgtctcctgcacgtcggaacccgcgagtgtagttcgttagggtaacctttttaagtagttggttaccgttcggttacggttaacctaaacgttaacccctcccggtaaacggaccaaaaacccggaccccccctaaaacttacctaactttaacttttaacgtacggtaccggggtacctaaccgtaaacggtcccggtaccccttacgggttacggggttttcgttacggttccgttacctttccgttccgttacggtccctaccgtaacgttccgtacggtaccaaaccgtcccggtccctaccccgttacgaacccgtacgttaccgttccggtccggtacccgttacccgaaccggtcccgttacgggaacccggaacggtacgggtaacttcggttaaactttaacgtttaacgttcgtaccgttcgtaaccgttactacgtacgtcgtacgaagttaacgttagttacgttacgttacgggacgggtttcggggacgggtacgtagggtacgtaccgttaggtaccggtcgaccggtcgtaacggtcccggttcccgaccccggttacgtacccgttccgttacccgttcccgttaccccttacccccg

SEQ ID NO: 228147 - DNA, 861 bp, Homo sapiens
  misc_feature: GYAE6OF02F8FGX.23.21.B10.1.454.CMB.1.raw
  modified_base (240)..(240): a, c, t, g, unknown or other
  misc_feature (240)..(240): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcaggacacgagggtcctgggcccagtctcgccctgtactcagcctgcctcgtgtcgtggtctccgtggacagtcgatccgaccgtcctccgtgcacgtcggaacccgntagtgacgttggttaggtaacttttaatagttcggttccgttcggtacggtaaccaacgttaccctacccgtacggaaccaaaaccgacccccctaaactaccgtaactttaccgtttaaggtaggacggacctaaccggtaacggtccccggtacccgttacgggttacggggtttacctacggttaccgtcctttccgtcgtacggtccgtaaccgtaacggttcgttacggaccctaaccgtccggtcccctacccgtacgtaacccttcgttaccgtccggttccggtacccgttcccgtacggtacccgtaacggtaacccggtacgggtaccgttacgttacgtttaaacgtttacgtttaacggttcgtaccgttacggtaccttaacgtacgtttacgtcggtaacgttaagttaacgtttaacggttaacggttttaccgggttacggggttaccggggttaccggggaacgggggttaaaccggtaccgggttaccggttaccgggttaccggtaacggtaaccgggtaaccgtaacccgggttaaccggtcccgttacccggtaccccggttaccggtaccctacccgttccgttacccccgtaaccccg

SEQ ID NO: 228148 - DNA, 762 bp, Homo sapiens
  misc_feature: GYAE6OF02FQH1T.23.21.B10.1.454.CMB.1.raw
  modified_base (113)..(113): a, c, t, g, unknown or other
  misc_feature (113)..(113): n is a, c, g, or t
  modified_base (131)..(131): a, c, t, g, unknown or other
  misc_feature (131)..(131): n is a, c, g, or t
  modified_base (244)..(244): a, c, t, g, unknown or other
  misc_feature (244)..(244): n is a, c, g, or t
tcagacgcgagtatcacgaccggtgctcgatttagtgtcgtcgcaagagaggaggggggggggtcacaagaggcagcgctctcgggacgtctccaccatggctggctctgctnctctcactctcctcactnaggacacgagggtcctagggcccagtctgccctcgactcacgtcctcgcctccgtgtcgtgggtcctcctggacctagtcgatccgaccgtctcctgcaacgtcggaacccgnagtgacgtcggttaggtacctttaatagttgcctacggtcggtaacctaacttaccctcctacggaaccgaaaccgtccccccaaaactctaattaccgtttagcggaacgggacctaaccggtacggtccgtacccccgtagggtaacggggttttcaacgtccttcgttcctagtccggtactacccgaagttccgtagggacccaacggtacccggaccctttcccgagtaaccctacttaccggccctacgggtaccccttcgaccgtcccggttaggaccgtaaacggacggttactacgttaagttacttaagttccgtcttacgactcctaatcgtaggccaagttataagttacggttaacgttcggggtacggggtacccgggtacggggtaaccctaacggggttcgtaacccgggacggtaccggtaccggtacggacccggttaaacggcccgtcccggttacccggtacccggttacgtccgtttaccgttccccgtttaccccg

SEQ ID NO: 228149 - DNA, 806 bp, Homo sapiens
  misc_feature: GYAE6OF02GO3TV.23.21.B10.1.454.CMB.1.raw
  modified_base (266)..(266): a, c, t, g, unknown or other
  misc_feature (266)..(266): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctcactcacggacacgtagggtccgtcgggccctagtcctcgtccctcgactcacgcctcgccctccggtgtcgttgggtcctccgtggactagtcgactccgacccgttcctcctgacctaccggtaccggaacccgtntacgtgtacgttggttacggttaactttaagtcggttcggtcgttacggtacgtaacctaacctaccccgtaccggaacgaacccgaaacccgtaaccccctaaactctaacttacgttaagacgggaacggtacctaacgtaccgggtccgtcccgttaggtacgggtttctacggtcgttccttcgtaccgtcgtacctaccgtagtcggtaacgaacccgtaaccgtcccgtacccctaccgtaaccgacctcgtccttccgcgtccgtacccgtaccgtaccgtacggaccggtaaccggtaccgtacgttacgttaacgtttacgtttacgttcgtaccgttacgtacttacgtatacgtacgtacgtaacgttaacgttaacgttaacgtttacggttacgggttcgggtacgggtacgggtaacggtacggtacgggtaccggacgggttttttttaaccggaccggtaccggtaccggtaccgtccggtcccggtcccggttccggtaccgtccgttcccgtcccgtccccg

SEQ ID NO: 228150 - DNA, 905 bp, Homo sapiens
  misc_feature: GYAE6OF02IN2H4.23.21.B10.1.454.CMB.1.raw
  modified_base (129)..(129): a, c, t, g, unknown or other
  misc_feature (129)..(129): n is a, c, g, or t
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctnactcaggacacgtagggtcctgggcccagtctgcctagactcggcctcgcctccgtgtcgtggtctcgtgacagtcgattccaccgtctactgacctacgtacggaacccgngtagtcgattggttacggtaacttttaangtcggtctacggttacggtaacctaactaccgtaccgaggtaacccaaaccgaccccctaaaacgtcttaacgttaactttacgtacggtaacgggtcctaaacggtaacggtaccccgggtacccgtttacgggttacggggttttacccgtacggttaccggttaccctttcggttaacccggtcggacccgtttaaccgtaacgggtttcaccgggttaacgaaacccggtcccgtaccccttaccgtaccgaaaccgtttaacccgtccggtttacggtcccggttaacccttacccggtaccgttaccgggtaaccggtaaaccgggtaaccggtaacggggtacccgttttaagttaaacggtttaaaccgttacggtttaccgttccgtaaaccgtaccttaacgttaacgttaacgtacccggttagtaaaccgtttaagttaacggttacgtttaacgtttaggggaaccggggtttaccgggggaccggggttaaaaacgtaccggggttaacccgtcggggttaacccggtaacggttacccggaaacctccgggtaaccgtccgtacccggtaccccgttcggaacccgttcccggtacccttaccccggtacccgttacccc

SEQ ID NO: 228151 - DNA, 824 bp, Homo sapiens
  misc_feature: GYAE6OF02G1MRO.23.21.B10.1.454.CMB.1.raw
  modified_base (242)..(242): a, c, t, g, unknown or other
  misc_feature (242)..(242): n is a, c, g, or t
tcagacgcgagtatcacgaccggtgctcgatttagtgtcgtcgcaagaggagaggggggggtcacaagaggcagcgctctcgggacgtctccaccatggcctggctctgctgctcctcactctctcactcaggaccacgaggtcctgggccctagtccgtcgacccgttgaacttcacgtcctcgcctcgttgtcgtagggtctccgtaggacgtacgtcgactccgtaccgtacttcccgngcctaacgtacgggaacccgacgaggttcgaagttcggtttcgggttaactttttaactagttcggtaccgttacggtacggtacctaacgtcccgtacccgaagggtaccaaacccggtacccctaaacttcgtaactttaacttacgtacggtacggtacgtaacgtaacgggcccggtaacccgttaccggttaggggtttacacggttccgactttcgtcgttcgtcctaacccgtaaggttccgtaggtacccaacggtccggtaccttcccgtacggaacctttgtacccttcgttccgtcctaaccgtccgtacccgtaacggtaccggtacggacggttccgtaacgttacgtttacgttacgttcgtcgtaacgtaccttagaaacgtttcgtacgtactaacggtaactttcggttacgttaacggttcgggtttaacggggttccggggaacgggttaaccgggtagttacccgggtacgtttccgggtacggtacgtaccggaaccggttacgggtcccgtaccggtcccccgttagtttacccgtaaccgtttccgttacccgtccccg

SEQ ID NO: 228152 - DNA, 731 bp, Homo sapiens
  misc_feature: GYAE6OF02IS1IY.23.21.B10.1.454.CMB.1.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (547)..(547): a, c, t, g, unknown or other
  misc_feature (547)..(547): n is a, c, g, or t
tcagacgcgagtatcacgaccggtgctcgatttagtgtcgtcgcaagagaggagggggggggtcacaagaggcagcgctctcgggacgtctccacatggcctgggctctgctgctcctcactctcctcactcgaggacacagggtcctgggcccagtctcgccctgactcacgcctgccctccgtgtctcgggtcctccgtggacaggtcgactcaccgtctccngccacgtcggaacccgnagtcgtagtggttaggtaacttttagagtcggtctacggtgtaacctaacgtaccgtaccgaggacctaaaccgaccccctaaatctaagttaaccttagtacggacggactaacgtaacggcccgtacccttacggtacgggtttctacgtccgttcttccgttcgacgtactaccgtagtctcggaccaacgtccggtccctaccgactactacgtctcgtaccgtcctccgtacgtccgtacgaccgtacgtacgtcgtagtaacgttacgtttacgtcgtctcggtacctacgtacgtacncgtaacgtacgtaacgttacgttaccgtttaggttacgggtcggggtttacgggcccgggttaacgtacgggttaccggttaccgggtacggtaacgggtcccgtaacggtacccgtaacgggttcccgtacccggttccccggttacgggtaccctaccggtttcccgtccccggttaccccc

SEQ ID NO: 228153 - DNA, 767 bp, Homo sapiens
  misc_feature: GYAE6OF02HH183.23.21.B10.1.454.CMB.1.raw
  modified_base (129)..(129): a, c, t, g, unknown or other
  misc_feature (129)..(129): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (485)..(485): a, c, t, g, unknown or other
  misc_feature (485)..(485): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctnactcaggacacgaggtcctggacctagtctcgccctagactcacgcctgcctccgtgtctcggtcctccgtggactagtgactcaccgtctccgtnacgtacgtacggaaccgtnagtacgattgggttacggttaaattttaatacggtcggttccgtcggtaacgtaacctaacttaccccgtaccgaggtaaccctaaaaccgacccctaaactactaacttaacttagacggagtaactaacgtaaccgccgtaccgtggttaacgggtttacacggttcgtacttcgtcggtacgtacgttaacgaagttcgacggtaaccgaacgtacccggcctaccgtacgaaccttntccgttcggcgtacctaccgacgtaccgacgaaccgtaaggcggtacttaagtaatttagttacgttacgtcgtagtacctagagttaacgcgtaacgaagttaaggttacgttaacgtttaccgttaggggttccggggttaaaccggggaaccgggggtaaacgagggttacccggtaccggttacggtaaccggttaccggaacccgaccggtaaacccgttcccgtcccggtaaccccggttcgtaacccgtaacttttcccgtacccgtttaccccc

SEQ ID NO: 228154 - DNA, 832 bp, Homo sapiens
  misc_feature: GYAE6OF02I6R3I.23.21.B10.1.454.CMB.1.raw
  modified_base (130)..(130): a, c, t, g, unknown or other
  misc_feature (130)..(130): n is a, c, g, or t
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
tcagacgcgagtatcacgaccggtgctcgatttagtgtcgtcgcaagagaggaggggggggggtcacaagaggcagcgctctcgggacgtctccaccatggcctgggctctgctgctcctcactctcctnactcaggacacgagggtcctgggcccagtcctcgccctgactcagcctagcctcgtgtcgtggtctccgtggacngtcgactcaccgtctcgtnccgactcggaacccgnagtcgagttggttagggtaacttttaatagtacggttacgttccggtacggtaaacctaacgttaacctaccccgaaggtaccgaaaccggaaccccctaaactactaacttacgtttacgtaggtaacgggacctaacggtaaccgtccggtacccttacgggtaaggggtttccttacggtaccgttccgttacgttaccggttcggtaacccttacgtaaacggttaccgtcgggaacctaaaccgtcccggtacccctaccgtaccgaccctacgttcctccgggttacgacccctacgtaccggaccttaccggacggaacggtcgtacggtattacgttaagttaacgttgaccgttcgtaccgttataacttgtaacgtaacgtaacgttaacgtaggttttaacgttacgtttaccgggtaaggggttacccgggggaacggggttaaccgtaacgggtacctaacccgggttagtaccggggttaaccctaaccgggtaaccggtaacccgggtttcccgtaccccgggttacccgtaccgggtaacccttacccggtttaccccgtaacccggttccccccg

SEQ ID NO: 228155 - DNA, 825 bp, Homo sapiens
  misc_feature: GYAE6OF02GU5K6.23.21.B10.1.454.CMB.1.raw
  modified_base (253)..(253): a, c, t, g, unknown or other
  misc_feature (253)..(253): n is a, c, g, or t
tcagacgcgagtatcacgaccggtgctcgatttagtgtcgtcgcaagagggaggggggggggggtcacaagaggcagcgctctcgggacgtctccaccatggcctgggctctgctgctcctcactctcctcactcaggacacgagggtcctcgggccctagtctcgccctgacctcacgcctgccctccggtgtcgtgggtcctccgtaggacagtcgactccaccgtcctccgtgacctagtcggaacccgnaggtgacgttaggttgggttaactttaagtagttcggtccgttacgtacggtaacctaaacgttacccgtaccgacggtaaccgaaaccgtacccccaaactctaacttacgttaacgacggtaggaccaacgtaacggccgtcctaggttacggttcgtactcgtctgtctacggctacgagttcgacggtacaaccggaccgtcctcctaacgtacctcgtactccgtacgtcccgtaccgtacgaccgtacggaccggacggacggtacgtacgtgttaaaaaaaaaaaaacgtttcgttacgtacgtcgttacgtactaacgttagtacgtacgtaacgtacggttaacgttacgtttaacggttaacgggttacggggttaccggggtaaccggggttaaccgggtaaccgggttaccggttaccgggttaccgggttaaccgggttaaccggtaaccggtaacccggtaacccggttacccggttaccccgggttacccccgggttacccggtttaacccgttacccgtttacccggtttaccccggttacccccgttacccccgg

SEQ ID NO: 228156 - DNA, 737 bp, Homo sapiens
  misc_feature: GYAE6OF02GNWA4.23.21.B10.1.454.CMB.1.raw
  modified_base (99)..(99): a, c, t, g, unknown or other
  misc_feature (99)..(99): n is a, c, g, or t
  modified_base (130)..(130): a, c, t, g, unknown or other
  misc_feature (130)..(130): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (408)..(408): a, c, t, g, unknown or other
  misc_feature (408)..(408): n is a, c, g, or t
  modified_base (463)..(463): a, c, t, g, unknown or other
  misc_feature (463)..(463): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
tcagacgcgagtatcacgaccggtgctcgatttagtgtcgtcgcaagagaggaggggggggggtcacaagaggcagcgctctcgggacgtctccaccanggcctgggctctgctgctcctcactctcctnactcaggacactagggcctgggcccagtctcgccctgactcacggcctgcctccgtgtcgtggtctccgtggacncgtgatccacgtctctagctacgtacgaccccggnagtcgtagtcggttaggtacttttaagtggtggtctacggttacgtaacctaacttccctaccgtacggaaccaacccgccccctaaaatctaaatttctacgtggagtacctaacggtccgccggtaccgtacggggttacgggtttacgtacttcgttccggttcncggttccggtctaccgttacgtcggtaggtacccaacggtcctaccgtcccgtanacctgtccgttcgccgtcaccgactcgacggacgacgcgtatagtacttatccgtgtactcgtcctacagttncnggtttaacaacggttagttaacgttacgtttacggggtaccggggttaccgggggaaccggttaaccgggacggtttaccgggtacccggggttacgtaccgggtttacccggaacgggtaacccggtacgggtaccccggttaccgttcccgggtaacccttacccgggtccgttaccccggtttccttccccccggg

SEQ ID NO: 228157 - DNA, 663 bp, Homo sapiens
  misc_feature: GYAE6OF02JXRMZ.23.21.B10.1.454.CMB.1.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagacgcgagtatcacgaccggtgctcgatttagtgtcgtcgcaagagaggagggggggtcacaagaggcagcgctctcgggacgtctccaccatggcctgggctctgctgctcctcactctcctcactcaggacacgagggtcctgggcccagtctgccctgactcagcctgcctccgtgtctgggtcctcctggacagtcatcaccgtctcctgctacnggacccgnagtgatcggttaggtacttttaatntggtctcgtcggtaccaagtacctccaggacaaacgcccaaaactctaatacttaatcggagtacacgtaacgccgcctcgtaggggttactacgtccgtactctacgtcggtctaccgtaagtctgaccgtacaccggtacctccgtacgaccgtacttcctcggtcgtaccaccgtacgccgtaacggacggacgtaaacggtcgttagtaacgttacgtttactttacggcttcgtacttcctagttaacgtgtaacctagtagtttaacgacggtttacgtttgggtaaccgggttcgggaccggggtaacgtacggtaggtaccggttacggaagggttccaacggtaccgaccgttcgacccgttacccggtggtacccgtacgttccgtaaccttccccgg

SEQ ID NO: 228158 - DNA, 739 bp, Homo sapiens
  misc_feature: GYAE6OF02F4GSH.23.21.B10.1.454.CMB.1.raw
  modified_base (417)..(417): a, c, t, g, unknown or other
  misc_feature (417)..(417): n is a, c, g, or t
tcagacgcgagtatcacgaccggtgctcgatttagtgtcgtcgcaaggagaggggggggggtcacaagaggcagcgctctcgggacgtctccaccaagtggcctgggctctgctgctcctcactctctcactacagacacagggttcctcgggccctagtcctgccctgactcagcctgcctcgtgtcgttcgggtctcgtggacagtcgtatcctaccgtctaccgtcgacctacggtacggaacccgtgacgttcggtacgttggttacgggtttaacttttaagtacggttcgttacgttacggtcggtaacctaaccttccgtacgaacggtaacccaaaccgtacccaaacttactaacgtttactttaggacggacgtaccagtacggccgtaccgtagttacgggttacncggtcgtacgttctacgtcgtacctctaacggttcgtcgaactaccgacgtcgtcctacgacctcttacgtcctcgtaccgtcgtacgtcccgtaagccggtgacgtagtacggttactattcgtagctacgtctacaagtctacgacttagtacgttacgtagtttacggtacgggtcgggtaacccgggtagggtaacccgtagggtaaccggtcgggtttaacggacggttagtacccgggtaacggttacggacccggttcccgaccccgggttacgtaacccgtccgtttacccgttacccggttcccttaccccgg

SEQ ID NO: 228159 - DNA, 768 bp, Homo sapiens
  misc_feature: GYAE6OF02JRBC5.23.21.B10.1.454.CMB.1.raw
  modified_base (656)..(656): a, c, t, g, unknown or other
  misc_feature (656)..(656): n is a, c, g, or t
  modified_base (743)..(743): a, c, t, g, unknown or other
  misc_feature (743)..(743): n is a, c, g, or t
tcagacgcgagtatcacgaccggtgctcgatttagtgtcgtcgcaagaggaggggggggtcgacaagaggcagcgctctcgggacgtctccaccatgcctgggctctgctgctcctcactctcctcactcaggacacaggtccgtggccctagtctgccctgacctcagccttgccctcgtcgtcgtcgggtctcctacggacacgtcggatacgacccgtccgttaccgtcaccgtacgtaccggaacccgactacggtagtagttcggttacgggttaacttttaagtcgttcggttctcggttacggttaacctaacgttacccgtaccgaacggaacccgtaaaacccgaccccccaaacttaccgtaacttaaaccgtttaatcgggttaaacggaaccgtacggtaaccggaccggtaccccgttaagggttacggggtttacctaacggtccgtctttcctacggtacgtccgtactaacgttcgacggtacacgtaccgtccctcgtacctaccgtacttccgtaccgggtacgtaccccgttacgaaccgttcccgtaacgacccgggaacggtaccgtacgggtaatttacgttaattacgtcgtacgttacgtccgtaactagtcgactgaacctagtaccgttntacgttacggaggggttcgggaccggtagcgtaccgtcgtaacggtcgtaacgaccgacgaccggtctccccggtacctgttcccgngttacccgttccctaccggttaccc

SEQ ID NO: 228160 - DNA, 843 bp, Homo sapiens
  misc_feature: GYAE6OF02I5IR8.23.21.B10.1.454.CMB.1.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (314)..(314): a, c, t, g, unknown or other
  misc_feature (314)..(314): n is a, c, g, or t
tcagacgcgagtatcacgaccggtgctcgatttagtgtcgtcgcaagaggaggggggggggtcacaagaggcagcgctctcgggacgtctccaccatggcctgggctctgctgctcctcactctcctcactcaggacacgacggtcctgggcccagtctagccctgactcacgcctgcctccgtgtccgtgggtcctacctggacagtcgatccgacgtcctcgtcncacgtcgacccnagtnatgtggtactttaagntgtctgtcgtaccatacctcgagaccaacgacccctaagtacttattaacttagnggtacggactaacgtacggaccggtccctacggttacgggtttactacggttcttaccgtttcgtccgtttggacccttacgtaacggttctacggaaccggtaccgtaccggtcccgttcccgttacgaacccgtccgttcttccgtaccgggtaccctccgtaccgtaccgacggaaccggtacgtacgtccgtagtttaacgttaacgtttacgttcggtacgttacgttaccgttacctaggttaccgttacggacgttaacggtaacggtttaaccggttttacggtttaaccgggtttaccgggggttacggggttaacccgggggggttaccgggttaacccggggttaacgggggtttacccggtaccccgggtttacggggttaacccgggtaacccgggtaacccggtacccggggttaaaccccggttcccgggttaaacccccggtttcccccggggttaaccggtaccctttacccgggtacccggttttcccccggttacccccgttccccccgg

SEQ ID NO: 228161 - DNA, 713 bp, Homo sapiens
  misc_feature: GYAE6OF02H8VJA.23.21.B10.1.454.CMB.1.raw
  modified_base (150)..(150): a, c, t, g, unknown or other
  misc_feature (150)..(150): n is a, c, g, or t
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (572)..(572): a, c, t, g, unknown or other
  misc_feature (572)..(572): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
tcagacgcgagtatcacgaccggtgctcgatttagtgtcgtcgcaagagaggagggggggggtcacaagaggcagcgctctcgggacgtctccaccatggcctgggctctgctgcctcctcactctcctcactcaggacacgagggtccncgggcccagtctcgccctgactcacgcctgcctcgtcgtcgtggtctcctggacngtcgactcaccgtctctgcacgtcggaacctcgagtntacgttggttcggttaacttttagtacgttcgttctacggttacgaacctaaccgtcccgtaccgtaacggaacctaacccgaaccccctaaaacttctaaccgttttaacgttaggacggacggtaaacctacgtaaccgggcccggtaccccgtttagggttacggggttttactacggtcccgtctttcgtacgtcggtacctaaccgtagtccgtacgggaaactaccggtcccggtccctacgtaccacccgttcgtaccgtttccggtacccgtctacccgagtacccgtacgacggtacgacggtctaacgttattactcgtntcgctacagtntacgntactagtacgtacgttgttacggtacgggtcggtacgggacggtacgtagggtccgtaggtacggtcgaccgtacgtcccggtcgtccgtcccggtccgtaccgttccgtcgtcccgtccgtccc

SEQ ID NO: 228162 - DNA, 787 bp, Homo sapiens
  misc_feature: GYAE6OF02IEXKJ.23.21.B10.1.454.CMB.1.raw
  modified_base (208)..(208): a, c, t, g, unknown or other
  misc_feature (208)..(208): n is a, c, g, or t
  modified_base (534)..(534): a, c, t, g, unknown or other
  misc_feature (534)..(534): n is a, c, g, or t
  modified_base (571)..(571): a, c, t, g, unknown or other
  misc_feature (571)..(571): n is a, c, g, or t
tcagacgcgagtatcacgaccggtgctcgatttagtgtcgtcgcaagaggagagggggggggtcacaagaggcagcgctctcgggacgtctccaccatcggcctgggctctgctgctcctcactctcctcactgacggacacgacgggtccgtcgggacccagtctcgcctgactcacgcctcgcctcgtgtctcggtctcctggacncgtcgactcaccgtctctcgacacgtacggaccacgtagtcgtacgttagggttacggttaactttaacgtaggttcggtcgttaccggtacggtaacctaacttaccgtaccgaaacggtaccaaacccggtacccctaaatcctaatttaacgtttaacggacgggtacgtaacctaacggtacgcccgtacgttacggttacgggtttactaaccgtcgttccttacgtacgtacgtcctaacgtaacgttccgagtaaccgaaccggtaccgtcccgtacctaccgaaaccgttcttacgggtccttaccgggcccttaacncggtaccacgaacggttacgcgtactaggttaacttnttaacgtcgtaactcgtactaagttacgtacgcgtacgtaagtacgtttaagtaaccgggtttcgttaacggggttcccggggtaacgggaaccgggttaacgtacggggttaccctacgggttaaccgggttacgaacccggtacgacccggttaacggtccccgttaccggcccctagggttaccttaacccggttccgtacccggttaccccc

SEQ ID NO: 228163 - DNA, 696 bp, Homo sapiens
  misc_feature: GYAE6OF02HIUY5.23.21.B10.1.454.CMB.1.raw
  modified_base (244)..(244): a, c, t, g, unknown or other
  misc_feature (244)..(244): n is a, c, g, or t
  modified_base (470)..(470): a, c, t, g, unknown or other
  misc_feature (470)..(470): n is a, c, g, or t
tcagacgcgagtatcacgaccggtgctcgatttagtgtcgtcgcaagagaggaggggggggtcacaagaggcagcgctcgtcgggacgtctccaccatcggccgtgggctctgctgctcctcactctcctcactcgaggacaacgcgggtcctcgggcccagtctcgccctagctcgcgcctcgcctcgtgtcgtcggtctccgtgacgagtcgactcgccttctctacgcacgtacggaaccncgtagtagtgttggtacggttactttaagtgtcgttctacgttacgtaactactacccgtaccgacgaccgaaccacccctaactaccttacttacgttagacggtacgaacgtacacggtccgtaccgtacggttacggttctcgtcgttcgttctcgtaccgtcgacgtacgtcgtaccgaactccgtacccgtcctactaaaccgccgttctactccggaccncccgtcgacgtacgcggaacgcggacgtactagttacgttaacgttcgtcgtacgttctacgtacgtctaagtccgtagtacgttacgtacgtttacggtacggttaacgggtcggggtacgggttaaccggaacgggttcgtacgggtaccggttcggactaccggacgtacccggtacggtccctacggcccgtaccgtccggtacttacccggtcctaccccg

SEQ ID NO: 228164 - DNA, 827 bp, Homo sapiens
  misc_feature: GYAE6OF02G2D18.23.21.B10.1.454.CMB.1.raw
tcagacgcgagtatcacgaccggtgctcgatttagtgtcgtcgcaagagaggagggggggggtcacaagaggcagctctctcgggacgtctccaccatggcctgggctctgctgcctcctcactctcctcactcgaggacacgacgggtcctcgggccctagtctcgccctgactcacgcctgcctccgtgtcgtgggtcctccgtggacagtcgactccgaccgttcctaccgtgccacgtaccggaacccgcgaagtacgtagttggtttacggttaacttttaagttagttcggttccgttcggtacggtaacctaactacctacccgacggaaccgaaaccgaacccctaacctactacttacttagtacgacggactaacgtacgccggtaccgtacgtacggttacgttcgtaaaaaacgttccttcgttcgtcgtaccgtaccgtacggtaccgtacggtaccgtaccgtacccggtaccccgtacccgtaccgtaccgttacctccgtaccgttaccggtcccgtacccgtaccgtaccgtaccggaacccggtacggaacggtacgttacgttaacttaacgttacgttacgtacgttcgtacctaacgtactacgtacgtaaccgtaacgttaacgttaacgttaacgtttacggttacgggttacggggtaccgggtaccggggtaacgggtaccgggtaccggttaccggttacgggttaacggtaccggtaaccggtaacccggtaccggtaccggtacccggttacccgttacccggttacccgtacccgttcccgttaccccggttaccccg

SEQ ID NO: 228165 - DNA, 800 bp, Homo sapiens
  misc_feature: GYAE6OF02HE3ZJ.23.21.B10.1.454.CMB.1.raw
  modified_base (129)..(129): a, c, t, g, unknown or other
  misc_feature (129)..(129): n is a, c, g, or t
  modified_base (258)..(258): a, c, t, g, unknown or other
  misc_feature (258)..(258): n is a, c, g, or t
  modified_base (386)..(386): a, c, t, g, unknown or other
  misc_feature (386)..(386): n is a, c, g, or t
  modified_base (620)..(620): a, c, t, g, unknown or other
  misc_feature (620)..(620): n is a, c, g, or t
  modified_base (630)..(630): a, c, t, g, unknown or other
  misc_feature (630)..(630): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctcctnactcgaaggacacgagggtcctgggcccagtctcgccctgactcacgtcctcgcccttccgtgtccgtgggtcctccgtggacagtcgactccgaccgtctccgtagacctaccgtacggaaaccccgngtaaggttgagttagggtttacggttaacttttaagtagttcggttcgtaccggtacgttaaacctaaacctaccgtaccgaaggaacccgaaaacccaccccctaaacttactaactttacgttaanacgggtacggaccaaccgtacggaccggtcccgtacggttaagggttctcggtacgtacctttccgtcgtccggtacctacgtaagtcccgtacgtaacaaccggtacccgtacctacccggtaacacccgtacgtttcccgcgtacccgtacccgtaccgtaccgttacggacccgaacgggtaacccgtagtaccttagttaacgtttattcgttaacgttcctgtaacctntaagtaccgntagtaacgttaagtacgttacgtttaaggttccgggacggggttccgggaacggggtaacgtaggttaccggtaacggttacgtaacgggacctaaccgggtcggaaccggttccgtaacccccggtcgtttacccggtacctaccgtttacccgacccctttcccccgg

SEQ ID NO: 228166 - DNA, 913 bp, Homo sapiens
  misc_feature: GYAE6OF02G4TT8.23.21.B10.1.454.CMB.1.raw
  modified_base (258)..(258): a, c, t, g, unknown or other
  misc_feature (258)..(258): n is a, c, g, or t
tcagacgcgagtatcacgaccggtgctcgatttagtgtcgtcgcaagagggagggggggggtcacaagaggcagcgctctcgggacgtctccaccatggcctgggctctgctgctcctcactctcctcacgtcaggaccacgacgggtccgtcgggcccagtctcgtccctgacctcgacgtccgtcgtcccgtcgtggtccggttcgggtcccttacggtcggaacgcgttccgacgtccgtaaccgttcctccgtnaccgtaccgtaccggaccgctaggtgtacgttggttaggttacttttaagtcgtccgtcgttcgtacggtaaccacgttacccacgtaccggaaccgtaaaccctacccctaaacttctaaacgttttaaccgtttaggacggtaaccgtaacctaaggtacccggcccggtttccgttagggttaccgggtttctacggttccttcgtttccgacgttcggtacctaacggttaccgcgtacgaaccgttaaccgtcccgacccttcgacttaacccttcggtccttaccggtccggtacccgtacgtacccgtccggtaacgtaaccggtacgggtaccggttacgttaacggttaacttttaccggtttacgtccgggttaaccctttgttacccgttaacttaccggttgtacggtaacgttaacggttaaccggtaacgttttttttttaaccggaacgggtttacgggggtaaccggggggtttaacccggggaacgggttaaccgggtacccggttaaccgggttaccgggttaaccgggtaaacggtccggggttaaacccgacgggtacccggttacccgggtcccgttaccgggttaaccgtacccggttccgtttaccccggttaccccgtaccccgttcccgg

SEQ ID NO: 228167 - DNA, 847 bp, Homo sapiens
  misc_feature: GYAE6OF02GVIXQ.23.21.B10.1.454.CMB.1.raw
  modified_base (163)..(163): a, c, t, g, unknown or other
  misc_feature (163)..(163): n is a, c, g, or t
  modified_base (286)..(286): a, c, t, g, unknown or other
  misc_feature (286)..(286): n is a, c, g, or t
tcagacgcgagtatcacgaccggtgctcgatttagtgtcgtcgcaagaggagagggggggggtcacaagaggcagcgctctcgggacgtctccaccatggcctgggctctgctgcctcctcactctcctcactcaggacacgtagggtcctgggccctagtcncgccctgactcagcctgcctccgtgtcgtggtctccgtggacagtctatccaccttccgtaccgtgctaccgtaccggaacccgtctaggttacgtcgttaggttacggtttaacttttaagngtttcggtccttcggtaacgttaaccaacgtacccctaccgaggaaccaaacccgtaccccctaaacgtcttaacgttaaccggtttatacgggtaacggtaccgtaacgtacggcccggtaccctacgggtttacggtttctaccgtccgtaccttccgtcgtcggtaccctacggtacttcgtacggtacccaaaccggtcccggttccctacccgtcgtaaccctcgttacccgtcggtccggtacctccgtaccggacccgttacggaaccggaccggtagtcccgttaaggttacctttaagttacgtcgttccgtactaccggttattacgtacggtataccggaattaggttttaacgtacggtttttaacggtcgggttaacccggggggggtaccggtaaccggggtaaacccgttacgggtacccgggttacggtttaacccggggttaacgaacccgggttacccggtaaacccgttcgggtcccttccccggggtaccccggtttaattcccccgggtaaactttccccgggttaccccttcccccccg

SEQ ID NO: 228168 - DNA, 722 bp, Homo sapiens
  misc_feature: GYAE6OF02HXYZV.23.21.B10.1.454.CMB.1.raw
  modified_base (152)..(152): a, c, t, g, unknown or other
  misc_feature (152)..(152): n is a, c, g, or t
  modified_base (232)..(232): a, c, t, g, unknown or other
  misc_feature (232)..(232): n is a, c, g, or t
  modified_base (261)..(262): a, c, t, g, unknown or other
  misc_feature (261)..(262): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
  modified_base (446)..(446): a, c, t, g, unknown or other
  misc_feature (446)..(446): n is a, c, g, or t
tcagacgcgagtatcacgaccggtgctcgatttagtgtcgtcgcaaggagaggagggggggggtcacaagaggcagcgctctcgggacgtctccaccatggcctgggctctgctgctcctcactctctcactcgacggacacgacgggtccncgggccctaggtctcggacccgtgtacctcacgcctacgtccgtcgtcgttcgttcgggtctccgtaggactagtcgacncgtaccgtctctgccacgtacggaaccgnnggtagcgttggtacggttaactttagngttcggcttacggngttaaccaactcccgacgagacctaaccncctaaatctaagtacttagcggagacaagtcgccggtctaggtggtactcgtcgtcttacngcgtctacgattcgctaacacgcgtccctcgtacacgttctcgtacgccgtcnctacgccggtaggacgtaccggtagattagttatttactcgttccgtgttactactaacgtgttcacggtactaacgtttaggttaccgtttaagggtttccgggtttaggggttaaaccgggggttccggggaacccgggtaaagggtccgggttaccggtaccggtttaaacggccggggtaaccgttaaacccgccggttaaccgggtcccgtacccgggtttccccgtaacgttcccgggtacccggttccccgttcccggttaaacccccc

SEQ ID NO: 228169 - DNA, 708 bp, Homo sapiens
  misc_feature: GYAE6OF02FG0X8.23.21.B10.1.454.CMB.1.raw
  modified_base (235)..(235): a, c, t, g, unknown or other
  misc_feature (235)..(235): n is a, c, g, or t
  modified_base (325)..(325): a, c, t, g, unknown or other
  misc_feature (325)..(325): n is a, c, g, or t
  modified_base (433)..(433): a, c, t, g, unknown or other
  misc_feature (433)..(433): n is a, c, g, or t
  modified_base (686)..(686): a, c, t, g, unknown or other
  misc_feature (686)..(686): n is a, c, g, or t
tcagacgcgagtatcacgaccggtgctcgatttagtgtcgtcgcaagaggaggaggggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatccaccgtctcctgcactcgggaacccnagtgattcgggttaggtacttttaagtcgtggtctggtcgtaccaacttacccgtccgaggacaaccgacccctaactcaattacttagnggacggactacgacgtccggtaccctaggttagggtttactacggtcctacgttctccgtaggtacctaccgtaagtcgtacgggactaaccggccggtccctacccncggaacctaccgtcctcgccggtccctccgaccgtccgtaggaacccggtacggtacgtcgttagtaacgttagtttacgtcgtaccgttacgaccttacgtaacttctacggtacctaaggtacgtttaaggttacggtttagtttaggggtaccgggttcggggtaccgggggaccgtaagggtacggaccggttagttaccggtacgacccggtaccgacggtcccgtaccggttccccgtacggttccnccgttaccggttccctaccccg

SEQ ID NO: 228170 - DNA, 729 bp, Homo sapiens
  misc_feature: GYAE6OF02GIGYG.23.21.B10.1.454.CMB.1.raw
  modified_base (128)..(128): a, c, t, g, unknown or other
  misc_feature (128)..(128): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
  modified_base (581)..(581): a, c, t, g, unknown or other
  misc_feature (581)..(581): n is a, c, g, or t
tcagacgcgagtatcacgaccggtgctcgatttagtgtcgtcgcaagagaggagggggggggtcacaagaggcagcgctctcgggacgtctccaccatggcctgggctctgctgctcctcactctctnactcaggacacgacgggtccgtgggcccagtctcgcccgtgactcaggcctcgccgtccgtgtcgtggtcctcgngacagtcgctccaccgtcnctgcacgtcggaacccnacgtagtagtggttagggtactttaagngtacggtcgttacgtggaacctataccgtccagacctaacgacccctaatacctagttacttaggacgcggacgacgtaccggccggttccgtcggttacggttacgtcgttccgactttccgcgtcgtacctacgtaacgtcgtacggtacaaccgtccgtccgtcctacgtaacccgtctttaccgccggttccgttacccgacccggtacggtacctaacgggtaaaccggtaccggcgttaaccgttacgtttaacgttaacggtttattcccggttaacgttaccggttacttaacgtaacgtttacgnggtactacgtagtttacggtacgtttacgtcgggttaccggggtcgggaacccgggttagtacgggtccgtaccggttacgtcgggaccctacggaccggttagccccgtcgtacccgttggaccctttcggtacgttccctaccccg

SEQ ID NO: 228171 - DNA, 266 bp, Homo sapiens
  misc_feature: GYAE6OF01AICF0.36.80.H03.1.454.CMB.1.raw
  modified_base (262)..(266): a, c, t, g, unknown or other
  misc_feature (262)..(266): n is a, c, g, or t
tcagtacgctgtctcacgaccggtgctcgatttagctgtgcgtcgaagggaaagggttccactgggcataagtgcgcacctcgatgctttgataagtgggccaagggacaatggtcaccgtctcttcagcctccaccaagggcccatcggtcttcccctggcaccctcctccaagagcacctctggggcacagcggccctgggctgcctggtcaaggactacttccagacagcgtactgagcgggctggcaaggcgcatagnnnnn

SEQ ID NO: 228172 - DNA, 269 bp, Homo sapiens
  misc_feature: GYAE6OF01EDP5N.36.80.H03.1.454.CMB.1.raw
  modified_base (265)..(269): a, c, t, g, unknown or other
  misc_feature (265)..(269): n is a, c, g, or t
tcagtacgctgtctcacgaccggtgctcgatttagctgtgcgtcgaagggaaagggttccactgggcataagtgcgcacctcgatgcttttgataagtgggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnn

SEQ ID NO: 228173 - DNA, 279 bp, Homo sapiens
  misc_feature: GYAE6OF01C4EB9.36.80.H03.1.454.CMB.1.raw
  modified_base (265)..(279): a, c, t, g, unknown or other
  misc_feature (265)..(279): n is a, c, g, or t
tcagtacgctgtctcacgaccggtgctcgatttagctgtgcgtcgaagggaaagggttccactgggcataagtgcgcacctcgatgcttttgataagtgggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnnnnnnnn

SEQ ID NO: 228174 - DNA, 279 bp, Homo sapiens
  misc_feature: GYAE6OF01D3DGB.36.80.H03.1.454.CMB.1.raw
  modified_base (264)..(279): a, c, t, g, unknown or other
  misc_feature (264)..(279): n is a, c, g, or t
tcagtacgctgtctcacgaccggtgctcgatttagctgtgcgtcgaagggaaagggttccactgggcataagtgcgcacctcgatgcttttgataagtgggccaagggacaatggtcaccgtctcttcagcctccaccaagggcccatcggtcttccccctggcaccctcctccaagagcacctctggggcacagcggccctgggctgcctggtcaaggactacttccagacagcgtactgagcgggctggcaaggcgcatagnnnnnnnnnnnnnnnn

SEQ ID NO: 228175 - DNA, 283 bp, Homo sapiens
  misc_feature: GYAE6OF01A3QW8.36.80.H03.1.454.CMB.1.raw
  modified_base (266)..(283): a, c, t, g, unknown or other
  misc_feature (266)..(283): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtcttccccctggcaccctcctccaagagcacctctgggggcacagcggccctgggctgcctggtcaaggctacttccagacagcgtactgagcgggctggcaaggcgcgatagnnnnnnnnnnnnnnnnnn

SEQ ID NO: 228176 - DNA, 276 bp, Homo sapiens
  misc_feature: GYAE6OF02GIFPU.36.80.H03.1.454.CMB.1.raw
  modified_base (266)..(276): a, c, t, g, unknown or other
  misc_feature (266)..(276): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnnnn

SEQ ID NO: 228177 - DNA, 267 bp, Homo sapiens
  misc_feature: GYAE6OF02G5UBE.36.80.H03.1.454.CMB.1.raw
  modified_base (265)..(267): a, c, t, g, unknown or other
  misc_feature (265)..(267): n is a, c, g, or t
tcagtacgctgtctcacgaccggtgctcgatttagctgtgcgtcgaagggaaagggttccactgggcataagtgcgcacctcgatgcttttgataagtgggccaagggacaatggtcaccgtctcttcagcctccaccaagggcccatcggtcttcaccctggcaccctcctccaagagcacctctgggggcacagcggccctgggctgcatggtcaaggactacttccagacagcgtactgagcgggctggcaaggcgcatagnnn

SEQ ID NO: 228178 - DNA, 274 bp, Homo sapiens
  misc_feature: GYAE6OF02FXBPT.36.80.H03.1.454.CMB.1.raw
  modified_base (266)..(274): a, c, t, g, unknown or other
  misc_feature (266)..(274): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnn

SEQ ID NO: 228179 - DNA, 271 bp, Homo sapiens
  misc_feature: GYAE6OF02GE1OH.36.80.H03.1.454.CMB.1.raw
  modified_base (266)..(271): a, c, t, g, unknown or other
  misc_feature (266)..(271): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnn

SEQ ID NO: 228180 - DNA, 277 bp, Homo sapiens
  misc_feature: GYAE6OF02II82L.36.80.H03.1.454.CMB.1.raw
  modified_base (266)..(277): a, c, t, g, unknown or other
  misc_feature (266)..(277): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnnnnn

SEQ ID NO: 228181 - DNA, 281 bp, Homo sapiens
  misc_feature: GYAE6OF02HQ13O.36.80.H03.1.454.CMB.1.raw
  modified_base (266)..(281): a, c, t, g, unknown or other
  misc_feature (266)..(281): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnnnnnnnnn

SEQ ID NO: 228182 - DNA, 273 bp, Homo sapiens
  misc_feature: GYAE6OF02HQWRL.36.80.H03.1.454.CMB.1.raw
  modified_base (268)..(273): a, c, t, g, unknown or other
  misc_feature (268)..(273): n is a, c, g, or t
tcagtacgctgtctcacgaccggtgctcgatttagctgtgcgtcgaagggaaagggttccactgggcataagtgcgcacctcgatgcttttgataagtggggccaaagggacaatggtcaccgtctcttcagcctccaccaagggcccatcggtcttccccctggccaccctcctccaagagcacctctgggggcacagcggccctgggctgcctggtcaaggactacttccagacagcgtactgagcgggctggcaaggcgcatagnnnnnn

SEQ ID NO: 228183 - DNA, 293 bp, Homo sapiens
  misc_feature: GYAE6OF02HJ8YK.36.80.H03.1.454.CMB.1.raw
  modified_base (266)..(293): a, c, t, g, unknown or other
  misc_feature (266)..(293): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnnnnnnnnnnnnnnnnnnnnn

SEQ ID NO: 228184 - DNA, 286 bp, Homo sapiens
  misc_feature: GYAE6OF02HBYPM.36.80.H03.1.454.CMB.1.raw
  modified_base (273)..(273): a, c, t, g, unknown or other
  misc_feature (273)..(273): n is a, c, g, or t
  modified_base (275)..(286): a, c, t, g, unknown or other
  misc_feature (275)..(286): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatcggtccttcccctggcaccctcctccaagagccacctcgtcgggggcacgagcggccctggctgcctggtcaaggactacttcagacagcgtactggacgcgggctggcgaaggcgcagtaggntnnnnnnnnnnnn

SEQ ID NO: 228185 - DNA, 338 bp, Homo sapiens
  misc_feature: GYAE6OF02FG74K.36.80.H03.1.454.CMB.1.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(278): a, c, t, g, unknown or other
  misc_feature (277)..(278): n is a, c, g, or t
  modified_base (280)..(338): a, c, t, g, unknown or other
  misc_feature (280)..(338): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctcaccaaggcccatcggtcttccccctggcaccctcctccaagagcacctcgtggggcacaggccggccctgggctgcctggtcaaggactacttcagacagctactgacgcgggtctggacaagggcgacgaacgtagngncnngnnnnnnnnnnnnnnnnnnnnnnnnnnnnnnnnnnnnnnnnnnnnnnnnnnnnnnnnnnn

SEQ ID NO: 228186 - DNA, 303 bp, Homo sapiens
  misc_feature: GYAE6OF02FZCJD.36.80.H03.1.454.CMB.1.raw
  modified_base (266)..(303): a, c, t, g, unknown or other
  misc_feature (266)..(303): n is a, c, g, or t
tcagtacgctgtctcacgaccggtgctcgatttagctgtgcgtcgaagggaaagggttccactgggcataagtgcgcacctcgatgcttttgataagtggggccaagggacaatggtcaccgtctcttcagcctccaccaagggcccatccggtcttccccctggccaccctcctccaagagcacctcgtgggggcacagcggccctgggctgcctggcaaggactacttccagacagcgtactgagcggctggcaaggcgcatannnnnnnnnnnnnnnnnnnnnnnnnnnnnnnnnnnnnn

SEQ ID NO: 228187 - DNA, 508 bp, Homo sapiens
  misc_feature: GYAE6OF01C5PJP.14.85.H08.1.454.CMB.1.raw
  modified_base (451)..(451): a, c, t, g, unknown or other
  misc_feature (451)..(451): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaagggctggagtggattggggaaatcagtcaaagtggaggcacaagtacaacccgtcctcgagagtcgagtcaccatatcaatagacacgttccagaatcagttctccctgagctgacttctgtgacagccgcgacacggctgtgtattactgtgcgagtatcgtttcggctggtacnctcttgactacgtgggccagggaccctggtccacgtctctcagccctccacaggccc

SEQ ID NO: 228188 - DNA, 570 bp, Homo sapiens
  misc_feature: GYAE6OF01C7HGI.14.85.H08.1.454.CMB.1.raw
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (464)..(464): a, c, t, g, unknown or other
  misc_feature (464)..(464): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggactccgccacgccccgaggggaaggggctggagtggagttaggggaaatcgagtacaaaggtggaggcacaagtaccaacccgtcctacgagagtcgagtcaaccatatacaatagacacgtccagaatcagttctcctgacgctgacttcngtnacagccgcgacacggctgtgtacttatgtgcgagtcttcgttcgcgttggtacncttcttaggtactacggtcggggacccgtaacgggtaacccgttcggtcctacccggttcttaccgttacgaccgtcccctacccgaacccgaacgggtacccccg

SEQ ID NO: 228189 - DNA, 498 bp, Homo sapiens
  misc_feature: GYAE6OF01E27ET.14.85.H08.1.454.CMB.1.raw
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
  modified_base (409)..(409): a, c, t, g, unknown or other
  misc_feature (409)..(409): n is a, c, g, or t
  modified_base (491)..(491): a, c, t, g, unknown or other
  misc_feature (491)..(491): n is a, c, g, or t
tcagcgtctagtaccacgaccggtgctcgatttagtatcactcagtcgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggngcttataactttgtctcctggtaccacagcacccaggcaaagcccccaaactcatgatttatgacgtcaataagcggccctcggggtcccngatcgcttctctgctcagtctggcaacacgcctccctgaccgtctctcgggctccgagctgacgatgaggctgattatacngcagctcacatgcagtcagtaactagtttcgggttaggaggaggacagctgaccgtctagcacgcccagcctcgcccctgcnctctccg

SEQ ID NO: 228190 - DNA, 586 bp, Homo sapiens
  misc_feature: GYAE6OF01DKCJ0.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccaggggaaggggctggagtggattggggaaatcgagtcaaagtggaggcacgaagtacaacccgtccctacgagacgtcgagtcaaccatactcaatacgactacgttccagaatcagttctccctgacgctgacttctgtcgacagcccgcggacgacggctggtgtattactgtgcgagtacttcgtttcggcgttggtaccgtcttcgttcgacgttaccgttcgggggacccgtaacggggtaaccccttgggtcccaacccggttctaccgttccaaccggtcccctacccacccggtaaccgggtacccccg

SEQ ID NO: 228191 - DNA, 534 bp, Homo sapiens
  misc_feature: GYAE6OF01EUKD6.14.85.H08.1.454.CMB.1.raw
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (416)..(416): a, c, t, g, unknown or other
  misc_feature (416)..(416): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcaccaggcaaacgcccccaaatcatgatttatgacgtcaataagccggcccgtcggggtccctgatcgcttctctgctcagtcngcaacncgcctccngagcatctcgtgggcctccgaggctggacggacgaggctgtattattacngcagctacatactactatacgctaagtacttggttacggtttcggacggaggaccaggtcgaccggtcgtaggtcacgcccgaaggcctaccgcccccgtagtcctcgtccgttcccg

SEQ ID NO: 228192 - DNA, 601 bp, Homo sapiens
  misc_feature: GYAE6OF01EXDI1.14.85.H08.1.454.CMB.1.raw
  modified_base (439)..(439): a, c, t, g, unknown or other
  misc_feature (439)..(439): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccgagggaacgggctggagtgggattggggaaatcagtcaaagtggaggcaccaagtaccaacccgtcctacgagagtcgagtcaaccatatacaatagaccagttccagaatcagttcctcctgacgctgactttctgtgacgcgccgacgacgacgctagtcgtattacngtgcgaagtcttacgtttcggcgttaggtaccgtcttacgttggacctttaccggacggggtacccgaacggggtaaccccgttcgggtacccgtaaccccggttccgttaccttaccgaaccgtcccccttacccgtaaacccgaacggggtaaccccccg

SEQ ID NO: 228193 - DNA, 673 bp, Homo sapiens
  misc_feature: GYAE6OF01D0G0L.14.85.H08.1.454.CMB.1.raw
  modified_base (240)..(240): a, c, t, g, unknown or other
  misc_feature (240)..(240): n is a, c, g, or t
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
tcagcgtctagtaccacgaccggtgctcgatttagtatcactcagtcgcggggggggtctcaggaggcagcactctcaggacgtcaccaccatggcctgggctctgctcctcctcagcctcctcactcagggcacagggtcctgggcccagtctgccctgactcagcctccctccgcgtccgggtctcctggacagtcagtcaccatactcctgcactggaaccagcagtgacgttggtncttatactttgtctctgtaccaacngcaccaggacaaacgcccccaaactcatgatttangacgtacaataacgccggcccgtcggggtccctgatcgcttctctcggctacagtcgtggaccaacgcggccctccctgacccgtctcgtcgggtcctccgacggtctaggacgagtggacggtcttgtaattttacttacgtgactacgtcctacgatacgttcgaccgtaacgttacgtaagttaaaccgttaagggttttttccggggggtttacgggaccggggtaacgggtaacccgtaaggtcccggttaccgtaaccccggtttaccgtaaaccggtaccgaaccggtacccccgtaaacgggtccccgttaccccggtaccccccccgttacgggttaccctacccgttccgtttaccccccggg

SEQ ID NO: 228194 - DNA, 545 bp, Homo sapiens
  misc_feature: GYAE6OF01DJI9Q.14.85.H08.1.454.CMB.1.raw
tcagcgtctagtaccacgaccggtgctcgatttagtatcactcagtcggcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaacccagcagtgacgttggtgcttataactttgtctcctggtaccaacagcacccaggcaaagcccccaaactcatgatttatgacgtcaataagcggccctcgggggtccctggatcgcttctctggcctcaagtctggcaacacggcctccctgaccgtctctgggctccaggctgacgatgagctgtattattactgcagctcacatgcagtacagttaactaagtttcggggttttcggacggtacgggaccaaggctcggacccgttaccgtaagtccgacgcccgaaggcctcgacccccctcgtccaccgtcttacccg

SEQ ID NO: 228195 - DNA, 547 bp, Homo sapiens
  misc_feature: GYAE6OF01B0R7B.14.85.H08.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagccacccaggccaaagccccccaaactcatgatttangagtcaatactcggccctnaggtagtttcaatcgcttctctgctcagtctggcacncgcctcctgancatctcgtgggctccgaggtctaggaggacgagctgatttatactgcagctnatatactagttagcagtactggttaggtttcgggcggacggtaccgtaagggtcgacccggttcgtaagggtcaacggtcccaagggtccttacccggccccccttgggtccctccgttcccgg

SEQ ID NO: 228196 - DNA, 604 bp, Homo sapiens
  misc_feature: GYAE6OF01B9OD6.14.85.H08.1.454.CMB.1.raw
tcagcgtctagtaccacgaccggtgctcgatttagtatcactcagtcgcgggggggtctcaggaggcagcgctctcaggacgtcaccaccatggcctgggctctgctcctcctcagccctcctcactcagggcacagggtcctgggcccagtctgccctgactcagcctccctccgcgtccgggtctcctggacagtcagtcaccatatcctgcactggaaccagtagtgacgttggttattataattttgctcctggtaccaacagcaccaggcaaacgccccaaatcattattatgagtcaataatcggccctcaggtatttctaatcgtcttctctggctcaagtctggacaacacgcctcctgacgcatctcgtggcctccgagctggaggacgaggctggaattatactgcagtctcatatacttatagactagtaacgttggttacgggttttcggacggggtacggtaaccgtaagggtccgtaacccggttaccgttaacggtccgtaacggaccccggtaaagggcccttacccggacccccccgtttacgggtaccctaacccgtttccttacccggttcccccctaacccccg

SEQ ID NO: 228197 - DNA, 604 bp, Homo sapiens
  misc_feature: GYAE6OF01C085B.14.85.H08.1.454.CMB.1.raw
  modified_base (250)..(250): a, c, t, g, unknown or other
  misc_feature (250)..(250): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagcttcggagaccctgtccctcacctgcgctgtcaatggtgcgtccctcactaatctctactgganctggatccgccagccccaggggaacgggctggagtggagttagggggaaatcgaggtacaaaaggtggaggacaaccgaaagtaccaacccgtcctacgagagtacgagtcaaccatatacgaaatacgactacgttccaagaactcaacgttcncctgacgtctgtacttctgtcgaacncgccgacgtacgacgctgtagtattactgtgacgtagactttcgttcggcgtcggttacgtcttcgttcgacctaggtcggggacccgtaacggggtaccccttagggtaccctaacccggttcttacccgttcgaaccgtcccctaacccgaaccggtaacgggtacccccg

SEQ ID NO: 228198 - DNA, 687 bp, Homo sapiens
  misc_feature: GYAE6OF01DGMFP.14.85.H08.1.454.CMB.1.raw
  modified_base (297)..(297): a, c, t, g, unknown or other
  misc_feature (297)..(297): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttatactttgtctcctgtaccaacagcacccaggcaaacgccccaaatcatgattangacgtcaatacgccggccgtcggggtccctgactcgtcttctcgtggcctaccgaagtctcggacaacgaccggtccctcccgtgacccgttctccgtcgggtcctccgacggtcctaggacgagttggaacggtcgttagtaactttacgtttaccgtcggactaacggtccttacgaactacgttcggacctaaggttaccgtaaacggtttaaaccgttaacgggttttttccgggggttttaccgggacggggtaaccgggaacccgtaacggtccgttaccggtaccccggttaaccgttaaacggttccgaacccggtaccccgtaaacgggtccctaccccggtaccccccgttcggttaccctaccgttcccggttaccccg

SEQ ID NO: 228199 - DNA, 740 bp, Homo sapiens
  misc_feature: GYAE6OF01D4KAD.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccgaggggaacggggctgggagtggagttaggggaaatcgagtacgaaagtggaaggacaaccgaacgtaccaacccgtcctacgagagtcgagtcaccatatacaatacgaactacgttaccaagtaatcctagttcctcccgtaggtaacggtcgtagtaacctttcgtaggttacgaaccgtacggcccggaccgggtaaccgtaaccgggtcgttacggttacggtttaacgtttaaccgtcggttacgggtacccggtaaggttacgtttcccgggttttccgggaccgtttacggggttaacccgtccgtttcgtttacgggtaacccgttaccgggtccggggggtaacccgtaaaccgggggtaaccccgtttcggggttaccccgtaaccccgggtttccttacccggtttaccgaacccggtcccccgttaccccgaaacccgggaacccgggtaccccccg

SEQ ID NO: 228200 - DNA, 628 bp, Homo sapiens
  misc_feature: GYAE6OF01ATTHW.14.85.H08.1.454.CMB.1.raw
  modified_base (303)..(303): a, c, t, g, unknown or other
  misc_feature (303)..(303): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggacaaacgcccccaaactcatgatttangacgtacaataagccggcccgtcggggtccctgactcgtcttctctggctccagtctgcaacacggcctccctgaccgtctcgtgggcctccgaggctgacgtagtgaggtctagtattagttactgctagcctacactagtcgacacgtacaagttaacgttaacgggttttcgggggtttaccggacggggtaacggtaccgtaaaggtccgttacggaacccggttaccgtaaaggtccgaaccggacccccgtaaagggtccccgttacccggtacccccccgttacgggttcccctaacccgttcccgtttaccccccgg

SEQ ID NO: 228201 - DNA, 625 bp, Homo sapiens
  misc_feature: GYAE6OF01CG0EW.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccgagggaacggggctggagtggattgggggaaatcgagtcaaagtggaggcaccaagtaccaacccgtccctcggagagtcgagtcacatatacaatagacacgttccagaatcagttcctccctgacggtctcgactttctgtgacagcccgacggacacggctgtgtattacgtgtcgcgtaagtactttccgtttcgggccttacgggtaccgtccgtttcgttacggtaaccgtttaccgggtccggggggaccccgtaacgggggtaacccccttggggttccccacccgggtttccttcccgtttccgaaccgtccccttaccccgaacccggtaacggggtaccccccc

SEQ ID NO: 228202 - DNA, 540 bp, Homo sapiens
  misc_feature: GYAE6OF01ANYHU.14.85.H08.1.454.CMB.1.raw
tcagcgtctagtaccacgaccggtgctcgatttagtatcactcagtcgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggacaaacgcccccaaactcatgatttatgacgtcaataagccggcccgtcggggtccctgactcgcttctctggctccaagtctggcaacaccggccctccctgacccgtctcgtcgggcctccgaggctgacgtatggaggctgtattattacgtgcagctcatatgcagtcaagttaactaagttttcggggtttcgcgtggaggaccaagctcgtaccgtctagtccacgacccaggtcctccgccccctcggtcctcgtccg

SEQ ID NO: 228203 - DNA, 642 bp, Homo sapiens
  misc_feature: GYAE6OF01AFPP6.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggactccgccacgccccgaggggaacgggctggagtggagttaggggaaatcgagtacaaagtggaggcaccaagtaccaacccgtcctacgagacgtcgacgtcacatatcaaatacgactacgttaccaagtaactctacgttcctcccgtgtacggtctacgtacttctgtagaacgtacgccggaccggacgaccggtctagtacgttacttacgtggtcgacgtagtacttcgtttccggacgttcggtaccgtcgttcgttaggaccgttacgggtcggggacccgtaaccgggggtaaccccttcgggtccctacccggttcccgttaccgtttccgaacccgttccccgtaaccccgaacccggaaaccggggttcccccg

SEQ ID NO: 228204 - DNA, 658 bp, Homo sapiens
  misc_feature: GYAE6OF01C6CRW.14.85.H08.1.454.CMB.1.raw
  modified_base (254)..(254): a, c, t, g, unknown or other
  misc_feature (254)..(254): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctcgtccctcacctgcgctgtcaatggtgccgtccctcactaatctctacgtggancgtggactccgccaccgccccgaggggaacgggctagggagtggagttaggggaaatcgagtacgaaaggtggagacacgaacgtaccgacccgtccgacgacgacgtacgacgtaccgacctaatacgtacaaagtacgaacctaccgttaccaagtaactactacgttcctccgtgacggtctagtacttcgtgtcgacacggccgacggacgacggtctggttacgttacttacgtgttcggacgtagttacgtttcgtttcgggcgttcggtaccgtcttccgttagtaccgtaccgggtacggggacccgtaacggggtaaccccgttcggtacccgtacccgttccttaccgttaccggaccgtaccccgttaccccgaacgggtaacccggtccccg

SEQ ID NO: 228205 - DNA, 651 bp, Homo sapiens
  misc_feature: GYAE6OF01A7N49.14.85.H08.1.454.CMB.1.raw
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctctggtaccaacagcaccagacaaacgccccaactcatgatttatgacgtacaagtaacgccggcccgtcggggtccctgactcgcttctcgtcggctaccagtctggaccaacgaccggtccctcccgtgtacccgtctcgtcgggcctccgaggtcctaggaccgtagtggacggtctgtaatttacttacgtcgactacgtcctacactagtcgactagtaccgtaagttaaccgttaagggtttttccggggtttacggacggggtaaccgggtaacccgtaaggtccgttacggtacccgttaccgttaaggtcccgtaaccgaccccgtaaaggtccccgtacccggtaccccccggttaaccggtcccttacccgttcccggttacccccg

SEQ ID NO: 228206 - DNA, 678 bp, Homo sapiens
  misc_feature: GYAE6OF01CLLOD.14.85.H08.1.454.CMB.1.raw
  modified_base (172)..(172): a, c, t, g, unknown or other
  misc_feature (172)..(172): n is a, c, g, or t
  modified_base (234)..(234): a, c, t, g, unknown or other
  misc_feature (234)..(234): n is a, c, g, or t
  modified_base (357)..(357): a, c, t, g, unknown or other
  misc_feature (357)..(357): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcncaggactgttgaagccttcggacgaccctgtccctcacctgcgctgtcaatggtgcgtcctnactaatcctctactgagctggactccgccacgccccgagggagggctggagtggagttagggaaatcgagtacgaaagtgagcacgaagtacaaccgtcctcgagagtcgacgtcaaccatanacaaatgaacaacgtttaccaaggaaactctaagttcctacccgtgtaacggctcgtaaccttgtacggtagaacgacgcccggacgggaaccgtaacgggtccttaggttagtaacttttagcgttacggacgtaaggttacttccgggttttaccggccgttacgggttaacccgtcgttaccgttcggtaaccgttaaccgggttcggggacccgtaacggggtaacccccttggggtccctaacccgggtttcttacccttttacccggaaccttcccccgttaacccaaacccgggtaaccggggttaaccccccg

SEQ ID NO: 228207 - DNA, 701 bp, Homo sapiens
  misc_feature: GYAE6OF01C0A91.14.85.H08.1.454.CMB.1.raw
  modified_base (182)..(182): a, c, t, g, unknown or other
  misc_feature (182)..(182): n is a, c, g, or t
  modified_base (268)..(268): a, c, t, g, unknown or other
  misc_feature (268)..(268): n is a, c, g, or t
tcagcgtctagtaccacgaccggtgctcgatttagtatcactcagtcgcgggggggtgctttactgagagttccatggaacctcctcgcgacaagaacatgaaacacctgtggttcttcctcctcctggtgggcagcttcccagatgggtcctgtcccaggtgcagctacagcagtggggcncaggactgttgaagccctttcggggacgtaccctggtcccctacaacccttggccggccttggtcaaagttggtcgcgtcccctanaaccttaatccgtactacctcggtaagcctagggtacttccggacccacgaccccccgagggggaacggggctagggaggtcggagttagggggaaatcgagtacgaaaggtgggaggacgacaagtacaacccgtcctacgagtagtacgagtacgacatatactaagtagacacgttccagtaactcagttcctccgtagaaggcctagacttactggttgacgtacggccgacggacgaaccggtctaggtggttaacttcgttaggtagtaccgtaagtacttcgttttcggacgttacggttaccgtcgttcgtaacggtaccgtacggtacggggggtaccggtaacgggggtaccccttgggttacccgaccggtttcgtaccggtttccgaacggtccctacccgtaccggtaacgggtaccccg

SEQ ID NO: 228208 - DNA, 537 bp, Homo sapiens
  misc_feature: GYAE6OF01A9GQ4.14.85.H08.1.454.CMB.1.raw
  modified_base (442)..(442): a, c, t, g, unknown or other
  misc_feature (442)..(442): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccaggggaacgggctggagtggagttggggaaatcagtcaaaggtggagcaccaagtacaacccgtcctcgagacgtcgagtcaccgatatacaatagacacgttccaagaatcagttctcctgagctgcttctgtgacagcccgcggacacggctgtgtattactgtgcgagtntcgtttcgcgttggacgtctcttgacgtacgtcgggccgagggtaccctcgggtcaccggtctccttcgacgccctcccacccgacgggtccccg

SEQ ID NO: 228209 - DNA, 602 bp, Homo sapiens
  misc_feature: GYAE6OF01CQX26.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccgaggggaaggggctggaggtggagttgggggaaatcgagtcaaaggtggaggcaccaagtaccaacccgtccctcgagagtcgagtcaaccatatcaatagactacgtccagaactctagttctcctagacggtctgtacttctgtgacgacgccggcggacgacggctgtcgttattctggtgcgtagtacttcgtttcggtcgttcggttacgtcgttccgttacggtaccttaccggtcggggacccgtacggggtaaccccgttgggtccctaccccggttcttcccgttccgacgtcccctacccgtaacccgaaccgggtacccccg

SEQ ID NO: 228210 - DNA, 746 bp, Homo sapiens
  misc_feature: GYAE6OF01BCJTX.14.85.H08.1.454.CMB.1.raw
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataacttttgtctcctggtaccaacagcacccaggacaaacgcccccaaactcatgtatttatgactcaataagcggcccgtcgggggtcctgactcgtcttctctcggctaccaagtctggccaacgaccggtccctcccgtcgaccgtcctcgtcgggtcctccgacgggtctacgaccgtagtaggacgggtccttaggtaacttttacgtttaacgtcgtaccgtacgtccttactaaccgtagttcgacctaacgggttacctaaacgggttaaaccgtttaacggttttttacccgggggggttttacgggaaccgggggtaacggggtaaccccgtaaacgggttacccggttacccgggttaacccgggttaaccccgttaaacggttaaccccgtaacccgggtaacccccggtaaaccggggcccgtttaccccgggacccccccccgtttaccgggttaccccttaaccccggtttcccgtttaccccccggg

SEQ ID NO: 228211 - DNA, 602 bp, Homo sapiens
  misc_feature: GYAE6OF01E3O1O.14.85.H08.1.454.CMB.1.raw
  modified_base (401)..(401): a, c, t, g, unknown or other
  misc_feature (401)..(401): n is a, c, g, or t
  modified_base (478)..(478): a, c, t, g, unknown or other
  misc_feature (478)..(478): n is a, c, g, or t
tcagcgtctagtaccacgaccggtgctcgatttagtatcactcagtcgcgggggtgatttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccaggggaaggggctggagtggattggggaatcagtcaagtggagcacaagtacaacccgtcctcgagagtcgagtcaccatactacaatacgacacgttaccagaatcagttcctccgtgacggctgacttcngtcgacacgccgcggacacggcgtgttgtacttacgtgtcggcgagtacgttccgtttcgggccttagggttacccncgtttcgttcgaccgttaccggtcgggggacccgtaacggggtaaccccgttgggttacccctacccggttcttaccctttaccgaccgtcccctaccccgaacccggtaacgggtaccccccg

SEQ ID NO: 228212 - DNA, 647 bp, Homo sapiens
  misc_feature: GYAE6OF01A5QZS.14.85.H08.1.454.CMB.1.raw
  modified_base (251)..(251): a, c, t, g, unknown or other
  misc_feature (251)..(251): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactgganctggactccgccacgcccccgaggggacgggcgtggaggtggagttagggggaaatcgaggtacaaaggtggacggaccaaccgaacgtaccaaccccggtcctacggagacgtcgagtaccaaccatactacaatacgactacgttaccaagtaactctagttcctcctaggacggtcctagtaccttcgtggtacgaccaggtcccggacgggaccacgggtacttggtcgttaattacgtgtcgacggtatacgtttccgttacggcgttacggtacgtcttacgttcgaccgttcggtccggggacccgtaacgggtaaccccgttgggtccctacccggtttcttcccgttcgtacctacccgtccccgaaaccggtacccgggtaccccg

SEQ ID NO: 228213 - DNA, 589 bp, Homo sapiens
  misc_feature: GYAE6OF01A8E1R.14.85.H08.1.454.CMB.1.raw
  modified_base (439)..(439): a, c, t, g, unknown or other
  misc_feature (439)..(439): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatcccgccacgcccccgaggggaacggggctggaggtggagttagggggaaatcgagtacgaaaggtgggaggcaccaagtaccaacccgtcctcgagacgtcgagtccacatatcaatagacacgttccagaatcagttcctcccgtagacggtctgaccttcgtgtcgacacgccgcggacncggctgtgtattactgtgcgagtacttcgtttcggcttgggtacgcttcttgaccgttacggtcggggacccgtaacgggtaaccccgttgggtccctacccggtcttccgttccgacgtcccctacccgacccgtaaccgggtcccccg

SEQ ID NO: 228214 - DNA, 540 bp, Homo sapiens
  misc_feature: GYAE6OF01BGI7Y.14.85.H08.1.454.CMB.1.raw
  modified_base (433)..(433): a, c, t, g, unknown or other
  misc_feature (433)..(433): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagccccagggagggctggagtggattggggaaatcagtcaaagtggaggcaccaagtacaacccgtcctacgagagtcgacgtcaccgtatatcaatacgacacgttaccagaatcagttctcctgaggtctgtacttctgtgacagccgcgacacggctgtgtattacgngtgcgagtattccgtttggcttcggtactctcttgtactacgtcggggcctacgggtaccctcggtcctaccgtctcttcacgtccctaccgaccgacggtaccccg

SEQ ID NO: 228215 - DNA, 686 bp, Homo sapiens
  misc_feature: GYAE6OF01DX5UQ.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggacgaccctgtccctcacctgcgctgtcaagtggtcgccgtccctcaactaatctctacgtggagctggactccgccacggccccgagggacgggcgtggagtggagttagggaatcgaagtacgaaggtcggagaccaacgtaacgtaccgaacccgtccgtacggacgacgtacgacgtaccaactaatactactaaatacgacgtaacgtaccgaagtaactacgtacgttacctccgtaggacgtcgtacgtacttcgtagtacgtaacgacgcccgggacgacggtaccgtgttacgtacgtttacgttaacgtggtacgacggtaagttaccgtttccggttacggaccgttcggtaccgtccgttacggttacggtaccggttacggtaccggggtacccgtaaaccgggttacccggcggttacccgtacccgttccgttaccgttccgacccgttacccgtacccgaacggtacccggtaccccg

SEQ ID NO: 228216 - DNA, 562 bp, Homo sapiens
  misc_feature: GYAE6OF01E2LMF.14.85.H08.1.454.CMB.1.raw
tcagcgtctagtaccacgaccggtgctcgatttagtatcactcagtcgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaacgcccccaaactcatgatttatgacgtcaataacgcggccctcggggtccctgatcgcttctctgctcagtctggcaacacggcctccctgaccgtctctgggctccgaggctgacgatgaggctgtattattactgcagcctcacatgcagtacaagttaacttaaggttttcggggttttacggacgggacgggaccaaggtccgtacgtacccggttacctaagtccgacggacccgaaggcccgtaccgcccccgtacggtcctaccgtccgttccccg

SEQ ID NO: 228217 - DNA, 645 bp, Homo sapiens
  misc_feature: GYAE6OF01CKH9I.14.85.H08.1.454.CMB.1.raw
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacgagggtcctgggcccagtctgccctgactcagcctccctccgcgtccgggtctcctggacagtcagtcaccatactcctgcactggaaccagcagtgacgttggtgcttatactttgtctcctgtaccaacaacaccagacaaacgaccccaaactcatctatttatgatctactaacgccgcctcgagggtatctaatcgtcttctctgcctacaagtctaggacaaccgaccggtccctcccgtacgtacccgttctccgtcggccctccgacgtacgtcggaacggacggagcttagtaatttacgttactcgccctactactaatagtaacgtaagttacgttacttaccgttccgttacggtttgggtttaccgggacgggtaacgggaccgtaaggtccgtaccggtacccggttccgtaagggtccgacggtacccggaacggtcccgtacccggtcccccgttcggtaccctaccgttcccgttccgttcccccctaccccg

SEQ ID NO: 228218 - DNA, 670 bp, Homo sapiens
  misc_feature: GYAE6OF01B78QH.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgccgtccctcactaatctctactggagctggactcccgccacgcccccgaggggaacggggcgtgggaggtggagttagggggaaatcgaggtacgaaaggtggaagacaccaagtaaccgaaccccgtccctacgagacgtcgagtcaacatactacaaatacgactacgttccaagaactcgacgttcctcccgtaggacggtccttacgtacctttcgtgtacgaccgtacggcccggacggaccgaccggtcgttggttacgttacgtttactgggtcggacggtaagttcgttaccggtttccggcgtttcggtaccgtcttcgtttacggaccgttacggtccgggggtaccgaaccggggtaacccgttcgggtcccttacccggttcttaccgttcccgaacgtccccctacccgaacccggtaccgggtacccccg

SEQ ID NO: 228219 - DNA, 745 bp, Homo sapiens
  misc_feature: GYAE6OF01DRZJ5.14.85.H08.1.454.CMB.1.raw
  modified_base (242)..(242): a, c, t, g, unknown or other
  misc_feature (242)..(242): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtcctgccctgactcagcctccctccgcgtccgggtctcctggacagtcagtcaccatactcctgcactggaaccagcagtgacgttggtnacttaatactttgtctcctaggtaccaacacgaccacccgaggaccaaaccgccccaaactcatagtatttatcgacgtacaagtaacgcggcccgtcggggtccctgtactcgtcttctcgtcggtctaccgaagttcgtacggaccaaaccggtaccggtcccctcccgtacgtaccccgttcgttacgtccggggtcctacccggtaacggtccgtaacggaacggtacgttacggacgggtacttacgttaagttttaacgtttacgtacgacgtacgtaccttacaacgtacttacggaaccgtagttaaacccgttaacggttaaaccgtttaacggggtttttccggggttttaaccggggaccggggtaacgggtacccaaaaggtccgttaccggtaacccgttaacccgtaagtacccggtaaccggaccccgtaaggtccccgtacccggttaccccccgtggttacccctacccgtttccgttacccccgg

SEQ ID NO: 228220 - DNA, 627 bp, Homo sapiens
  misc_feature: GYAE6OF01C8GPI.14.85.H08.1.454.CMB.1.raw
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacaggtcctgggcccagtctgccctgactcagcctccctccgcgtccggtctcctggacagtcagtcaccatactcctgcactggaaccagcagtgacgttggtnacttatacttgtctctgtaccacagcaccagacaacgaccccaatcatgtatttancgtactacaatacggccggtcccgtcggggtccctgactcgtcttctcgtcggtcctaccgtaagtcgtacggaccaacgaccggtccctcccgtcgacccgttctcgtcgggcctcgacggtctacggacgtagtcgagtactagttaacttacgttacgtcgtacgacgtctacactagtcgacagtcgtaaagttacgttacgggttttcggggttacgacgggaacggtaaccgtaggccgttacggaccgttaccgtaacgtaccgtaccgacccgtacggtccctccccggtaccccgttggtaccctccgtttcccgttacccccg

SEQ ID NO: 228221 - DNA, 607 bp, Homo sapiens
  misc_feature: GYAE6OF01D970T.14.85.H08.1.454.CMB.1.raw
  modified_base (425)..(425): a, c, t, g, unknown or other
  misc_feature (425)..(425): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatcccgccagcccccaggggaagggctggagtggagttgggggaaatcgaggtacgaaaggtgggaggacaccaaagtaccaaacccgtccctcggagacgtcgagtcaccatactcaatagacacgttaccagaatcagttcctccgtgaggctgtacttcgtgtgacngccgacggacgcggctgtagtattacgtgtcgcgaagtgtaccgtttcggcgttcggttacgtcgttccgttacgaccgttaccggtcggggtacccgtaaccggggtaacccttcggggtccctaacccggttccttaccgttccgtaccgcccctacccgaacccgacggggtacccccg

SEQ ID NO: 228222 - DNA, 664 bp, Homo sapiens
  misc_feature: GYAE6OF01CLZON.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaacgccttcggacgaccctgtccctcaccctgcgctgtcaatggtcgccgtccctcactaatctctacgtggagctggactccgccacgccccgaggggaacgggcgtggagtggagttggggaaatcgagtacgaaagtggacggcaccaagtaaccaacccgtcccacgagacgtacgagtacacatactacaatacgactacgttaccaagtaactctagttcctccgtagacgtctacgtactttcgtagtcgaaccgacggcccggacggaccgacggtcgtgttacgttaacgttacgtgtacgacgtaggtacgtttccgtttcgggtaccgttcgggttaccgtcgttcgttcgaaccgttacggtccgggggacccgtaacgggttacccctacgggtcccgttaacccggttcctttaccgttacccgacgttccccgtaacccggtaacccgaacccggggttacccccg

SEQ ID NO: 228223 - DNA, 632 bp, Homo sapiens
  misc_feature: GYAE6OF01A4C3Y.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggacgaccctgtccctcacctgcgctgtcaatggtcgcgtccctcactaatcctactacgtggagcgtggactccgccacgccccgaggggaacgggcgtggagtggagttggggaaatcgagtacgaaggtggacggcaaccgaagtaccaacccgtcccgtacggagacgtcgagtaccaacgatactacaagtacgactacgttaccaagtaatcacgttacctaccgtaggacgtctacgtacttcgtgtacgacgacgaccggaccgaacgccggtcgtcgttagttacttacgtgtacggcgtacgtagttccgtttcggcgttcggtacgtccttacgttcgaccgttacggtcggggacccgtacgggtaccctcgggtcccaccgttcctaccgttaccgacgtacccgtacccaccggtaaccggtccccg

SEQ ID NO: 228224 - DNA, 661 bp, Homo sapiens
  misc_feature: GYAE6OF01BADJ2.14.85.H08.1.454.CMB.1.raw
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagacccctgtccctcacctgcgctgtcaatggtnccgtcctnactaatctctacgtggagcgtgactccgccacgcccccgaggggacgggctggagtggagttggggaatcgagtacaaaggtggaggcaaccaagtaccaacccgtcctacgagacgtcgacgtccaacagtatacaagtagaccgtacgttaccagtaaactccgtacgtttccgtccccgtaggacggtacttcgtaactttcgtacgtcggaactcggaccgaccggacgtacggccgtttgtaggttactttacgtaggtcgacggtagttacgttcgtttccggtgtcgggttaacgcgttacgtaggtaccgttccgggtacgggtacccgaccgggtacccgttacggtcccgacccggtttcgtacccgtttccgaacccggttacccttacccgaaccccggtacgggttacccccg

SEQ ID NO: 228225 - DNA, 547 bp, Homo sapiens
  misc_feature: GYAE6OF01A1NXI.14.85.H08.1.454.CMB.1.raw
  modified_base (439)..(439): a, c, t, g, unknown or other
  misc_feature (439)..(439): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccaggggaaggggctgggagtggattgggggaaatcgagtcaaaggtggaggcaccaagtacaacccgtcctcgagagtcgagtcaccatatcaatagacacgttccagaactcacgttctccctgacgtctgacttctgtcgacagccgcggacacggctgtgtattacgngtgcgagattcgttcggcttggtacgcttcttgacgttacgtggggacccaggggtaacccctggtcccacccgttctccgttcacgtccctccaccgacgggtcccc

SEQ ID NO: 228226 - DNA, 669 bp, Homo sapiens
  misc_feature: GYAE6OF01BR8EN.14.85.H08.1.454.CMB.1.raw
  modified_base (253)..(253): a, c, t, g, unknown or other
  misc_feature (253)..(253): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtcgccgtccctcactaatctctactgganctggactccgccacgccccgaggggaacggggctggaggtggagttaggggaaatcgagtacgaaaggtggaggacaaccgaagtaccgaacccgtccgtacgagacgtcgacgtacaaccatactacaatacgacctacgtaccaagtaactacgtacttccgtaccgtaggacgtcctacgtacctttcgtaggtacgacgtacggcccgacggtacgacggtcgttggtacgttaacgtttacgtcgtacgacgtagttacgtttccgtttaccggacgttacgggtccgttaccttacgttcgtaaccgttcgggtacggggtacccgtaaccggggtacccgttcgggtcccctaccgttcttacccgttacgacccgtaccctacccgaacccggtaccgggtacccccg

SEQ ID NO: 228227 - DNA, 748 bp, Homo sapiens
  misc_feature: GYAE6OF01BQRML.14.85.H08.1.454.CMB.1.raw
  modified_base (226)..(226): a, c, t, g, unknown or other
  misc_feature (226)..(226): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtncgtccctcactaactctctactggagcgtgatcccgccagcccccgaggggaacgggctggagtggacttggggaaatccgagtacgaaagtggaaggcaaccgaagtaaccgacccgtcctacgagacgtcgagtcaaccgtataacgtacaagtacgacaccgttaccaacgaatcgtaagttcctacccttgaacggtcttacggtactttacgtggtacgtaacgacggacccggtaccgggaacgtaaccgggtcgttacggttacggttaactttaccggttcggttagccggtaacggtaacgttccgggttttccgggaaccgtttacgggttaacccggttccgttaccggttttacggtaacccggtttaccggtaaccgggggggtaccccttaaacggggggtaaccccccgttacggggtttacccgtaaccccggtttccgttacccgtttaccgtaaccggtaccccctttaaccccgaaccccggttaaaccggggtaccccccgg

SEQ ID NO: 228228 - DNA, 646 bp, Homo sapiens
  misc_feature: GYAE6OF01C1RJB.14.85.H08.1.454.CMB.1.raw
  modified_base (240)..(240): a, c, t, g, unknown or other
  misc_feature (240)..(240): n is a, c, g, or t
  modified_base (492)..(492): a, c, t, g, unknown or other
  misc_feature (492)..(492): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatactcctgcactggaaccagcagtgacgttggngtactttataactttgtctccgtcggtaccaacacgacaccgacgacaaacgacccccaaactcattagatttagtgactacaataacgccggtaccgtccggggtacctcgagtcgtcttctcgtcgctaccgagtcgtacgacaaccgaccggtccctccgtcgtaccgtcgtcgtcgggcctccgacgtcgtacgacgtagtcggacgtcgtagtacttatacgtacgcgtacgtactcgatcgtacgngtacgtacgtaaacgtacgtttaacgggtttcgggtttacggacgggtaacggtacgtaacgtccgtacgtacccggtacgtaacgtacggacgacccggtaacgtcccgtacccggtaccccgttacggtaccctccgttcccttacccccgg

SEQ ID NO: 228229 - DNA, 638 bp, Homo sapiens
  misc_feature: GYAE6OF01EDG5A.14.85.H08.1.454.CMB.1.raw
  modified_base (239)..(239): a, c, t, g, unknown or other
  misc_feature (239)..(239): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtncttatactttgtctctgtaccacagcacccaggacaacgcccccaaactcatgtatttatgacgtcaataacgccggcccgtcggggtccctgactcgtcttctcgtgcctacgagtcgtgacaacgaccggccctcccgtcgtacccgtccgtccgtcgggtcctccgacggtctacggacgtagtcggaggtcttaggtaactttacgtttaccgtcggcgtacgtctacacgtatcgacgtacgtacgtaacgtttaacgttacgggtttttccggggtttacgggacggggtaacgggtaaccgtacggtacgtaccggtacccgttaccgtacgtacgtccggaccgacggcccgttcccgcccccgttacggtcctcccgttccgttaccccg

SEQ ID NO: 228230 - DNA, 621 bp, Homo sapiens
  misc_feature: GYAE6OF01BYG46.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggacgaccctgtccctcacctgcgctgtcaatggtgccgtccctcactaatctctactggagctggactccgccacgcccccgaggggaaggggctgggaggtggagttagggggaaatcgaaggtacgaaaggtgggacggcaaccgaagtaccaaccccgtcctacgagacgtcgagtcacatactacaatagactacgttaccaagaactctacgttcctccctgacgtctgacttctgtcgacagccgcgacgacggcttaggtagtattacgtggtcgcgtagtacgtttcgtttcgggctttcgggtacctcgttcgttacgtaccgttacggtaccgggggacctaaccggggtaacccctgggttccctacccgttcttaccgttcgaccgtccccctaccgaacccgtaaccgggtacccc

SEQ ID NO: 228231 - DNA, 521 bp, Homo sapiens
  misc_feature: GYAE6OF01BKKGU.14.85.H08.1.454.CMB.1.raw
  modified_base (502)..(502): a, c, t, g, unknown or other
  misc_feature (502)..(502): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaagggctggagtggattggggaaatcagtcaaagtggagcaccaagtacaacccgtccctacgagagtcgagtcaccatatcaatagacacgttccagaatcagttctcctgacgctgacttctgtgacagccgcggacacggctgtgttattacgtgtgacgagacttcttcggctggtacgctcttgactcgtcgggccacgggacctggtccaccgtctctcgacnccctccaccgacggtcccg

SEQ ID NO: 228232 - DNA, 644 bp, Homo sapiens
  misc_feature: GYAE6OF01BC3KI.14.85.H08.1.454.CMB.1.raw
  modified_base (509)..(509): a, c, t, g, unknown or other
  misc_feature (509)..(509): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaacgccttcggacgaccctcgtccctcacctgcgctgtcaagtggtgccgtccctcactaatctctacgtggagctgactccgccacgccccgaggggacgggctggaggtggagttaggggaaatcgagtacgaaaggtggacgacaacaagaccaacccgtccgtagagacgtacgacgacaacgatactacaactacgaactaccggttaccaagtaactctaagttccctacccgtagacggtctacgtacctttcgtagtaccgaacgtacggccggaccgacgacggtcgttacgtgttacttgcgttcggacgtagttnttacggtttcggacttcgggtacctcgttcgttacgtacgtacgggtcgggtaccggaacggttacccggtcggttaccgtacccgttcgttcccgttacacccggttcccaacccggaccggaccggtaccccg

SEQ ID NO: 228233 - DNA, 570 bp, Homo sapiens
  misc_feature: GYAE6OF01A69WA.14.85.H08.1.454.CMB.1.raw
  modified_base (389)..(389): a, c, t, g, unknown or other
  misc_feature (389)..(389): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagacccctgtccctcacctgcgctgtcaatggtgcgtccctcactaatctctactggagctggatccgccagcccccaggggaagggctggaggtggattgggggaaatcgagtcaaagtggaggcaccaagtaccaacccgtccctcgagacgtcgacgtcaccatatcaatagacacgttccagaatcagttcnccctgaggctgacttctgtgacagtccgcggacacggctgtgtattacgtgtgcgagtacgtcgtttcggcttcgggtaccgcttcgttcgacttacgtcgggggtacccacggggtaacccctgggtacctacccggttcttaccttccacgtcccctccgaacccgtaacgggtacccc

SEQ ID NO: 228234 - DNA, 821 bp, Homo sapiens
  misc_feature: GYAE6OF01A9H8A.14.85.H08.1.454.CMB.1.raw
  modified_base (330)..(330): a, c, t, g, unknown or other
  misc_feature (330)..(330): n is a, c, g, or t
  modified_base (369)..(369): a, c, t, g, unknown or other
  misc_feature (369)..(369): n is a, c, g, or t
  modified_base (405)..(405): a, c, t, g, unknown or other
  misc_feature (405)..(405): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcgagggcacagggtcctcgggcccagtctcgccctgactcagccctccctccgcgtccgggtctcctggacagtcagtcaccatactcctgccactggaaaccagcaggtcgacggtttggtaggtttaataagtattggttcttcctacggtaaccaacaacacccaggaccaaaccgaccccaaactcatagtatttacgngacggtcagtaactcggccctagtagggtttctaatcgnttctcgtcgctacagtcgtagcaacgcggcctccgngacctactctcggtcgggtccgtccgtaacggtcctacgggtaacgggaacggtacgtttaccgttaggttaaacgtttttacgtttaagtttcgggtaccacgtttacttaccttaagttaacgttaccgaacccgggttaccttacgggaaccgtaacccgggtaaccttaaacgttcccttaaaggggttttccggttttacgggggggttttttaccccggggggaaccccggggggggttaaacccgttaaaaccggggggtttacccgggttaaacccccgggttaccggggttttaaccccgggccggtaaacccggggtaacccccgtaccggggttaacccgggttccccccgttaccccccggggtttaccccggtttccccgggttaaccccgtttccccccggg

SEQ ID NO: 228235 - DNA, 721 bp, Homo sapiens
  misc_feature: GYAE6OF01EA2XV.14.85.H08.1.454.CMB.1.raw
  modified_base (225)..(225): a, c, t, g, unknown or other
  misc_feature (225)..(225): n is a, c, g, or t
  modified_base (273)..(273): a, c, t, g, unknown or other
  misc_feature (273)..(273): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcacgcctccctccgcgtccggtctcctggacagtcagtcaccatactcctgcactggaaccngcagtgacgttggtgactttataacgtttgtcttccgtaggtaccaancgaccacccgaggaccaaacgcccccaaacgtcatcgtatttagtacgtaaccgttacaaacgttaacggccgggtacccgttcggggtaccctggtactccgtcttccgtcgtcggccttaccaacggttctacgggacctaaacggtcccggtacccttcccgtacggtacccgttccgttccggtacgggtccttcccggtacggtaccgttacggaacgtacgtacggtacggtacgtaaggttaactttaacgttaccgttcgaccgtacgtaccctcaaccgtagcgtaacgtacgttaaccgtaacgtttaacgtttaacggggttttacggggtttaacgggagggtaaccggaccgtaacgtccgtaccgtaccgttacgtagtaccgtcgtaccggaacgtcccgtccgtccccgtagtcctaccttccgttaccccg

SEQ ID NO: 228236 - DNA, 653 bp, Homo sapiens
  misc_feature: GYAE6OF01BXMIG.14.85.H08.1.454.CMB.1.raw
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagacccctgtccctcacctgcgctgtcaatggtcgcgtccctcactaatctctactggagctggatccgccagcccccgagggaacggggctggagtggattggggaatcagtcaaagtgagcacaagtacaaccgtccncgagngcgagtcaccatanacaatacgactacgttaccaaggtaactcgtacgttcctacccgtgacggtccttagtacctttcgtggttacgaacctaggccccggagggacccacgggtccgttgttggttaactttaccgttgtcggcgtagtacgtttcccgttttcgggcgttcgggttaccgtccgttcgtttacgaaccgttaccggtaccgggggaccgtaacccggggtaccccgtttgggtacccgtacccgttcctttaccgttcccgacgtacccctttaccccgaaaccggtaccggggtacccccg

SEQ ID NO: 228237 - DNA, 942 bp, Homo sapiens
  misc_feature: GYAE6OF01DE0TA.14.85.H08.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
tcagcgtctagtaccacgaccggtgctcgatttagtatcactcagtcggcggggggggtctcaggaggcagcgctctcaggacgtcaccaccatggcctgggctctgcctcctcctcacgcctcctcactcgagggcacgagggtcctgggccctagtctgccctagacctcgacgccctcccctccggccgttcccggtctccgtggacagtcacgtcaccatacttcngacactaggaaccngtactaggtgtacggtttgatacttttaatacgtttntcctacgtacgtaacaacagaccaacccgaggaacctaaaccgaccccaaatcctaattagttactttaagcgtaaccgtactaacgtaaccggtcccggtacccggttaccggggtacccctaggtaccgttccgtccgttttccgtacgaccggttacctaacggtaacgttacggtaccggaaccgtaaaccccggccggtaccccgttacccgttaccggaacccgtttccgtccggttaacggggccctaccggtaacggtccgttaacgggaacgtaccggtagggtaacgttcgtttaaacgggtttaaactttaaccggggttttacaccggttaaccgacggtaccctaaccgttaacgtaccggttacgtaaacgggtaacccgtttaaacgtaaacccgggttttaaaaccggttttaaccgggggttttttcccgggggggtttaaaccaacccgggggtaaaccggggttaaacccttaacgggtaccccggttaaacggttaacccccgggtttttaaaccaaaccgggtaacccgggtacccccgttaaaacccgggtcccggttaaacccgttccccccggggttaaccccttacccggggtaaaccccctttacccgggtttcccgtttaaaccccccccgggg

SEQ ID NO: 228238 - DNA, 646 bp, Homo sapiens
  misc_feature: GYAE6OF01AGBM9.14.85.H08.1.454.CMB.1.raw
  modified_base (196)..(196): a, c, t, g, unknown or other
  misc_feature (196)..(196): n is a, c, g, or t
tcagcgtctagtaccacgaccggtgctcgatttagtatcactcagtcgcgggggtgctttctgagagtcatggacctcctgcacaagaacatgaaaccacctgtggttcttcctcctcctggtggcagctcccagatgggtcctgtcccaggtgcagctacagcagtggggcgcaggactgttgaagccttcgganaccctgtccctcacctggcgctgtcaatggtgccgtcctcactaatctctactggagctggactccgccacgcccccgaggggagggctgggagtggagttagggaatcagtcaaaggtggagccaccgaagtaccgaaccccgtccgacggagacgtcgacgtccaaccataacgtactaaatacgacctacgttaccaagaactctaacgtttccctcccgtaggacggtcgtagtacttcgtgtgacgacggtccgaccggaaccgaccggtcgtagttccgttagttacgtcggtcgacgtagtaacctttcggttaccggcttcgggttacctcgttagttcgaccgttacggtccggggacccgtacgggaaccccgttggttccctaacccggttcttaccgttccgaccgtacccctacccgaacccggtaccgggtccccg

SEQ ID NO: 228239 - DNA, 759 bp, Homo sapiens
  misc_feature: GYAE6OF01A0HLJ.14.85.H08.1.454.CMB.1.raw
  modified_base (230)..(230): a, c, t, g, unknown or other
  misc_feature (230)..(230): n is a, c, g, or t
  modified_base (519)..(519): a, c, t, g, unknown or other
  misc_feature (519)..(519): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacgagggtcctgggcccagtctgccctgactcacgcctccctccgcgtccgggtctccgtggacagtcagtccaccatactcctgcacgtggaaccngcagtgtacgttggtcgtacttattaacgtttgtctccgtacggtaccaacacgtccaccgaggaccaaaccgaccccctaaagtcaagtgtactttagtcgtaaccgtaacgaacgtaacggtcccggcccgttacggtaacggggtttttactaacgttccgttactttccgtcgttacggtccttaaccgtaagttcccgtacggaaccgtaaaccgacccggttaccccttacccgtaccgacccttacgtttacccgttcgggttaccggggtcccttaaccgngggtaccgttacgggaaacggggtaccgtacggtttaccgttacgttaacttttacgttaacgtcgaaccgtcgtacctacgttaacttaacttaacgttattacggaactacggttaaccgttgggtttacggttcggacggtaacgggtacgtacggtccgtcccgtaacgtccgggtacaccggacctacggtccttcccgcccggttcgaccgtccttcgttccccgttacccccg

SEQ ID NO: 228240 - DNA, 241 bp, Homo sapiens
  misc_feature: GYAE6OF01DLDEJ.14.85.H08.1.454.CMB.1.raw
  modified_base (176)..(176): a, c, t, g, unknown or other
  misc_feature (176)..(176): n is a, c, g, or t
  modified_base (237)..(237): a, c, t, g, unknown or other
  misc_feature (237)..(237): n is a, c, g, or t
  modified_base (240)..(241): a, c, t, g, unknown or other
  misc_feature (240)..(241): n is a, c, g, or t
tcagcgtctagtaccacgaccggtgctcgatttagtatcactcagtcgcgggggtgctttctgagagtcatggacctcctgcacaaagaacatgaaacacctgtggttcttcctcctcctggtggcagctccagatgggtcctgtcccaggtgcagctacagcaggtgggggccanagggtacttggttgaacgtccttcgggagaccctgtcccctcacctgcgctgtcaagtgtnccnn

SEQ ID NO: 228241 - DNA, 641 bp, Homo sapiens
  misc_feature: GYAE6OF01A88TB.14.85.H08.1.454.CMB.1.raw
  modified_base (474)..(474): a, c, t, g, unknown or other
  misc_feature (474)..(474): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgccgctgtcaagtggtgccgtccctcactaatctctacgtggagctggactccgccacgccccgaggggaacgggcgtaggagtggagttaggggaaatcgagtacgaaaggtggaggaccaaccgaacgtaaccaaccccgtcccgtacggacgtacgtcggacgtcgaaccatatactaatagaactacgttaccgaagtaactactacgttcctccgtgaggtctgtacttcgtgtacgacgcgccggcggacgacggtntggtcgttacgttacgtggtacgcgtagtacgttccgttcggcgttacggtaccgtcgttcgtacgtaccgttacggtaccgggaccgtaacgggtacccgttcggtcctacccggttcttacccgttaccaccgtaccctcccgtaacccggaccgggtaccccgg

SEQ ID NO: 228242 - DNA, 696 bp, Homo sapiens
  misc_feature: GYAE6OF01BGOPS.14.85.H08.1.454.CMB.1.raw
  modified_base (195)..(195): a, c, t, g, unknown or other
  misc_feature (195)..(195): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcgganaccctgtccctcacctgcgctgtcaatggtgccgtccctcactaatctctacgtggagctggactcccgccacgcccccgaggggaacgggctggaggtggtagttagggggaaatcgagtacaaaggtggaggacaccgaaagtaccaacccgtccctacggagagtcgacgtacacctatacgtacaatacgactacgttaccaagtaactctacgtttcctacccgtaggtacggtcttggtaacctttcgtcggttacgaaccgacggtcccgggaccgggaaccgtaccgggttcgtacggttacgttaacgtttacgtgggttacgacggttaagtacgtttcgtttcgggacgttcgggtacctccgttcgtttcggaccgttacggtacgggggtacccgtaacgggggtaccccttacgggtcccgttacccggttccttccgtttacccgaccggtccccttaacccgaacccgggtaacggggtaccccc

SEQ ID NO: 228243 - DNA, 687 bp, Homo sapiens
  misc_feature: GYAE6OF01AIIKV.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgccgtccctcactaatctctactggagctggactcccgccacgccccgaggggacgggctggagtggagttaggggaaatcgagtacgaaaggtggacggccaacgaacgtaccaaccccgtcccgtaggagacgtacgacgtaccacatactacaaatacgactacgttaccgaagtaactctacgttccgtaccgtaggacgtctacgtactttcgtagtcgtacgacggtcccgacggaaccgtacggtcgttaggttacgttaactttacgtggtacgtacggtacgtacgtttccgtttaccggtacgttcggttacccgtctttaccgtcggtaccgttacgggtccggggtacccgtaacggggttaccccgttacggtccccgtaacccgtttccgttaccgttacccgaccgttcccccgtaacccggtaacccgtaacccggggttaccccc

SEQ ID NO: 228244 - DNA, 861 bp, Homo sapiens
  misc_feature: GYAE6OF01C7P7Z.14.85.H08.1.454.CMB.1.raw
  modified_base (585)..(585): a, c, t, g, unknown or other
  misc_feature (585)..(585): n is a, c, g, or t
tcagcgtctagtaccacgaccggtgctcgatttagtatcactcagtcgcgggggtgctttctgagagtcatggacctcctgcaacaagaacatagaaacacctgtggttccttcctcctccgtggtggcacgctccagagtcggtcctgtccaggtgcagctacagcgaggtcggggcgcgaggacgtgttagaacgtccgttacgggaaccgacccttcgtcccctcacccgtgccgtcgttagttacgaagttcggtccgccgtccctactaaccttaactccttactaacggtggacgtcgttacggaccgtcccggaccgaccgggaccccggaagggggaacggggtcgtaggggtaggttagggtagggttaacgggaacttcggtaaggttaacgaaagggtcggaacggaccctaaaccggtaaaccgtaaccccgaaccccggttaacccgttacggaaacggtacggtaccggtaacgttaaccaaccctaagtaacgtaaacctaaaggtaaccgtaaccgttaaccgttacctaaacggtaaacttcccgttaacgtttcccgttaacccggnggttacgtacgtttaaccttaccggtttcgtaacggttaccgggaaccgaccgggtaacccggtaccggaccggtcgttacgttaggtttacgtttaacgttcgtacggtcggtacgtaacgtacgtttccgggttacggtacggtacgtcgtccgttacgttcggaccgttaccgggtacgggtaaacccgtaccggggtacctccgggtaaccgtcccgtttacttacccgtacgtaccccggtacctaaccccggtacggtccggttaccccg

SEQ ID NO: 228245 - DNA, 800 bp, Homo sapiens
  misc_feature: GYAE6OF01A1PBP.14.85.H08.1.454.CMB.1.raw
  modified_base (174)..(174): a, c, t, g, unknown or other
  misc_feature (174)..(174): n is a, c, g, or t
  modified_base (224)..(224): a, c, t, g, unknown or other
  misc_feature (224)..(224): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcgagggcacgagggtcctgggcccagtctgccctgactcagcctccncgcgtccggtctcctggacagtcagtcaaccatatcctgcactggaaccngcagtgacgttggtcgtatttaataacgttttgtacctcgtcggtaaccaactagccaccgacggaccaaaaccgacccccaaactccaatcgtaatttagtacgtaacgtacgtaaacgtaacggtcccggacccggttccgggggtaccctacggtacgtaccgtccgttttctaccgtcggtaccttaaccgagttacccgtacgggtacccaaaccggtcccggtacccgttaccccgtcggtaaccccggttcgttccgggtacgggtcccttaccggacgggttaccctcggggtaacgtacgtacgggtaacgggacttaggttaactttacggtaacgcggtaaccacggtctaaccgtaacggtattaccggacgtaacgttaccgtaacgggtttaacccgtttaaggggtttttacccgggggttcgggaacgggttaccggaaccgtacggttccgtaacggttaaccccggttacgtaacccggtacgaccccgtaacccggtacggtacccccgttccccggacccggttacggtacccttaccgtttcccggttaccccgg

SEQ ID NO: 228246 - DNA, 643 bp, Homo sapiens
  misc_feature: GYAE6OF01AVKTB.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcagtggtgcgtccctcactaatctctacgtggagctggactccgccacgccccgagggagggctggagtggagtaggggaaatcgagtacgaaaggtggacggacaaccgaagtaccaacccgtcctacgagacgtcgagtcaccatatacaatacgactacgttaccaagtaactctacgttcctcccgtgacggtctgtacttcgtgtacgacgacgcccggacggaccgtacggtctaggttacgttacttacgtggtgacgtagtacgtttccgtttcggcgttacggtaccgtcgttcgttacggtaccgttaccgggtcgggggtacccgtaacgggttaaccccgttcgggttaccctacccggttcgttacccgttaccgaccggtacccctaccccgacccggtaaccggtccccg

SEQ ID NO: 228247 - DNA, 720 bp, Homo sapiens
  misc_feature: GYAE6OF01D5BJM.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccgttcggacgaccctgtccctcacctgcgctgtcaatggtgccgtccctcactaatcctctacgtggagcgtcggactcccgaccaccggacccccgagggggaacggggcgtagggaggtcgggtaagttagggggaaactcgtaaggtacgaaaggtcgggacggacgaaccgaaacggtaacccgaaccccggtcccgtacggacgtacggtcgacgtaccaacgatactacaaataacgacctaaccgttacgaagtactacgtacgttaccctccgtaggacggtacgttacgtactttcgtcgtacgacgacggcccggacggaaccgaccggtcgttagttacgttaacgttacgtggtacggacgttacgtacgtttccgttcgggtaccgttaggtacccgtctttacgttacggtaaccgtaccggtacgggggtacccgtaaccgggtacccgttgggtccctaacccgttccgtaccgtttccgacccgtacccgtacccgaaccggaaccgggtaccccg

SEQ ID NO: 228248 - DNA, 716 bp, Homo sapiens
  misc_feature: GYAE6OF01CMCXI.14.85.H08.1.454.CMB.1.raw
  modified_base (211)..(211): a, c, t, g, unknown or other
  misc_feature (211)..(211): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
tcagcgtctagtaccacgaccggtgctcgatttagtatcactcagtcggcggggggggtctcaagaggcagcgctctcaggacgtcaccaccatggcctgggctctgctcctcctcagcctcctcactcgagggcacgagggtcctgggcccagtctgccctgactcagccctccctccgcgtccggtctccgtggacagtcagtccaccntactccgtgcacgtggaacccagcaggtgtacggttggtgtactttataactttgtctccgtcggtaaccaacagccacccgaggaccaaaccgacccccaaactcatgtatttagngacgtanaatacggccggtcccggtcggggtaccctgacgtcgtccttcgtcgtacggtcctacctaaggtcgtacggacctaaaccgcccggtcccgtacccgttcgaccccggttcgtccggtccgggtcctacccggtacggtccttacggacggtagtcggtaacgggtcttaaggtaactttagttaccgtacggtccagtccctacgaacgtacgtcggtactaacgttacgtaacgtaacggttttaacgggttttccggggttaacggggcgggtaaccggtaccgaacgtccgttaccggtaacccgttcgtaagtaccggcctaacccggccgtccggtcccgtaccccggtagttcccctaacttcccgttcccccg

SEQ ID NO: 228249 - DNA, 708 bp, Homo sapiens
  misc_feature: GYAE6OF01CIKLG.14.85.H08.1.454.CMB.1.raw
  modified_base (327)..(327): a, c, t, g, unknown or other
  misc_feature (327)..(327): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacgagggtcctgggcccagtctgccctgactcagcctccctccgcgtccgggtctccgtggacagtcagtcaccatactcctgcacgtggaaccagcagtcgacgttggtgtacttattacgtttgtccttccgtacggtaaccaacacgaccaacccgaggaccaaaccgacccccaaactcatagtatttancgacgtacaacgtacggccggtcccggtcggggtacctgtacgttccgtcttcgtcgtacggcctaccgtaagtcgtacggaccgtaaccgtcccggtccccttcccgtaccggtacccggttccgttccgggtcgggtccctacccggtagtacccgttacggacgtaacgtggaaccggttctaacgtttactttaacgttaccgtcggaccgtaacgtacctacgaactaacgtcgacgtaacgttacgtaaacgttaacggtttaaccggggttttacggggttcgggacggtaacgggtaccaggtaccgtacgtaaccgtacgtacaccggtacaccgtgacccgtcccgtacccgtcgtcctcgttccgtcccg

SEQ ID NO: 228250 - DNA, 620 bp, Homo sapiens
  misc_feature: GYAE6OF01C5G8G.14.85.H08.1.454.CMB.1.raw
  modified_base (192)..(192): a, c, t, g, unknown or other
  misc_feature (192)..(192): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
tcagcgtctagtaccacgaccggtgctcgatttagtatcactcagtcgcgggggggtctcaggaggcagcgctctcaggacgtcaccaccatggcctgggctctgctcctcctcagcctcctcactcagggcacaggtcctgggcccagtctgccctgactcagcctccctccgcgtccggtctcctggacngtcagtcaccatatcctgcactggaaccagcagtgacgttgncttatacttgtctctagtaccaacagccaccagcaacgccccaaatcatcgattatgacgtnaataacgcgtccgtacgggtcctgactcgtcttctctgtcctacaagtctcggactaacgaccggtccctccgtcgaccgtctccgtacggcctccgacggctacggtacgacgtaggacggcttaggtaatttacgtttaccgttaggactaacggtccttacggaactacgtacggtacctaggttacctaagttaaaccgttaggttttccggggtttaacggcggaacggtaccaaggtcctacgacccgttacgaagtccgtaacgaccccgaggtccgttacccgaccccgttggtaccctaccgttccgttaccccg

SEQ ID NO: 228251 - DNA, 1002 bp, Homo sapiens
  misc_feature: GYAE6OF01EE4D9.14.85.H08.1.454.CMB.1.raw
tcagcgtctagtaccacgaccggtgctcgatttagtatcactcagtcgcggggggtgctttctgagagtcatggacctcctgcacaagaacatgaaacacctgtggttcttcctcctcctggtggcagcctcccagagtcgggtcctgtcccaggtgcagctacaggcgaggtgggggcacgaggtacgttggttaggaacgtccggttaccgggaccgtaccccttcggtccccctcgtaccctcgccgtcttagtaccgaagtcgggtcgtccctcccctactaacttaacttcctaccgttacggtaggtacgtccggtacggtaacctccccgggaccccgaacccgggaacccccggggaagggggggtaacggggtccggttaagggggtaagggtagggttaacggggttaaagggggtaaaactacggtaaacggttaacggtaaacgggggtaggggaaccgtaaccgtaaaacccggtaaaacggtaacccccggtaaccccggttaccccggtagggaaacggtaccggttacccggaagtaacccctaaacctaacgttaaacgtaaacctaaaaccggtaaccgtaacccgtaaaccggttaaacccgtaaacggtaaacgtttacccggttaacctttacccggtacccgtttaacggggtacgtaccgtttaaccgtttcgttacgttacggaacggttaacccgacgggggacccccgtagggtaacccggttccggtagtttacggttaggtttacgtacgttgggtccgtaaggtacggtttctttaccgggttacggttacgtttacgggttccgttcccgtttacggttaaccggtaccgggttacgggggtcccgggtaaacccggggtaccggttaaccccggggttcgttacccggttaaccccggtttctttaacccgtacccgtacccgtaacccccggtaacccgttaacccggggaccccggtttaacccccggg

SEQ ID NO: 228252 - DNA, 671 bp, Homo sapiens
  misc_feature: GYAE6OF01ELJ3X.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcagggactgttgaagccttcggacgacccctgtccctcacctgcgctgtccaatggtcgccgtccctcactaatctctacgtggatcgtggactccgccacgccccgaggggaacgggcgtggagtggagttagggggaaatcggtagtacgaaaggtggacggacaacctaagtacccaacccgtcccgtagacggtacgtcgaacgtaccgaccatacgtaccaaagtaacgacctacgttaccaacgtactacctaacgttcccgtccgtaggacgtcctacgtacctttcgttgtacgaacgcggcccggacgggaaccgtaccggtcgttggttacgttaattcggtacgtgtacgtagtacgttcggtttaccgggtcgttcggtaccgtcttcgttacgtaccgtacgggtcgggacccggtacgggtaacccgttcgggtcctacccggttctaccgtccgtactccccgaccgtaaccgccggtaccccg

SEQ ID NO: 228253 - DNA, 668 bp, Homo sapiens
  misc_feature: GYAE6OF01A75JY.14.85.H08.1.454.CMB.1.raw
  modified_base (172)..(172): a, c, t, g, unknown or other
  misc_feature (172)..(172): n is a, c, g, or t
  modified_base (291)..(291): a, c, t, g, unknown or other
  misc_feature (291)..(291): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcncaggactgttgaagccttcggacgaccctgtccctcacctgcgctgtcaatggtcgccgtccctcactaagtctctacgtggagctggatcccgccacgccccgaggggacgggctggnggtggagttggggaaactcgagtacgaaaggtggagcacaagtaccaacccgtccctacgagacgtcgacgtccgaacctatactacaatacgactaccgttaccaagtaactccgacgtttcctcccgtaggtacggtcttcggtaacctttcgtagtacgacgacggtcccggacggaccgtaccggtcttacgggtacgttacgtttacgtggtcggtacgtaacgtacgtttccggtttaccggtcgttcggtaccctcgttacgttcggtaccgttacggtccgggggtaccgacgggtaacccgttcggtacccgtccgtaccttcgttaccgaccgtaccccgtacccgaaccggtacccgggtaccccg

SEQ ID NO: 228254 - DNA, 658 bp, Homo sapiens
  misc_feature: GYAE6OF01BIU9O.14.85.H08.1.454.CMB.1.raw
  modified_base (251)..(251): a, c, t, g, unknown or other
  misc_feature (251)..(251): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtcgcgtccctcactatctctactggancgtggactcccgccaccgaccccgaaggggaaggcgtaggaggtggtagtaggggaaatcgaagtacgaaaggtggacgacgaacaagtaccaacccgtccgtagacggacgtacgacgtacaccatactactaatacgactaacgttaccaagtactactacgttcctacccgtggacggtctacgtactttcgtgtacgactcggccggaccggactacggctttagtacgttattaccgttgaggtacgtacgtacgtttccggtttcggtcgttacggttacgtcgttacgttggtaaccggttcgggtaccggggaccgtaaccggggttacccttagggttaccccgtacgttcccttacgtcccgaccgtcccgtacccgtaccgtacccggggtacccc

SEQ ID NO: 228255 - DNA, 664 bp, Homo sapiens
  misc_feature: GYAE6OF01A69CK.14.85.H08.1.454.CMB.1.raw
  modified_base (161)..(161): a, c, t, g, unknown or other
  misc_feature (161)..(161): n is a, c, g, or t
  modified_base (172)..(172): a, c, t, g, unknown or other
  misc_feature (172)..(172): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (649)..(649): a, c, t, g, unknown or other
  misc_feature (649)..(649): n is a, c, g, or t
  modified_base (656)..(656): a, c, t, g, unknown or other
  misc_feature (656)..(656): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacngcagtggggcncaggactgttgaagccttcggagaccctgtcccctcacctgcgtctgtcaatggtnccgttccctnaactatctctacgtggagctggactcccgccacggccccgaggggacggggctgggagtggacgttggggaaactcaggtacaaggtggaaggccaacgaacgtacccgaaccccgttcccgtacggacggtacgttccgacgtccaacccgtaatataccgtaaatacgaacctaccgttacccaagtaacgtcctaacgtttcccgtccgttaggaacgggtcctacggtaccttttccgtagggttaccgaacgtacgggcccggaccggtacgtacggtcgtcgtagtttactacgtgtggacgtagtacgttcgtcgtacgtgtaccgtcttcgtcgtactccggtcggggacccgtaccgggtaaccgttcgtccgacccgtacttcccttcgccacccgtaccncccgggngtaccccg

SEQ ID NO: 228256 - DNA, 722 bp, Homo sapiens
  misc_feature: GYAE6OF01BNBI0.14.85.H08.1.454.CMB.1.raw
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatatcctgcactggaaccagcagtgtacgttggtgactttaattaactttgtctccgtaggtaaccaacgacgccaacccgaggaccaaacgcccccaaaactcatagtatttagtgtaaccgtacaaagtaacggccggtccccgttcggggtcccctagactccgcctcgtcgtcggcctacgaacgtccgtacggaccgtaacgaccggccctacccgtcgtaccgttcctcgtcgggcctcccgaggcctagacgtagtcggacgtcgtagtaactttacttacctaggctacgtctacaactagtacgactaggtaactaaagggtttaaacttttaacggggtttttacccggggggtttaacggaacggggtaaccgggtaaacccgtaacgggtccgttaacgggtaaccccggttaaccgttaacggtaccggtaacgggtaaccccgtaacggttcccgtaccccgttcccccggttaccggttccctaccgtttcccgttaaccccg

SEQ ID NO: 228257 - DNA, 682 bp, Homo sapiens
  misc_feature: GYAE6OF01BUABB.14.85.H08.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
tcagcgtctagtaccacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccctgacctcagcctgcctcgtgtctgggtctctgacagtcatcacntctctncacacgaaccngctagtgacgttggtagttataagtntcgtctctacggtaccaaacaccacccgaggaccaaacgaccccccaaactcatacgtatttacnggacggtactaagtaactccggcccttacggtagggttttactaactccgtactttctcgtggtccctacgtaacgttctcgggaactaaccggacccgtcccgtcccgtacgaaccctacttccgtcggttaccgggcccttacccggacggaccgttgggaacgggtaccggtagttccgttaggttaacttttaaacgtttgtaccggtactacgttcgtaactaagtttacgcgtacctaccgttcggacctaacggtctaactccggtagtttcgggttacggtttcgggggaccgggtacgtacgggtacgtacccgggtctacgggtaccacggacccgtaggtcccgtcccgccccggttacg

SEQ ID NO: 228258 - DNA, 1172 bp, Homo sapiens
  misc_feature: GYAE6OF01D5ZCK.14.85.H08.1.454.CMB.1.raw
tcagcgtctagtaccacgaccggtgctcgattttagtatcactcagtcggcgggggtgtctttctgagagtcatcggaccctcctgacaacaaacgaacatacgaaacctaccttggttcggtttcctttcccttcccttccgtggtcggacacgcctaccgagtacgttcgggttcctcggtacccgaggtcgacgacgtactacgacggtacggtacggggtcggggaccgacggtaacgggttacgtttacggttaacggaaccggttacccggttaccgggtaacccgttaccccgtttcccggttacccccttacccgtacccggtcggtccgttaccgttacggttaccgtaacggttccgggttaccgttaccccgtttaccccttaacgtaacctttaacctttaccgttaccggttaccggtacgggtaccggttaccggtaaccggttacccgtacccccggaaccccggacccccggggtaaacccgggggtaacgggggggtaacggggttaccgggtaagggggttaacggggttaacgggggttaacggggtttaaacggggttaaacgttaccggtaaacgggttaaacgggtaaacggggtaaccgggaacccggtaaacccgtaaaacccggttaaaccccggttaaacccccgttaaccccggttacccggtaacgggtaacccggtaaccgggttaacccggtaacccgttaaccctaaacgttaaacgttaaaccgtaaacgtaaacccggttaaaccgtaacccgttaacccggttaactaaaccgttaaaccgtttaccgttaaccgtttacccggtaccgttacggtaccgttacgtttaccggttaccgttacgtacggaaccgtaaccgggtccggtaacccgggaccggttaccgttacggttcgtttacgttacgtttacgttacggtcgtacgttaccggttactttaccggttccgggtttaccgtacggttaccggttcctttaccggttccggttaaccggtaccgggttaccccggggaaccgggtttaccccgggtaacccgggtttaccccgttacccgttacccgtacccgttttaccgtaacccggtccctaccccggtacccggtaaccccggacccgggttaaccccgttcccg

SEQ ID NO: 228259 - DNA, 777 bp, Homo sapiens
  misc_feature: GYAE6OF01DYZ8P.14.85.H08.1.454.CMB.1.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
tcagcgtctagtaccacgaccggtgctcgatttagtatcactcagtcgcgggggggtctcaggaggcagcgctctcaggacgtcaccaccatggcctgggctctgctcctcctcagcctcctcactcagggcacgagggtcctgggcccagtctgccctgactcagcctcctccgcgtccggtctcctggacngtcagtcaccatatcctgcacgtggaaccagcagtgacgttggtgctttataactttgtctctggtaccaacagccaccagacaacgaccccaacnctatgtattatgtacgtacaatacgccggtcccgtcggggtccctgactcgcttctctcggcctcgaagtctacggctaaaccgccggtccctcccgtacgtacccgtccgttcgtcgggtccgttacccgacggtaccgttacgggacgtacggttacgggtaacgggtcgttagttaacgtttttacgtttaacgttcggtacctacgtaccgttaccgtaaccgtaagttcggtacctaacggttaccgttaaacggtttaaaccggtttaaccgggttttttaccggggggtttttaccgggtaccgggggtaaaccgggtaaccccggtaaggttacccggttaaccggttaaccccggttacccgttaaacggttacccggtaaacccggttccccgggtaaaacccgggttccccggttaaccccggttccccccggttacccgggttaccccttcccgtttccccgttttaccccccggg

SEQ ID NO: 228260 - DNA, 818 bp, Homo sapiens
  misc_feature: GYAE6OF01E5QRN.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagcctcccagatgggtcctgtcccaggtgcagctacagcgaggtggggcgacgaggacttgttagaacgtccgttacggacgaccccttcgtccctcacctgcgctgtcaagtcggtcgccgtccctactaactaacttcctacgtacgtggagtcgtacggtacctcccggaccgaacccggacccccggaagggggaacgggggtccgtaggggacggtaggggtaaggttaacggggggaaaacttacgtaacggtaaccgaaaaggttgggaaccgggtaccctaaaccgtaaaaccgttaaccccgtaaacccccggtcccgtaccggaaggtacggtaccggtaacggtaccaaaccgtaacgttaactaacgtaaaacgtaacgtaaccgtaaccgtttaaccgaacgtaactctacgttcctccgtaggacgtcgttacgtacgtttcgacgtcgaaccgtcggaccccggtacgggacgtaccggttcgtaggttacgtttacttacggtgtacgtacgacggttcgtttaccgtttccgggtcgttacggtacgttccgttacgttacggtaccgttaccggtacggggtacccgtaaaccgggtacccggttccggtcccctaccggttcccttaccgtcctaccggtacccctacccggtaaccccggtacggtacccccg

SEQ ID NO: 228261 - DNA, 851 bp, Homo sapiens
  misc_feature: GYAE6OF01AF9PN.14.85.H08.1.454.CMB.1.raw
tcagcgtctagtaccacgaccggtgctcgatttagtatcactcagtcgcgggggtgctttctgagagtcatggacctcctgcacaacgaacatgaaacacctgtggttcttcctccttcctggtcggcacgctcccagatcgggtcctgttcccgaggtgcgtagcctaacgacgcgaggtcgggggacgccgacgggtactcggttacgaacgtcccgtttacgggacgtaccccttcggtccctactacccgtcgaccgtctacgtacctaaggttcggtaccgccggtaccctcctacttaacttccgttacctaccgtggacgtcgtacggtcctccccgaccgaccgaccccggaggggtaccggggtacgtacgggtacggtacggtaacgggttacgggggaaacgttccggtaacggttaaccggaaagggtacgggaacgaccggtaaaccgtaaccgtacccgtaaaccccgttaccgtacggtacggtaaccggttaccggaacgtacctaccgtaacgttaaccacggttaaacgtaccgtaaccgtaacggttacccaaagtaacgttccgttaaccgttcccgttacctacgggtactaccggttacgttaccttacggttacgtacgacctagggtccccgagtaccgtaccgtagttcggttacttaacgttcggagttaccggacgtacgttacttccggtttacgcgttacgttacgggttcaacggttcgtacggttacgggtaccggaaccggttccgtaacgggttaccgttcccgtcgttacccggttcaccgggttcccacccgttcccggcgtaacccgggttcccg

SEQ ID NO: 228262 - DNA, 872 bp, Homo sapiens
  misc_feature: GYAE6OF01DKFZM.14.85.H08.1.454.CMB.1.raw
  modified_base (664)..(664): a, c, t, g, unknown or other
  misc_feature (664)..(664): n is a, c, g, or t
tcagcgtctagtaccacgaccggtgctcgatttagtatcactcagtcggcggggggggtctcaggaggcagcgctctcaggacgtcaccaccatggcctgggctctgctcctcctcagcctcctcactcgagggcacgagggtcctgggcccaggtcctcgccctgactcacgccctcccgtccgccggtccgggtctccgtggactagtcagtccacatactcctgccacgtacggaaccagcgtagtggtacggttggtcgtactttaattacgtttcgttccttccgtacggtaaccaaacgacgacccgacccgaaggaacccaaaccccgaccccctaaaactacctaagttacgttaacttttagcgtaaccgttacgtaaaacgtaccgggacccgggtccccgggttacccgggggttaccctagtaccgttccggtccttccgttacgtcggtcctaaccggtaacgtccggtacggtaacccgaacccggtacccggtacccccttcccggtaccggttacccgttccgttccggttccgggtacccgtacccggtaacgggtccctaacgggtaccgggtacgtgggttaccggtacgtttaaacgttacttttaacgttccacgggtaccacgtaacccgttacacgttacncgtaaccgtagttaaaccgtaacgtttaaaccggggtttacgggttttcccgggggttaacggacccggggtacggtaaacccggtacggttaccgggttacccgtacccggtttaacgtaacccggtacggaaacccggtcccgaacgggttccccgtacccgggtacccggttaccgttaccctcccggtttccgttcccccccgg

SEQ ID NO: 228263 - DNA, 727 bp, Homo sapiens
  misc_feature: GYAE6OF01A9C5T.14.85.H08.1.454.CMB.1.raw
  modified_base (261)..(261): a, c, t, g, unknown or other
  misc_feature (261)..(261): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcaggtggggcgcaggactgttgaagtcccttcggacgaccctgtccctcacctgcgctgtcaagtggtcgccgtccctcactaatcctctacgtggacncgtggactcccgccaccgccccgaggggagggctggagtggagttggggaaatcgagtacgaaaggtgggacgaccaaccgtaaacgtacccgaacccccgtcccgtacggaacgtacggtacggaacgtaccaaaccctagttaacctactaaacgttaacgaaccgtaaccgtttaccgaaacgtaaacttcccgtaaacggttttccctaccccgttaggacggttaccgttacggtacctttcgttaggtacgaacgtacggcccggacggacgtaccgggtcttggttacgttatttaccggtggtacgcggtaattacgttccgttcggcgttaggttcctacgttccgttgtaccgttacgggtaccggggacccgtaaccgggtacccgtcgggtaccctacccggttcttcccgtacctacccggtacccctcccgaacccggtaccggtacccccg

SEQ ID NO: 228264 - DNA, 734 bp, Homo sapiens
  misc_feature: GYAE6OF01DE5W6.14.85.H08.1.454.CMB.1.raw
  modified_base (174)..(174): a, c, t, g, unknown or other
  misc_feature (174)..(174): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctccgagatcgggtcctgtcccaggtgcagctacagcgaggtgggcncgaggtactggttagaacgtccgttacggactacccgtcgtaccctcaccgtgccgtactgtactaagtcggtcgtcccgttccctactaacttaactcctacttacggtaggacgtcgtacggaccgtcccgacccgacccggacccccgggaaagggggaacggggtaccgtagggtacggttacgggttaagggttaaggggtaaactacggaacggtaacgaaaggtggacgaccacaaacgtacccgacccgtccgagaggcgtacggactaccgacaatacgactaaatacgacctacgtctaagtactcgttacgtcctccgaaggcgtacttgtaccgttcgtacggtcgaacgcggtacccggacgtacgtcggtcgttacggttacgtttactaggtcgtaggtacgtacgttaccgtttccgtaacggtcgttagtccgttacttcgtaccgtacggtccggttacggggaccgtaaccgggtacccgttcggtccctccgttactccgtaaccgcctacccgtaacccggaccggtccggtaaccccg

SEQ ID NO: 228265 - DNA, 802 bp, Homo sapiens
  misc_feature: GYAE6OF01AEIBA.14.85.H08.1.454.CMB.1.raw
  modified_base (258)..(258): a, c, t, g, unknown or other
  misc_feature (258)..(258): n is a, c, g, or t
  modified_base (328)..(328): a, c, t, g, unknown or other
  misc_feature (328)..(328): n is a, c, g, or t
  modified_base (447)..(447): a, c, t, g, unknown or other
  misc_feature (447)..(447): n is a, c, g, or t
tcagcgtctagtaccacgaccggtgctcgatttagtatcactcagtcgcggggtggctttctgagagtcatggactcctgcacaagaacatgaaacacctgtggtcttcctcctcctggtcgcagctcccagatgggtcctcggtcccaggtgcagctacgagcaggtggggacgcgacggtacgttaggtttaggaacgtccgttaccgggagtaccccgtcgtccctccaccgtgcgtaccgtgtcgaacgttggngtcccgtacccttcgacctaagttcctacgtccgtggatcgtcggactccgccgaccgccccgaaggggngggacgtggtacggaagggtcggtaaggggtacgtcgtagacgttaaagggcggacggaccacggaaccgtccgaacccgtcgacgacggagtcgacgacgaaccagtaccacgtaaanacgtaccgtaacgaccgaacgtacgtaagtttcccgtcctaccggtaccgtaacgtcgttacgtaacgttaccgtacgttccggagacccggttaccggaccggttaacccggaaccggtcgttacggtaccgtttaagtttccggttaacggttacaccgggttacttaccggtttaccgtttccgggttaacccggttagggtccccgggttactcgggtttacccggtaacggttccccggtaagggggttaaccccggacccggggtttaaccggtacccggttcctaacccgggttcccttcggtaccgttaccgtacccggtacccccgagggtaccccggtaaccccg

SEQ ID NO: 228266 - DNA, 797 bp, Homo sapiens
  misc_feature: GYAE6OF01BA90C.14.85.H08.1.454.CMB.1.raw
tcagcgtctagtaccacgaccggtgctcgatttagtatcactcagtcgcggggggtgctttctgagagtcatggacctcctgcacaagaacatgaaacacctgtggttcttcctcctcctggtggcagctccagatgggtcctgtcccaggtgcagctacagcgaggtggggcgcgaggactgttgaacgtccgttcggacgaccctcgtccctcgacctgcgtctgtacaagtggtcgccgtccctctaactaactctactacgtggactcgtggactcccgccgaccggacccccggaagggggaacgggcgtacgggtaggtgggtaaggttacgggggaaattccgaaggtacgaaaagggtcgggaacggaccgaaccgtaaacggtacccgtaaaccccggttcccgtacggtaacggtacggtaccgtaacgtaccaaaccgtacgtaactacgaaagttaacggaacctaccgttaccgaacgtaacgtacgttaacgttcccgttaccgacgtacggtacttacggttaaccgtttcgtacggtacgaaccgtacggaccccggacgggtaaccgtaccgggtcgtttaggttacgttaaccgtttacggtcggtcggtaggttaacggttacgtttccggttaccgggtacgtttaccggtaccgtccgtttcggtaccggtaccgttaccgggcccgggtaccggtaccgggttaccccgtcggtcccttacccggttcttccgtacccgcgtaccccgtcccgaacccgggtacccggtaccccg

SEQ ID NO: 228267 - DNA, 952 bp, Homo sapiens
  misc_feature: GYAE6OF01BJ419.14.85.H08.1.454.CMB.1.raw
tcagcgtctagtaccacgaccggtgctcgatttagtatcactcagtcgcgggggtgctttctgagagtcatggacctcctgcacaagaacatagaaacacctgtggttcttcctcctcctggtggcagctccagatgggtcctgtcccaggtgcagctacagcgaggtggggcgcgaagggtactggttagaaacggtcccgttacgggacgtacccttcgtccctcaccgtgcgtctgtacaagtcggtgccgtccctactaactaatcctacgtacgtggagtcgtaggactcccggaccaaccggtacccccggaagggggacggggtaccgtaggggtaaggttacggggtaaggttaacgggggaaaacgttacggaaacgggttaaccggtaaaaggggtacggggaaccgggaaccaaaacccggtaaaaccggtaaaccccgtaaaccccggttacccggtacggaacggtacggtaccggaacgtaccaacgtaataacctacgtaaaagtaacggtaacctaacgtttaccgaaagtaactaccgttaacgtttacccgtacccgtaggtaacggttacttacggttacctttacggtacggttacgaacccggtaccggtacccggtaacccgggtaacgtaacccgggttacgttacgggttaacgtttaaacgttacgttaggggtacggtaacggtaacggttaccggtttaccgggttttccgggtaaccgggtttacgggttacccgggttaccgttttacggttaacggttaacccggttaaccggggtacccggggggtacccgggtaaacccggggttaaccccggtttcccgggttaacccgtttaaccccggtttaccgttcccgttttaacccggacgtttaccccccccgtaaaccggaaaccccgggttaaccccgggttacccccgg

SEQ ID NO: 228268 - DNA, 815 bp, Homo sapiens
  misc_feature: GYAE6OF01CDHNP.14.85.H08.1.454.CMB.1.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
  modified_base (624)..(624): a, c, t, g, unknown or other
  misc_feature (624)..(624): n is a, c, g, or t
tcagcgtctagtaccacgaccggtgctcgatttagtatcactcagtcggcgggggggtctcaggaggcagcgctctcaggacgtcaccaccatggcctgggctctgctcctcctcagcctcctcactcgagggcaaccgaggggttccctcggggacccaggtccttgccccgttaggacttaccaggtcccccttcccccgttccgggacccggttcccggggttcctaccgtgggacctaggttccacgtccacctatccgttcctggacctacgtacgaaccngcagttcggtacgttggtntacttataaccttttgcttccgtacggtaaccacaccgaccacgacggacaaaaccgccccctaactacacgttntttacttagtacggactaagtaacgtacggcccggtcccggttaccggggtccctaggtactccggtaccttcgtccgtacggtctaaccgtctaccggtacgaacccgtaaccggtacccgtccccttaccggtcccgtacgtccgttccgggttacgcccgtaaccgtcggtaccgtacgaccggtagttacgggaccgttagttaacgtaaacgttttccgtacggtaccgtacggtaacnccttacaacgttctacggtactaacggttaccgtaacgttttaaccgggtttaggggtttttacccggggaggccgggggtaaacgttcccggacggtccggtaccggtaccgttaccggtaacgacgtcccggtacggcccgttacccgggtcccttcccgggtcggacccttccgtcccgtttaccccg

SEQ ID NO: 228269 - DNA, 703 bp, Homo sapiens
  misc_feature: GYAE6OF01DZ5IR.14.85.H08.1.454.CMB.1.raw
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
  modified_base (507)..(507): a, c, t, g, unknown or other
  misc_feature (507)..(507): n is a, c, g, or t
tcagcgtctagtaccacgaccggtgctcgatttagtatcactcagtcgcggggggggtctcaggaggcagcgctctcaggacgtcaccaccatggcctggctctgctcctcctcagcctcctcactcgagggcacgaggtcctcgggcccagtctcgccctgactcacgcctccctccgcgtccgggtctcctggacagtcagtcaccatactcctgccacgtacggaaccagctagtcgtacggttggtcgtactttattaactttgttcctccgttacggtaaccaaactacgaccaacccgaaggaaccaaaccgtacccccaaactccgtaattgtatttagtcgaacgtacaaagtaacggcccgggtcccgtaccgggggtcctagacgtccgtcttcctcgtcgtcctaccgtaagtcgtaggacgaacgaccggtccctaccgtcgaccgttcgtcgtcgctacgngcgtgatagtacgngtatagttattacgttacncgctacgtacctagtacacgcgaactacggttaacctaagttaaccgtttaacgggttttcggggttacgggacggaacgggtaactacggtacgtaccggtaccggtaaccgtaaggttaccgtaacccggaccggtaaccgtcccgttccccggtaccccggttacgtaccccgtacgttcccgttacccccgg

SEQ ID NO: 228270 - DNA, 849 bp, Homo sapiens
  misc_feature: GYAE6OF01C74FZ.14.85.H08.1.454.CMB.1.raw
  modified_base (162)..(162): a, c, t, g, unknown or other
  misc_feature (162)..(162): n is a, c, g, or t
  modified_base (825)..(825): a, c, t, g, unknown or other
  misc_feature (825)..(825): n is a, c, g, or t
  modified_base (836)..(836): a, c, t, g, unknown or other
  misc_feature (836)..(836): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctccagagtgggtcctcgtcccaggtgcagctacngcgaggtggggcgcgaggacttggttagaacgtccgttcggacgtacccgtcgtccctcacctcggctcgtgtctaagtggtcgccgtccctactaactaactccgtactacgtggacgcgtaggacctcccgacccgacccggcccccgggaaggggacgggggtacgtcgggtagggtacgggtaagggtttaacggggggtaaacttacggtaacgggtaaaccggaaaaggggttaccgggaaccggaacccgtaaacccggtaaaaccggtaacccccgtaaaccccggttccccggtaaccgggaaacgggtacggttaaccggtaacgttacccgtaaccttaacgtaacttaacgtaaaacgttaaccgaaccgttaacccgtaccgtaaacgtaacgtacttacgttccgttacccgttaggtaccgtccgttcgttaactttcgtacggtacgaaccgtaccgggtcccgggaacgggtaccgtaccggttcgttaacggtttcgtttaaccggtttaccgttgggttaacggaccggtaacgtttaccgtttccgggtttacgtcgggttacgttcccgttcgtttaccgttacgtaccgtacgggcgaccgggtacccggtacgtcgtacccgtccgtctccgttcgaccncccgtaacccncggtaccgtcccg

SEQ ID NO: 228271 - DNA, 677 bp, Homo sapiens
  misc_feature: GYAE6OF01ASCUX.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagtcccttcggacgaccctcgtccctcacctgcgctgtcaatggtgccgtccctcactaatctctacgtggagctggactcccgccacgcccccgaggggacgggcgtgggaggtggagtagggggaaatcgaagtacgaaaggtggacggaccgaaccaagtacccaaccccgtccctacggagacgtacgacgtaccaaccatactacaatacgaccgtacgttaccaagtaactaccgtaacgttcctacccgttgacggtctgtaccttcgtacgtcgacgtaccggcccggaccggaacgtaccggtcttacggttgttaacttaccgtggttacggccgtaagttacgtttccggtttacggtcgttcggtaccgtcttcgttaggtacccgtgggtacccgggaccgtaaccgggtaccccgttggtcccgtacccgttccgttaccgtacgaccgttacccgtacccaaccggacccggtccccg

SEQ ID NO: 228272 - DNA, 842 bp, Homo sapiens
  misc_feature: GYAE6OF01C1MHP.14.85.H08.1.454.CMB.1.raw
  modified_base (136)..(136): a, c, t, g, unknown or other
  misc_feature (136)..(136): n is a, c, g, or t
  modified_base (195)..(195): a, c, t, g, unknown or other
  misc_feature (195)..(195): n is a, c, g, or t
tcagcgtctagtaccacgaccggtgctcgatttagtatcactcagtcggcggggggggtctcaggaggcagcgctctcaggacgtcaccacatggcctggctctgctcctcctcagcctcctcactcgaggcacgngggtcctgggcccagtctgccctgactcacgcctccctcgcggtccggtctcgtggacngtcagtcaccatctcctgcacgtacggaaccagcgtagtcgtacggtttggtactacgtttacttacgtttcgtccgttacccgtacggtaaccaaacgtaccggacccaacccgtaacggaaccctaaaaaccccggtacccccccgtaaaattaccgtaacgttaacggttttaacgtttttaaccggtaccgggtaaaccgtttaaaccgtaaaacgggttaaccccggggtccccggggtttaccccccggggttttaccgggggttccccttaaagggttcccgtccccgggttttacctttccggttaccggttcgtaccccgtttaaccgtaaagggtccgttacgggaaacccacccgggtacccggttcccccttaccggtacgaccccgtttcggtaccggtccgggttaccgaccgtacgggtctaaccgggtacgacgggttacggtaccgtagttacggtttaactttacggtcgtaccgtacaccgtacgtcgtaccgagttcggcttaaccgtacgtaaacggtttaacgtttcggggtttacggtcggacggtacgtacgtagccgttcgacgttcgacgtacgccgaccggttagcccgtaccgacccgttgtactccgttccgtacccg

SEQ ID NO: 228273 - DNA, 810 bp, Homo sapiens
  misc_feature: GYAE6OF01BK76P.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcaggtgggggctcaggacttgttgaacgtcccgttcggacgacccctgtacccctcacctgccgtctgtacaagtggtcgccgtccctacactaactctctacgtggacgtctggactcccgccgaccggacccccggaagggggaacggggtcgtaggggtacggtaggtaggttaacgggggaaacttcggaacgtaacggaaaacggtcgggacggtaccaaccgtaaccgtacccgtaacccgtcccgaggacgtagtaccgacgtccaaccgatactacgtaaagtaacgaccgtaccgttacgaacgtaacgtaccgtaccgtttcccgtaccgtaggacggtcccgttacgtacgtttcgttacgacggtaaccggacggccccgacgggacgtccggtccgttgtaacgtttaccttcggtggtacggtacggtacgttacgttcccgtttaacgggccgtttacggtaaccggttccttaccggtttacggaacccgggtttaccggggtaccggggaccccggtttaaacggggtaccccgttaccgggttaacccgttcccccgggtttaactccccggtttaccgaacccccggtcccgttaaacccccgtccgggtaaaccccggttcccccggg

SEQ ID NO: 228274 - DNA, 900 bp, Homo sapiens
  misc_feature: GYAE6OF01B0YQ5.14.85.H08.1.454.CMB.1.raw
  modified_base (307)..(307): a, c, t, g, unknown or other
  misc_feature (307)..(307): n is a, c, g, or t
tcagcgtctagtaccacgaccggtgctcgatttagtatcactcagtcgcgggggtgctttctgagagtcatggacctcctgcacaagaacatgaaacacctgtggttccttcctcctcctggtggcagcctcccagatgggtcctgtcccaggtgcagtctacgagcgtaggtggggcacgaggtacgttggttacggtaagtcccgttacggaccgtaccccgttccggttcccctaccgtaccctgacgtccgtagtacgtaacgttggtcgcccgttccctactactaacttccgtacgtacgngacgtcgttacggacctcccgacccgaccggtaccccggaagggggacgggtaccgtgggacgggttaggtaagggtttacggggaaacgttcggtaacggtaacggtaaacggtaggggaaccgtaactaaacccggtaacccgttaacccgtaaaccccggttcccgtaacggaaggtacccggtacgtaccgtaccgaaccgtaattaacgtacctaaagttaaccggaacccttaaccgtaacgtaagttaacgttacccgttaccgtttacccgtaccggttacggtacgttaccttacgttacgttttaccggtaaccgtagggtacccaccgggacccgaacggttccgggtacccggttacttacggtttagtttacggtacttcgggaacggttcgttaacgttaccggtttccgttcggtaccgggtttacggtaacccgttcgtttaccgtaccgggttaaccgggttccggtaaccgggggtaccccgtaaccggggttacccttcccgggtaccgttacccgttccgttcccgttacccgcggtaccccccttaacccggacgggttacccccgtaccgg

SEQ ID NO: 228275 - DNA, 971 bp, Homo sapiens
  misc_feature: GYAE6OF01BD5U6.14.85.H08.1.454.CMB.1.raw
  modified_base (162)..(162): a, c, t, g, unknown or other
  misc_feature (162)..(162): n is a, c, g, or t
tcagcgtctagtaccacgaccggtgctcgatttagtatcactcagtcgcgggggtgctttctgagagtcatcggacctctgcaacaagaacatgaaacacctgtggttcttcctcctcctggtggcagctaccagatcgggtcctgccctaggtgcagctangacaggtgggcacgaggatgttagaacgtccgttacggacacccgttcgtccctcgaacctggccgtacgttacggtaccgtaaggtttcggggtaccgtacccgtttcccctaactaaaccgttaacgtttacccgtttaccggttaaacggttacggggtaaaccggttccgttaacgggtaaccgttacccccgggaaccggtaaccccgggaacccccggggtaaaaggggggtaaccggggggtacgttaacgggggtaaacggttacgggggtaaccgggtttaaagggggggtaaaactaccgggttaaacggttaaccgtaaaacggggtacgggtaaccgggtaacctaaaccgttaaaccgggtaacccgtaaccccgggttccgaaacgggtaacgtacggtaaccgtaacgtaccaaccgtaattaacgtaacgtaaacgtaacgaacctaacggttaacgaagttaactacgtaccgtttcgtaccgaacggtacgtaccgttaacgttccgttacgtacgggtaactaccggaacgtacccgggacgtaacgtacccgggtatttaaccgggtattacggttaacgtgggtacgaacgggtttacgttacggtttccggttaaccgggtacgtttaacgggaccgtttacttacgggttacgtaaccggtaccgggtaacccggggtacggtaaaccgggtaacccggttcccgtttaaccgggacccgttttacgttacccggttaactaccccggtaaacccgtcccgtaaacccgggtccggttaaccccgg

SEQ ID NO: 228276 - DNA, 714 bp, Homo sapiens
  misc_feature: GYAE6OF01ASMJK.14.85.H08.1.454.CMB.1.raw
  modified_base (226)..(226): a, c, t, g, unknown or other
  misc_feature (226)..(226): n is a, c, g, or t
  modified_base (526)..(526): a, c, t, g, unknown or other
  misc_feature (526)..(526): n is a, c, g, or t
tcagcgtctagtaccacgaccggtgctcgatttagtatcactcagtcggcgggggggtctcaggaggcagcgtctctcaggaccgtcaccaccatggcctggctctgctcctcctcagcctctcactcaggcacaggtcctggcccagtctgccctgactcagcctccctcgcgtccgggtctccgtggacagtcagtccacctatactcctgccacgtggaaccngcagtgacgtttggtaggtatagtatcgtctcctggtaccaacaacacccaggcaaacgcccccaaatccatcgtatttagcgaggtacaagtaactccggccctacgtacggggtttcaacgtccggtctttactcgtcgtcctacctaagtctacggaccaaccaccggtccctcccgtacgccctaagttccgtcgtaccggtccacccgtggtcgtacggacggaccggtgttacgtgttaacgtttagttacgttcgacgtactccgacctttacgacgttccgacacccggtanccgtaacgactaaacgtccgtaagttcgggtttaccggggttcggggtacccggggtaacgtaacccggggttaccggtacccggttacccggttacgggttacccgaccgggttaccccgtaaccgggttacccgttaccccgggaccccccgtttacggttaaccccgtcccgttttacccccggg

SEQ ID NO: 228277 - DNA, 783 bp, Homo sapiens
  misc_feature: GYAE6OF01CRTHC.14.85.H08.1.454.CMB.1.raw
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
  modified_base (501)..(501): a, c, t, g, unknown or other
  misc_feature (501)..(501): n is a, c, g, or t
tcagcgtctagtaccacgaccggtgctcgatttagtatcactcagtcggcgggggggggtctcaggaggcagcgctctcaggacgtcaccacatggcctgggctctgctcctcctcagcctcctcactcgagggcacgagggtcctcgggccctagtctcgccctgacctcacgccctcccgtccgccggtccggtctccgtggactagtcagtcaccagtactccngaccacgtacgaaccagcctaggtcgtacgttggngtcttaattacgttcgtcctccgtacgtaaccaacacgaccgaacccaacggaaccaaaccgacccccaaacgtactacgtagtactttacgtataaccggtanaacgtacggcccgggtacccggtccggggtacccngtacgtccgtccttacgtcgtcggtacctacttacggtcgacgtaactacccgccgtacccgtccgtcggtaaccccgtctaccggtcggtctacccggngtacgtcggacgtacgaggttacgtagtacttagttactcgtcgactccgtctaacgactcgtaacgtcggtaactacgttaaacggtttaaccggtttaacgggttttccgggggttaacggggacccggttaaaccgggaaccgttaccggtaacccgttccggggttaaacccctaccggggttaaccggtacccgtaaacccgggaccggttaccggtaaccccgttcccgggtaacccccgttgggttaccccttacccgttccccgggttaccccg

SEQ ID NO: 228278 - DNA, 508 bp, Homo sapiens
  misc_feature: GYAE6OF02FJT3H.14.85.H08.1.454.CMB.1.raw
tcagcgtctagtaccacgaccggtgctcgatttagtatcactcagtcgcgggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctcctgaccgtctctgggctccaggctgacgatgaggctgattattactgcagctcacatgcagtcagtaacaatttcggggtttcgcggaggaccaagctgaccgtctaagtcagcccaaggctcgccccctggtccactctcg

SEQ ID NO: 228279 - DNA, 823 bp, Homo sapiens
  misc_feature: GYAE6OF02ICAUV.14.85.H08.1.454.CMB.1.raw
tcagcgtctagtaccacgaccggtgctcgatttagtatcactcagtcgcgggggggggtctcagggaggcagcgctctcgaggacgtcaccaccatcggccgtgggctctgctcctcctcagcctcctcactcgagggcacgacgggtccgtcgggcccagtctcgccctgactcagccctccctccgcggtccgggtctccgtggacagtcagtccaccatactcctgcacgtacggaaccagcagtcggtacggtttggtcgtactttaattaacgttttcgttccttccgttcgggttaacccaaacacggaccaacccgacgggaccaaaaccgaccccccaaaactcctaaattttaacttttaagtaggtaacgggttacaaattaaacgtcccgggcccttacgaagggttacgttttacttaaacgtccgtctttcctcgtcggtccttaccgtaaacgttcgtacggacctaaaccgacccgggtccccttccccgtaggacggacctaactttccgttcggtcggggtcccttacccggacgggtcgtacgggaacggggaaccggacggggtccgttaggtaacttttaacgtttaaccgttcgaccgacggtccttacaaactttaactttaacttaagtttacgacgtaaacgtaacgtttgggttttcgggttttaccgggacggggtaacggggtaaccgtaagggtaccggtaacccggttaccggttacggtaccgaaccggtacccgaacgggtccgtacccggtcccccggttcgggtacccttacccgttccgtttaccccgg

SEQ ID NO: 228280 - DNA, 529 bp, Homo sapiens
  misc_feature: GYAE6OF02GN5J5.14.85.H08.1.454.CMB.1.raw
  modified_base (458)..(458): a, c, t, g, unknown or other
  misc_feature (458)..(458): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaagggctggagtggattggggaaatcagtcaaagtggaggcaccaagtacaacccgtccctcgagagtcgagtcaccatatcaatagacacgttccagaatcagttctccctgaggctgacttctgtgacagcccgcggacacggctgtgttattactgtgcgagtatcgtttcggcttggtacncttcttgacttcgtgggccgagggaaccctgggtccaccgttctcttcacgtccctaccaccgaggtcccc

SEQ ID NO: 228281 - DNA, 547 bp, Homo sapiens
  misc_feature: GYAE6OF02GDVJH.14.85.H08.1.454.CMB.1.raw
  modified_base (301)..(301): a, c, t, g, unknown or other
  misc_feature (301)..(301): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttangacgtcaataagcggccctcggggtccctgactcgcttctctggctccaagtctggcaacacggcctccctgacccgtctctcgggctccaggctgacgatgaggctggattattacngcagcttcacatncagtcaacgttaactaagttttcggggtttacggaggtaggtaccaagtctaggacccgtctaaggtcctaacgccccgaaggcctcgcccccgtggtcctaccgtccttcccgg

SEQ ID NO: 228282 - DNA, 502 bp, Homo sapiens
  misc_feature: GYAE6OF02GR07C.14.85.H08.1.454.CMB.1.raw
  modified_base (299)..(299): a, c, t, g, unknown or other
  misc_feature (299)..(299): n is a, c, g, or t
  modified_base (452)..(452): a, c, t, g, unknown or other
  misc_feature (452)..(452): n is a, c, g, or t
  modified_base (497)..(497): a, c, t, g, unknown or other
  misc_feature (497)..(497): n is a, c, g, or t
tcagcgtctagtaccacgaccggtgctcgatttagtatcactcagtcgcagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcaccaggcaaagccccaaactcatgatttangacgtcaataagcggcctcggggtccctgatcgcttctctggctcaagtctggcaacacgcctccctgaccgtctcgtgggctccgaggctgacgatgagctgattattactgcagctcacatgcagtcaagtaactagtttcggggtttcgnggacggacagctgaccgtcctaagtcagccagctcgcccctgtcnctccg

SEQ ID NO: 228283 - DNA, 522 bp, Homo sapiens
  misc_feature: GYAE6OF02H1EJ9.14.85.H08.1.454.CMB.1.raw
  modified_base (234)..(234): a, c, t, g, unknown or other
  misc_feature (234)..(234): n is a, c, g, or t
  modified_base (427)..(427): a, c, t, g, unknown or other
  misc_feature (427)..(427): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctnactaatctctactggagctggatccgccacgcccccagggaaggggctggagtggattggggaaatcagtcaaagtggagcacaagtacaacccgtcctcgagagtcgagtcaccatatcaatagacacgttccagaatcagttctcctgaggctgacttctgtgacagccgcggacacggctgtgtattacngtgcgagtatcgtttcggcttggtacgctcttgactacgtgggccaagggaccctggtccaccgtctcttccagtccctccgacccaagggcccc

SEQ ID NO: 228284 - DNA, 544 bp, Homo sapiens
  misc_feature: GYAE6OF02JSYHJ.14.85.H08.1.454.CMB.1.raw
  modified_base (478)..(478): a, c, t, g, unknown or other
  misc_feature (478)..(478): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtcctcactaatctctactggagctggatccaccacgcccccgagggaacggggctgggagtggagttggggaatcgagtcaagtggaggcacagtacaaccgtcctgagagtcgagtcaccgatactcaatacgacacgttccagaactcagttcctcctagacggtctagtacttctgtagacacgtccgcgacgacggctgtgtattactgtgcgagtcgtcgttcggctggtacgcttagtcgtacncgtcgggcctacgggtaacctggtcctacggtcttccttcgaccgtccgtccaccgtacggtcccg

SEQ ID NO: 228285 - DNA, 767 bp, Homo sapiens
  misc_feature: GYAE6OF02IHPNL.14.85.H08.1.454.CMB.1.raw
tcagcgtctagtaccacgaccggtgctcgatttagtatcactcagtcgcgggggtgctttctgagagtcatggacctcctgcacaagaacatagaaacacctgtggttcttcctcctcctggtggcagcctcccgagagtcgggtcctcgtcccgaggtgcagctacagcaggtggggcgcgaggacttgttagaacgtccgttcggacgtacccgtcgtccctcaccgtgccgtctgtactaagtgggtcgccgttccctcaacgttaactcctacctacgtggacgcgtggactcccgccgaccgacccccggaggggtaacggggccgtagggaggtaggtaggtacggggaaatcgaagtacgaaggtggacggaccaaccgaagtaaccgaaccccgttcccgacggaggacgtcggaacgtcccaacgtacgtaactaccgaaagtaacgaccgtaccgttaccgaacgtaactacgtacgtttccgtacccgtaggacggtactacgtaccttcgtgtacgacgacggcccgacggtaccgaacggtccgttagggttacttaacgttacgtcggttcgacgtacggttacttcccgttttcgggaccgttttacgggaacgttccgttaccgttcgtaaccgttaccgggtacggggtcccggaaaccggggttaacccgttcggttacccggtacccggttccgttcccgtttaccggaccttaccccggtcccgtaacccgggaccgggtacccccg

SEQ ID NO: 228286 - DNA, 527 bp, Homo sapiens
  misc_feature: GYAE6OF02FR792.14.85.H08.1.454.CMB.1.raw
  modified_base (420)..(420): a, c, t, g, unknown or other
  misc_feature (420)..(420): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagccccccaaactcatgatttatgacgtcaataagcggccctcggggtccctgatcgcttctctggctccaagtctggcaacacggcctccctgacccgtctctgggcctccgaggctgacgatgaggctgattattacngcagctcacatgcagtcaagtaactagttttccggggtttcgcggtagggaccagctcgaccgtctaagtcacgcccaaggcctcggcccccgtggtccactctccg

SEQ ID NO: 228287 - DNA, 532 bp, Homo sapiens
  misc_feature: GYAE6OF02FUD6R.14.85.H08.1.454.CMB.1.raw
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggcccgtcgggggtccctgatcgcttctctggctcagtctggcaacacggcctccctgaccgtctctgggcctccgaggctgacgatgagctgattattactgcagcctcacatgacagtcaagttaacgtaagttttcggggtttacgcggtaaggaccagctacgaccgtctaagtcgacgccgaaggcctccgccccgtggtcctactctcccg

SEQ ID NO: 228288 - DNA, 531 bp, Homo sapiens
  misc_feature: GYAE6OF02IX9Q5.14.85.H08.1.454.CMB.1.raw
  modified_base (172)..(172): a, c, t, g, unknown or other
  misc_feature (172)..(172): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctnacctgcgctgtcaatggtgcgtccctnactaatctctactggagctggatccgccagcccccagggaaggggctgggagtggattgggggaaatcagtcaaaggtggaggcacaagtaccaacccgtcctcgagagtcgagtcaccatatcaatagacacgttcagaatcagttctccctgacggctgacttctgtgacagcccgcgacacggctgtgtattcgtgtgcgagattcgtttcggcttggtacgcttcgttgactacgtggggacctaggggaaccctggtccaccgttctcttcacgcctccgaccgacggtccc

SEQ ID NO: 228289 - DNA, 647 bp, Homo sapiens
  misc_feature: GYAE6OF02H0INU.14.85.H08.1.454.CMB.1.raw
  modified_base (240)..(240): a, c, t, g, unknown or other
  misc_feature (240)..(240): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
tcagcgtctagtaccacgaccggtgctcgatttagtatcactcagtcggcgggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatactcctgcactggaaccagcagtgacgttggngtcttataactttgtctcgtggtaccaacacgcaccgaggacaaacgacccccaaactccatagtatttagtagtaaccgtacaaagttaacggccggtacccgttccgggggtccctagtacgtccgtcttctacgtcggcctaccgaagttctcggacctaaacgcggcccttcccgtcgaccgtctcgtcggccttcgaggtctcgacgatggacgctagtaatttacttacgtcgacncgtcctacacnttcgactagtacgaagttaacgttaacgggtttttcggggttaccgggacggaacggaacctagtccgtacgtacccggttaacgtaacgtccgaaccggcccgtaacggtcctcccggtaccccgtcgggtacctacccgttcgttaccccgg

SEQ ID NO: 228290 - DNA, 514 bp, Homo sapiens
  misc_feature: GYAE6OF02JIJZ7.14.85.H08.1.454.CMB.1.raw
  modified_base (239)..(239): a, c, t, g, unknown or other
  misc_feature (239)..(239): n is a, c, g, or t
tcagcgtctagtaccacgaccggtgctcgatttagtatcactcagtcgcggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggngcttataactttgtctctgtacaacagcaccaggcaaagcccccaaatcatgatttatgacgtcaataagcggccctcgggggtccctgactcgcttctctggctccaagtctggcaacgcgcctccctagaccgtctcgtgggcctccgagctgacgagtgagctgattattactgcagctcacatgcagtcagtaactagtttcgggtttcggcggtacggacagctacgaccgtctaagcacgccgaagcctcgccccgtgcctactctccg

SEQ ID NO: 228291 - DNA, 611 bp, Homo sapiens
  misc_feature: GYAE6OF02I1M5X.14.85.H08.1.454.CMB.1.raw
  modified_base (236)..(236): a, c, t, g, unknown or other
  misc_feature (236)..(236): n is a, c, g, or t
  modified_base (371)..(371): a, c, t, g, unknown or other
  misc_feature (371)..(371): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcaggcacaggtcctgggcccagtctgccctgactcagcctccctccgcgtccggtctcctggacagtcagtcaccatatcctgcactggaaccagctagtgacgttggngcttatactttgtctcctgtaccaacagcaccaggcaaagcccccaaactcactgattatgactcaataagcgccctacggggccctgactcgcttctctgctccaagtctggcacacggcctcctcgaccgtcncgttggccttccgaggctggacgtatggagcctagactttagttactggaccagcctactacatcgactagtaccgtaagttaaacccgtaaggtttttcggggtttacgggaccgggttaaggaaccggtaagtccgttaccggtaacccggttacccgttaaacgttccggaaccgtacccgtaaacggtccgtcccggtacccccgttccgggtacctacccgttcgtttcccccgg

SEQ ID NO: 228292 - DNA, 549 bp, Homo sapiens
  misc_feature: GYAE6OF02IDCSE.14.85.H08.1.454.CMB.1.raw
  modified_base (359)..(359): a, c, t, g, unknown or other
  misc_feature (359)..(359): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttatacttttgtctcctggtaccaacagcacccaggacaaagcccccaaactccatgattttatgacgtcaataggccggcccgtcggggtcctgactcgcttctctggctcaagtcngcacacggcctcctgccgtctctcggctcgaggctgacgatggagctagtattattactgacagctacacatgctagtcaagttaactagttttccggggtttcgacgggacgggtacaacgtcgtacggtacccgtacgtaagtccaccgtacccgaggctccgccccgtcggtctaccctcttacccg

SEQ ID NO: 228293 - DNA, 546 bp, Homo sapiens
  misc_feature: GYAE6OF02IJAV6.14.85.H08.1.454.CMB.1.raw
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (429)..(429): a, c, t, g, unknown or other
  misc_feature (429)..(429): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaagggctggagtggattggggaaatcgagtcaagtggaggcaccaagtacaacccgtcctcgagagtcgagtcaccatancaatagacacgttccagaatcaagttctcctgagctgactctgtcgacncgccgngacacggctgtagtattacgngttgacgagagtacgtttcgcgttgtaccgctcgttagactacgtggggtacccaacgggtacccgtggtaccctaccgttcgttcctaccgacgtccctccgacccgaggtccccg

SEQ ID NO: 228294 - DNA, 624 bp, Homo sapiens
  misc_feature: GYAE6OF02HW91J.14.85.H08.1.454.CMB.1.raw
  modified_base (271)..(271): a, c, t, g, unknown or other
  misc_feature (271)..(271): n is a, c, g, or t
tcagcgtctagtaccacgaccggtgctcgatttagtatcactcagtcgcgggggggggtctcaggaggcagcgctctcaggacgtcaccaccatggcctgggctctgctccccctctcagcctcctcactcagggcacagggtcctgggcccagtctgccctgactcagcctccctccgcgtccgggtctcctggacagtcagtcaccatatcctgcactggaaccagcagtgacgttggtgcttataactttgtcttcctggtaccaacngcacccaggcaaacgcccccaaactcaatgtatttatagtacgtacaataagccggcccgtcgggggtaccctgactcgtcttctcgtcgctaccaagtctggtcaacgacggtccctcctcggtacccgttcgtcgtcgggtcctaccgacggtctcggacgtacgtggacgtctagtactttattactgcacgtctacacatgactagtactacgttaaacttagggttttccggggtttcgggacggtaccgggtacctaggtcctacggtacccgttacctaacgtccgaaccgtacccgaaggcccgttaccggtcccccgttcggtaccttcctccggtttaccccg

SEQ ID NO: 228295 - DNA, 582 bp, Homo sapiens
  misc_feature: GYAE6OF02GVLTW.14.85.H08.1.454.CMB.1.raw
  modified_base (425)..(425): a, c, t, g, unknown or other
  misc_feature (425)..(425): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctgtcaatggtgcgtcctcactaatctctactggagctggatccgccacgcccccgagggaacggggctggagtggagttggggaatcgagtcgaaagtggaggcacaagtacaacccgtcctcgacgacgtcgagtcacatatacaatagactacgttaccagaatcagttcctcctgacggctgactttctgtgacgagcccgacggacncgcgtgtgtacttcgtgtcgcgtagtacttcgtttcggcgttggtaccgtcttcgttgacttaccggtggggacccgtaacggggtacccgttcggttcccgacccggttcgttaccgttccgacggtccccttcccgaacccgtacgggtaccccc

SEQ ID NO: 228296 - DNA, 577 bp, Homo sapiens
  misc_feature: GYAE6OF02FR8DN.14.85.H08.1.454.CMB.1.raw
  modified_base (505)..(505): a, c, t, g, unknown or other
  misc_feature (505)..(505): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatcccgccacgccccccgaggggaaggggctgggaggtggagttggggaaatcgagtcaaagtggaggcaccgaagtacaacccgtcctcgagagtcgagtcaccatatacaatagacacgttccagaactctacgttcctccctgaacgctgagtctctgtcgaccgccgcacgacgacggccgcgtatttctgtgcgacggacccgggagtacggtttactagtaagaaaacggttcgttcgtgctanagttagttggtttggttggttttgtagttggttcggtcggggtaccggtaggggtaccgtaaggttaccggg

SEQ ID NO: 228297 - DNA, 530 bp, Homo sapiens
  misc_feature: GYAE6OF02GWXXG.14.85.H08.1.454.CMB.1.raw
  modified_base (457)..(457): a, c, t, g, unknown or other
  misc_feature (457)..(457): n is a, c, g, or t
  modified_base (506)..(506): a, c, t, g, unknown or other
  misc_feature (506)..(506): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattggggaatcagtcaaagtggaggcaccaagtacaacccgtcctcgagagtcgagtcaccatatcaatgacacgttaccagaatcagttctcctgagctgacttctgtgacagcccgcggaccacggctgtgtattactgtcgcgagtattcgtttcggctgggtacncttcttgactacgtcgggccacgggaccctgggtccaccgtctcttacncgtccctccgaccgaacggtcccc

SEQ ID NO: 228298 - DNA, 566 bp, Homo sapiens
  misc_feature: GYAE6OF02H5S7I.14.85.H08.1.454.CMB.1.raw
  modified_base (402)..(402): a, c, t, g, unknown or other
  misc_feature (402)..(402): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccagggaacggggctggagtggatggggaatcagtcaaaggtggagcacaagtaccaacccgtcctacgagagtcgagtcacatatcaatagacacgttcagatcagtttctcctgacgctgacttctgtgacncgccgacggacacggctgtgtattactgtgcgtagtattcgtttcggcttcggtacgtcgttcgttgaccttacggtccggggtaccgtaacggggtaacccctgggtaccctaccggttccttccgttaccgacgtccccgtaccgacccggacgggtacccc

SEQ ID NO: 228299 - DNA, 601 bp, Homo sapiens
  misc_feature: GYAE6OF02HXWPZ.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccgagggaaggggcgtggagtggagttagggggaaatcgagtacgaaaggtggaggcaaccgaaagtaaccaacccgtcctacgagagtcgagtcaccatatcaatagacacgttcagaatcagttcctcctgagtctagacttctgtgacgacgccggacggaccacggcttggtagttattacgtggtgcgagtacgttcgtttcgggcttgggttacgtcttcgttacgacgttaccggtggggtacccgaaggggtaaccccgttgggtacccgacccggtttcttaccgttaccgaccgtcccgtacccgaccggtaaccgggtcccc

SEQ ID NO: 228300 - DNA, 540 bp, Homo sapiens
  misc_feature: GYAE6OF02FNBAV.14.85.H08.1.454.CMB.1.raw
  modified_base (387)..(387): a, c, t, g, unknown or other
  misc_feature (387)..(387): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgccccccagggaacggggctggagtggattgggggaaatcgagtcaaagtggaggcaccaagtacaacccgtcctcgagagtcgagtcaccatatacaatagacacgttccagaatcagttcnccctgagctgacttctgtgacagccgcgacacggctgtgtattactgtgcgagtacttcgtttcggcttggtacgtcttcgttgacttacggtcgggccgtaacgggtaccctggtaccaccgttctcttcacgccctccaccgacggtcccc

SEQ ID NO: 228301 - DNA, 588 bp, Homo sapiens
  misc_feature: GYAE6OF02JGE7W.14.85.H08.1.454.CMB.1.raw
  modified_base (240)..(240): a, c, t, g, unknown or other
  misc_feature (240)..(240): n is a, c, g, or t
  modified_base (307)..(307): a, c, t, g, unknown or other
  misc_feature (307)..(307): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatatcctgcactggaaccagcagtgacgttggngcttataactttgtctcctggtaccaacagccacccaggacaaacgccccccaaactcatgatttangacgtcaataagccggcccgtcggggtcctgatcgcttctctggcctcagtctggcaacgcgcctcccgtgaccgtctcgtcggcctccgaggctagacgagtgacggtctagtacttattactgacagtcctcacagttcgctagtacaagttaacgtaggttttccgggtttcggacggtaagggacctaggtccgtacggaccgttacctaacgtccgaaccgtacccgaaggtcccgttccggacccccgttcggtcctaccgttccgttaccccgg

SEQ ID NO: 228302 - DNA, 603 bp, Homo sapiens
  misc_feature: GYAE6OF02IX6UQ.14.85.H08.1.454.CMB.1.raw
  modified_base (252)..(252): a, c, t, g, unknown or other
  misc_feature (252)..(252): n is a, c, g, or t
  modified_base (449)..(449): a, c, t, g, unknown or other
  misc_feature (449)..(449): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgccgtccctcactaatctctactgganctggatccgccacgccccgagggacgggctggagtggagtggggaaatcgagtacaaggtggacggcaccgaaagtaccaacccgtcctcggagagtcgacgtcaccatactacaatagacacgttcagatcagttctcctagagtctgacttctgtacacgagcccggcggaacgcggtctgttagttacttacgngtcgacgtagtacgtttcgtttcggtcgtcgggttacgtcttacttggtaaccttacggtcggggtacccgtaaacggggtaccccttcgggtacccttcccggttcttaccgttccgtaccgtcccgtaacccgtaccggaccgggtaccccg

SEQ ID NO: 228303 - DNA, 540 bp, Homo sapiens
  misc_feature: GYAE6OF02F2IT7.14.85.H08.1.454.CMB.1.raw
  modified_base (352)..(352): a, c, t, g, unknown or other
  misc_feature (352)..(352): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtcctcactaatctctactggagctggatccgccagcccccagggaaggggctggagtggattggggaaatcagtcaaagtggaggcacaagtacaacccgtcctcgagagtcgagtcaccatancaatagacacgttaccagatcagtctccctgacgctgacttctgtgacacgcccgcggacacggctgtgttatactgtgcgagtatcgtttcgcgttggtacgcttcttgaccttacgcggggtccgaacgggtaaccctgggtccacccggttctcgttcacgtccctccgacccgaacgggtcccc

SEQ ID NO: 228304 - DNA, 598 bp, Homo sapiens
  misc_feature: GYAE6OF02HWT7E.14.85.H08.1.454.CMB.1.raw
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccgagggaaggggctggagtggagttgggggaaatcgagtacgaagtggagcaacaagtacaacccgtcctcgagagtcgagtcacatancaatagacacgtccagatcagttctccgtgaggctgacttcgtgtacgacacgccggcgacgacggtntgtgttattacgtgtgcgagtagttcgtttcggcgttacgggttaccgtcgtccgttagaccgttaccggtcggggacccgtaacgggggaaccccttcgggtaccgtaacccggttctttaccgttaaaccgccccgttacccgaaccggaaccgggtccccttaaccggg

SEQ ID NO: 228305 - DNA, 870 bp, Homo sapiens
  misc_feature: GYAE6OF02HQBA5.14.85.H08.1.454.CMB.1.raw
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
tcagcgtctagtaccacgaccggtgctcgatttagtatcactcagtcggcgggggggggtcgtcgaggaggcagcgctctcaggacgtcaccaccatggcctgggctctgctcctcctcagcctcctcactcagggcacgagggtcctcgggcccagtctcgccctgactcacgccctccctcgcgtccgggtctccgtaggacagtccaggtcaacctatactcctgcacgtcggaaccngcaaggtgacgttggtntacttaataaccttttgtctccgtaggtaaccaagacgacaaccgaggaccaaaccgccccaaaatccgatagtaactttatcgaccgtataaactaacggccggaccggtccggggtaccctagacctacgtccttcgtcgtggtacctaccgtaagtcgtagggaaccaacgaccggtcccgtaccctacggtacccgttcgtaccggttcgggtaccgtaccggtacggtacggtacggtaaacggtacgttaggggtaacgggtcgttaagtaacgttttaacgtaccgttacggtaacccgaagttcccgttaaacctacgtagtaccggtaccgttaacggttaaccggtaaaacgtttaaacccgggtttaacggggtttttaccgggggggttttaaccgggaaacggggttaaacccgggggtaacccttaaacggggtaccccgttaccgggttaaaccccggggtttaacccgttaaaacgggtaccccgtaacccggggtaaacccccgggtaaacgggtacccggtttcccccgggtaccccccgggtttaccccgggtaaccccgtttacccggtttaaccccggtttccccccgggg

SEQ ID NO: 228306 - DNA, 681 bp, Homo sapiens
  misc_feature: GYAE6OF02H2ZXD.14.85.H08.1.454.CMB.1.raw
  modified_base (125)..(125): a, c, t, g, unknown or other
  misc_feature (125)..(125): n is a, c, g, or t
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctnactcagggcacagggtcctgggcccagtctgccctgactcagcctccctccgcgtccgggtctcctggacagtcagtccacatctctgcactcggaaccagcagtgacggttggtaggttataagtntgttctcctgtaaccaacaaccacccgagaccaaacgacccccaatcatnatttangagtacagtactcgcctcgtagggtttcaatcgtcttctctgtctcgagtcagcaacgacggtcctccgtacgacctactctcggtacggaccttacgacggtcgtacggtacggacgtacgttcgtagtaatttattagttcgacgtacgttctacgtaattacgcgtacccgtaccggtaggtcccgagttaaaccacgttaacgttacgggtttacggtttacgggggttttcgggggaaccgggggttaacggttaaacggggttccggttaaccccggtacggttacggtaacccggaacccgtacccggttaaccgggtcccgttaaccccggtcccccggtttaccggtcccttaaccgttccccg

SEQ ID NO: 228307 - DNA, 645 bp, Homo sapiens
  misc_feature: GYAE6OF02GNNA0.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcaggtggggcgcaggactgttgaagccttcggacgaccctgtccctcacctgcgctgtcaatggtgccgtccctcaactaatcctctacgtggagcgtggactcccgaccacggcccccgaagggggaacggggcgtgggaggtgggtaggttaggggaaatcgaggtacgaaaggtgggaggacaaccgaaagtacccaaccccgtccctacggagtacgtcgacgtaccacatactacaaatacgactacgttaccaagtaactcgtacgtttcctaccgtcgtacggtcgtcgtacttcgtgtacgacgacgccggaccggacgacggtcgtcgtgttattacgtgtgcgtagtacgttcgttcggtcgtcggtcgtcttcgttcgtacgtacgtcgggtccggacggtaccggtcggtccgtaccgtccgttccttcgaccgtccctacccgacccgttttttttttttaccggacccg

SEQ ID NO: 228308 - DNA, 525 bp, Homo sapiens
  misc_feature: GYAE6OF02IYHYA.14.85.H08.1.454.CMB.1.raw
  modified_base (299)..(299): a, c, t, g, unknown or other
  misc_feature (299)..(299): n is a, c, g, or t
  modified_base (433)..(433): a, c, t, g, unknown or other
  misc_feature (433)..(433): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacacaccaggcaaacgcccccaaatcatgtattangagtcagtaatcgcctcgagggtttctaatcgcttctctgctccagtctggcaacgacgcctccctacgacctactctcgtcggcctccgaggctggaggacgagtctgtatttaattagtgcagtctcattcngccactggcagcaatcagttggttggttcgggcggggacgtaagggtcgaccgtcgtaggtcacggcccgaggcctccggccccgtcgtacc

SEQ ID NO: 228309 - DNA, 581 bp, Homo sapiens
  misc_feature: GYAE6OF02FODM4.14.85.H08.1.454.CMB.1.raw
  modified_base (442)..(442): a, c, t, g, unknown or other
  misc_feature (442)..(442): n is a, c, g, or t
  modified_base (465)..(465): a, c, t, g, unknown or other
  misc_feature (465)..(465): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccagggaacggggctggagtggagttggggaaatcagtcaagtggaggcacaagtacaacccgtcctcgagagtcgagtcaccatatcaatagacacgttccagaactcattctcctgacggctgacttcgtgtgactagccgcggacgacggtctgtgtattctggtgcgagnttacgtttcggcgttcggtaccncttcgttagaccttacggcgggacccgtaacggggtaaccccgttgggtaccctacccgttccgttaccgttaccgaccgttaccccgttcccgaacccggtaacgggtacccccg

SEQ ID NO: 228310 - DNA, 739 bp, Homo sapiens
  misc_feature: GYAE6OF02JX0CT.14.85.H08.1.454.CMB.1.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgtctagtaccacgaccggtgctcgatttagtatcactcagtcgcgggggggtcgtcgaggaggcagcgctctcaggacgtcaccaccatggcctgggctctgctcctcctcagcctcctcactcagggcacagggtcctgggcccagtctgccctgactcagccctccctccgcggtccgggtctccgtggacagtcacgtcaccatactccngcactggaaccagcagtgacgttgncttatactttnctctgacacancaccagcaacgccccaacncactgattacngtacgtacaataagccggacccgttcggggtaccctgacgtcgcttctcgtcggctaccgaagtctacggtacaaccgtacggccctccctcgacccgttcacgtcgggtccttcccgacggtccgtacgacggactacggtacgggacgtcggtaacttaacgtttaaccgtcgtacgtacggtacctaccgtaccgtaacgttcgtaaccgttacgtacccgttaaacgtaaaccggtttaaacggttttttccgggggttttaaccgggacggggttaaaccggggtaacctaaacgggtccgtttacgggtaaccccggttacggtttaaacgtacccggtaacccggtaaaccccgtaacggggtttaccccgtcccgggtaccccccggtttacccgggttaacccgttaacccgttccggtttttaacccccccggg

SEQ ID NO: 228311 - DNA, 649 bp, Homo sapiens
  misc_feature: GYAE6OF02HE6QR.14.85.H08.1.454.CMB.1.raw
  modified_base (240)..(240): a, c, t, g, unknown or other
  misc_feature (240)..(240): n is a, c, g, or t
  modified_base (300)..(300): a, c, t, g, unknown or other
  misc_feature (300)..(300): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcacgtggaaccagcagtgacgttggngcttataactttgtctctgtaccaacagacaccaggcaaacgccccaaatcatgtattangtacgtacaagtaagccgccgtcgggtcctagactcgcttctcgtcggctacgaagtcgtggacaacgaccgtcctacctcgaccctctcgtcgggtcctccgaggtcagacgagtacgaggtctagtactttagttacgtgctacgtctacactagtcacgtacgtactaacgttaaaccgttaacggttttccgggtttaacgggaccgggtaaaccgggtaaccgtaacggtccgttacggtaaccccgttaagttaaccggtacgtaaccgtacccggaacggttacccgttccccggttaccccccggttcggttaacccttacccgttccctttaacccccgg

SEQ ID NO: 228312 - DNA, 587 bp, Homo sapiens
  misc_feature: GYAE6OF02FQTKB.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatcccgccacgcccccagggaagggctggagtggagttaggggaatcgagtacgaaagtggaggcaccgaagtaccaacccgtcctacgagacgtcgagtaccaccatactacaaatacgaactacgttccaagaactctagttcctccgtgagctgactttcgtgtcgacacgccgcggacacggtctgtgtattacgtggtcgcgacgtactcgtttcggcgttgtaccgtccttcgttgaccgtacgtcggggccgtaacgggtacccgtcggtaccgacccgttcgttccgttcgaccgtacccttacccgaccgtaacggtaccccg

SEQ ID NO: 228313 - DNA, 601 bp, Homo sapiens
  misc_feature: GYAE6OF02JEE2I.14.85.H08.1.454.CMB.1.raw
  modified_base (466)..(466): a, c, t, g, unknown or other
  misc_feature (466)..(466): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggactccgccacgccccccgaggggaacggggctgggagtggagttgggggaaatcgagtcaaaggtggaggcaccgaagtaccaacccgtcctcgagacgtcgagtcaccatactcaatagacacgttaccagaactcagtttcctccctgacggtctgacttctgtcgacagcccggcgacgcggctggttgtacttacgtgtgcgtagtnttcgtttcggcttgggtaccgtcttacgttcgaccttcggttcggggacccgtaacggggtaaccccgttgggtcccgtacccggtttccttcccgttaccaccggtcccctacccgaacccggacgggtccccc

SEQ ID NO: 228314 - DNA, 577 bp, Homo sapiens
  misc_feature: GYAE6OF02GSQC8.14.85.H08.1.454.CMB.1.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatatcctgcactggaaccngcagtgacgttggngcttatactttgtctcctggtacaacagcaccaggcaaacgccccaaactcatgacttatgacgtacaataacgcgcccgtcggggtccctgactcgcttctctggctccaagtctggactaacgcggcctcctcgacccgtctccgtgggtcctccgaggtctgaccgtagtgaggctaggtaacttattaccngacagctacanatgactagtacaagttactaacgttttcggggtttacggcggtaacgggtaccagtcgtacggtaccgtaccgtaagttcgaccgacccgtacggaccttccggtacccctcgggtacctaccgtcgttacccg

SEQ ID NO: 228315 - DNA, 642 bp, Homo sapiens
  misc_feature: GYAE6OF02HILKD.14.85.H08.1.454.CMB.1.raw
  modified_base (162)..(162): a, c, t, g, unknown or other
  misc_feature (162)..(162): n is a, c, g, or t
  modified_base (240)..(240): a, c, t, g, unknown or other
  misc_feature (240)..(240): n is a, c, g, or t
tcagcgtctagtaccacgaccggtgctcgattttagtatcactcagtcggcgggggtgctttctgagagtcatggacctcctgcacaagacatgaaacactgtgttctctctctgtgcagctccagatggtcctgtcccaggtgcagctacagcagtgggcncagctgtgaagctgagacctgtacctcaccgtgcgcgtgtcaagtggtgccgtccctactactaatctctacgtggancgtggactccgcgacgccccgagggagggctggacgtggtagttagggaatcgagtacgaaagggtggagccgaacgtaacgtacgaacccgtccgtacgagtacgtcggagtccgaacagtactactaaagtacgactacgtaccaagaactctagttcctacccttaggagtactcgtacgttctgtcgaactaaccggccggaccggaacgtacggacgtttgtagttacttacggtaacgttcggtacggtaacggtacttttccgggttacccggtaggttccgggtaactcgttacgttacggaccgttttaaccggggcgggttacccgaacggggtaaccctcggtccgtaacccgtcgttactccgacgtcccgacctaccggaacgttcccg

SEQ ID NO: 228316 - DNA, 547 bp, Homo sapiens
  misc_feature: GYAE6OF02IIMMB.14.85.H08.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (265)..(265): a, c, t, g, unknown or other
  misc_feature (265)..(265): n is a, c, g, or t
  modified_base (373)..(373): a, c, t, g, unknown or other
  misc_feature (373)..(373): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatatcctgcactggaaccngcagtgacgttggncttataactttgtctcctggtaccaanagcaccaggcaaagcccccaaactcaatgattttatgacgtcaaataagcggaccctcggggtccctgactcgcttctctggctccaagtctgcaacacggcctcccngaccgtctcgtgggctccgacggctgacgatgacggctagtattattactgcagtctcacatgctagtacagttaaactaagttttcggggtttcggacggagggaccagcgtacgaccgttctaagtcaacgacccaaggcctacggtcccccgtggtcccacgtcttacccg

SEQ ID NO: 228317 - DNA, 919 bp, Homo sapiens
  misc_feature: GYAE6OF02F1RBX.14.85.H08.1.454.CMB.1.raw
tcagcgtctagtaccacgaccggtgctcgatttagtatcactcagtcggcgggggggggtctcaggaggcagcgctctcaggacgtcaccaccatggcctgggctctgctcctcctcagcctcctcactcgagggcacgagggtcctgggcccagtctgccctgactcacgccctccctccggcgtccgggtctccgtggacagtcagtccaccatactcctgccactcggaaccagccagtcggtacggttggtgtactttaattaaccgttttgttccttccgtacggtaaccaaacgacgaccaacccgaggaccgaaaaccgacccccctaaaactcctaacttagtaattttaagtacggtaaccgttaccaaacgtaaacggcccgggtccccggttaccggggggtccccttaggtacgttccgttcgtttccttcgttcgggtacctacccgtaacggttaccgttacgggaaccctaaaccgtacccggtaccccttaccccgtaccgggtaccccgttccgttaccggttcggggtcccttacccggaacgggtcccgttacgggaaccggtacgtgggtaaccgggtcgttacgttaacgtttaactttaaccggtacggtaccgtaacggtacccttaaccgaaccgttacgttaccggacgttaaccggttaccgttaaacggtttaaacgttttaaccggggtttttttccggggggtttttaacgggtaccggggtaaaccggggtaaaccgtaacgggtcccggttaacgggtaaccccgggtttaaccggttaaccgggtacccggtaacccggtaacccggtaacgggttccccggttaaccccggtaccccccgtttacccggggtacccctttacccgggttccccgtttaccccccgg

SEQ ID NO: 228318 - DNA, 576 bp, Homo sapiens
  misc_feature: GYAE6OF02HQD66.14.85.H08.1.454.CMB.1.raw
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagacccctgtccctcacctgcgctgtcaatggtgcgtccctcactaatctctactggagctggatccgccagcccccgagggaagggctggacgtggagttaggggaaatcgagtcaaaggtggaggcaccaagtaccaacccgtcctcgagagtcgagtcaccatatcaatagacacgttcagaatcagttctcccgtgacggctgactctgtgacngccgcgacncggctgtgtatctgtgcgagtatcgtttcggcgttggtccgtcttcgttcgacgttacggtcggggtacccgaacggggtaaccccttgggtacccgtacccgttcgttacgttacccgacggttcccctacccgaccggtaaccgggtacccccg

SEQ ID NO: 228319 - DNA, 604 bp, Homo sapiens
  misc_feature: GYAE6OF02G3999.14.85.H08.1.454.CMB.1.raw
  modified_base (566)..(566): a, c, t, g, unknown or other
  misc_feature (566)..(566): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctgtcaagtggtgccgtccctcactaatcctctacgtggagtcgtggactccgccacgccccccgaggggaacgggcgtggacgtggagttggggaaactcgagtacgaaaggtggagcacaagtaccaacccgtcctacgagacgtcgacgtcaaccgatatacaatacgactacgtccaagaactctacgttcctaccgtgacgtctacgtacttcgtagtacgacgacgccgacggacgacggcgtgtagttactcgtgtcgacgtagtcttcgttcggtcgttcggtacgtctcgttcgaccgttacgtcgggtaccgtaacgggtaccttcgggtacctacccggttnttccgtcgtacgtcccgtaccaccggaccggtaccccg

SEQ ID NO: 228320 - DNA, 598 bp, Homo sapiens
  misc_feature: GYAE6OF02F6H0J.14.85.H08.1.454.CMB.1.raw
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttatacttgtctcctggtaccaacngcaccagcaaacgcccccaactcatgactttatgacggtcaagtaactcggccctcgaggggtttctaatcgcttctctgcctcaagtctggcaacnccggcctccctcgacctatcctcgtgggcctaccgnggctggacggacgacgttcgtagtaatttattagttcgctacgtaccttcaattacgtcgacctaccgtggaccagacctaatccagtttgggttcgggttttccggggaccgggggtaaccgtagggtcgtacccggttaccggtaacggtccgacgacccgaaggtccctaccggcccccgttacggccttacccgg

SEQ ID NO: 228321 - DNA, 653 bp, Homo sapiens
  misc_feature: GYAE6OF02I461D.14.85.H08.1.454.CMB.1.raw
  modified_base (251)..(251): a, c, t, g, unknown or other
  misc_feature (251)..(251): n is a, c, g, or t
  modified_base (361)..(361): a, c, t, g, unknown or other
  misc_feature (361)..(361): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactgganctggatccgccagccccccagggaaggggctggagtggatttagggggaaatcgagtcgaaaggtggaggcaccaagtaccaaccgtccacgagagtcgagtcaccatancaatagacacgttccaagaactcagttctcccgtagacggtctgactttctgttgacacggccgtcggaacctacgggcttgttgttattaccttggtacgcggtaacgtacgttccgttttcgggccgttcggggttaccgtccgtttcgtttacggtaacccttacgggttaccgggggtcccgtaaacggggggtaacccccgttcgggttaccccgtaacccggttacctttcccgttaccgtacccgtaccccgtaccccgtaaccccggtaaccgggtacccccgg

SEQ ID NO: 228322 - DNA, 749 bp, Homo sapiens
  misc_feature: GYAE6OF02IRON9.14.85.H08.1.454.CMB.1.raw
  modified_base (171)..(171): a, c, t, g, unknown or other
  misc_feature (171)..(171): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtgggcncaggactgttgaagccttcggacaccctgtcccctcgaccctgccgctcgtccaagtggtcgccgttcccctcgactaactctactaccgtggagctggtactccgaccaccgacccccgaggggacgggctggacgtggtagttaggggaactcgagtacgaaggtggacggacaacgtaacgtaccctacccgtaccgtacgacggtacgtcgacgtaccaaccgtattactacgaaagtacgaacctacgttacccgaaagtaacttaccgtaccgtttcccgtacccgtaggaccggtaccttacgtaacctttcgttacggtcgacggtaccggaccccggtacggaccgtcggtacgttcgttacgttacgtttcgtacggtcgtaccgtacgttacgttaccggtttcggacgtttaccggggttaaccgttccgtttacgttacgtaaccggttccgggtacggggacccggtaacgggttaccccggttcgggttacccgtacccggtttaccgttaccgttacccgtaccgtacccccgttacccgaacccggtacccggttaccccg

SEQ ID NO: 228323 - DNA, 739 bp, Homo sapiens
  misc_feature: GYAE6OF02G0GHR.14.85.H08.1.454.CMB.1.raw
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtccagtccaccatactcctgcactcggaaccagcagtcgacgttggtgcttaataacttttgtcttcctggtaccaacagaccaccgaggaccaaacgccccctaaaactcaatcgtaattttagtacgtaacgtactaaagtaaacgggccggtacccggttaccgggggttaccctaggaacgttccggtacctttactccggttcggtacctaccgtaaacggttccgttccgggaaccaaaccggtaacccggtcccttacccgtaccggtaacccgttccgtcgtccggggtccttaccgaccggtcgtacgggaacgacggttcggaacggtcgtaaggttaacttaacttaccgacgtacgtacgtactacgaactagtacgcttaacgtgtaaacgtttaacgttaacggtttttacgggggtttccggacgggtaacgggaaccaagtccgtaggtaacccgttacctaaggaccctaacgacccgtaacggccttacccgggccccgttacggtcaccgttcttaccccgg

SEQ ID NO: 228324 - DNA, 720 bp, Homo sapiens
  misc_feature: GYAE6OF02HXVL5.14.85.H08.1.454.CMB.1.raw
  modified_base (98)..(98): a, c, t, g, unknown or other
  misc_feature (98)..(98): n is a, c, g, or t
  modified_base (173)..(173): a, c, t, g, unknown or other
  misc_feature (173)..(173): n is a, c, g, or t
tcagcgtctagtaccacgaccggtgctcgatttagtatcactcagtcgcgggggtgctttctgagagtcatggacctcctgcacaagaacatgaaacncctgtggttcttctcctctggtggcagctcccagagtcgggtcctgtcccaggtgcagctacgagcaggtgggcncaaggctgttgaacgccttcggacgtaccctgtccctcaccgtgccgtctgtccaagttggtcgccgtccctacaactaactctccgtacgtggactcgtgacgtccgccgtacgaccccggaagggtacgggcgtaggacggtaggtaggttacgggaatcgaaggtacgaaaggtcggaacgcaaaccgtaacgtaccgtaaccccgtccgtacggacggtacgtaccggtaacgtaccaacgtacgtaacgtaccgaaagtaacggtaaccgtaccgttaaccgaaacgttaaacgtccgttaaacgtttccccgtaaccggtagggtaaccgtcgttaccgggtactttcgtaggtaccgacgtaccggtaccggacggtaaccgcggttacgtaggtacgttacgttacgtcggtacgtaccggtagttaccgttcgttcggtacgttaggtccgtcttacgtagttacccgtacggtcgggaccgtaacggtaccgtcgtacgttaccgtctacgtcgacctcccgtacgaccgacgtccg

SEQ ID NO: 228325 - DNA, 662 bp, Homo sapiens
  misc_feature: GYAE6OF02IA7QW.14.85.H08.1.454.CMB.1.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcacctcagggcacagggtcctgggcccagtctcgccctgactcagcctccctcgtgtctgggtctcctggacaggtcgactcaccatcctcctagcactggaaccngcaagtgacgttgggngttataagtntgtctcctagtaccaacaacaccagacaaacgaccccaactcaatcgtattatagagtctaagtaacgtccgcccgtacgtaggggttctaactcggtacttctagtcgtcctaccgtaacgtccgtgtaccgaacgtacccggcccgtccttacgacctacgtcctccggtcggggcctacccgaggtccgtaggaacgggacgcggttacgttagtactttaagttagttcgtacgtacgtcctacgtatacttcgacccgtcgtacggcctagaaccttacgtcgtaagttcgggttcgggtttccggggacggggtaaccgtagggtcccggtaccggtacgtacggtaccgtaccggaccggtaaccggccgttcccggtccccgtaccggttcctacccg

SEQ ID NO: 228326 - DNA, 733 bp, Homo sapiens
  misc_feature: GYAE6OF02FHR9V.14.85.H08.1.454.CMB.1.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaagtggtcgccgtccctnactatcctctactgganctggactccgccacggccccccgaggggaacggggcgtggaggtcggagtttaggggaaacttcaagtacgaaaaggtcggtaggaccaacccgaaacgttaaccgaacccccggtccccgtaccggtacgtacggttaccggacggtaccctaaccattaacttaccgaaaatacgaactaaccggttacccaaggtaaacctccgtaacggtttccctacccgtggaacggtccgttcggtaacctttcggtacggttacaccgtaacgggtcccgacggggtacccgaccgggtcttcggtagttaactttccgtaggtcgcgtagtacttcgtttccgggcgttagggtacctcgtttccgttggtacccgttacggtcggggacccgtaaccgggtaaccctccgggttccctacccggttaccttccggttaccacccggtcccttacccccaaccggtaccgggtacccccg

SEQ ID NO: 228327 - DNA, 609 bp, Homo sapiens
  misc_feature: GYAE6OF02H2T47.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctccagatgggtcctgtcccaggtgcagctacagcagtggggcgcaggactgttgaagccttcggagaccctgtccctcacctgcgctgtcaatggtgcgtccctcactaatctctactggagctggactccgccacgcccccgaggggaacggggcgtgggagtggagttaggggaaatcgagtacaaaggtggagcaacaagtaccaacccgtcctacgagagtcgagtcacatatcaatagacacgttacaagaactcacgttcctcccgtgacggtctgtacttcgtgtgacacggccgcggacgcggctgtgttattacgtgtgcgtagtctttcgtttcggcgttacggtacgtcttcgttacgtaaccgttacgggtcggggacccgtaacggggtaacccgttcgggtacccgtacccggttccgttccgtttaccgaccgtaccccgtacccgaacccggtaccgggtacccc

SEQ ID NO: 228328 - DNA, 706 bp, Homo sapiens
  misc_feature: GYAE6OF02I6OCL.14.85.H08.1.454.CMB.1.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (492)..(492): a, c, t, g, unknown or other
  misc_feature (492)..(492): n is a, c, g, or t
tcagcgtctagtaccacgaccggtgctcgatttagtatcactcagtcggcggggggggggtctcaggaggcagcgctctcaggacgtcaccaccatggcctgggctctgcctcctcctcagcctccgtcactcgagggcacgagggtcctgggcccagtctgccctgactcagcctcctcgcggtccggtctcctggacngtcagtcaccatactcctgcacgtggaaccagcagtcgacgttggngtccttataacgtttgtcttccgtcggtaccaacncgcaccgaggacaaacgacccccaaactctatagtacttactcgtacgtactaagtaacggccggcccgtccgggggtcctaggtactccggtactttccgtctcgggtccttaccgaacgttcgtacggaccaacgtaccggtcccgtcccgtacgtacccgttcgtcggtcggtctacccggaggtccgttacggacgtagtggacggngttacgtattttacgttactcggactaggactacctaactcgtcgtacacgttacgaacgttaacgttaacgggttttccgggtttacggggacggtaacgggtaacctacgtccgttaccggtaccggttaacccgtacggacgtaacccggtaccggtaaccgtccgtacccggtccccgttaccggtccgtacccggttcgttacccccgg

SEQ ID NO: 228329 - DNA, 589 bp, Homo sapiens
  misc_feature: GYAE6OF02F769I.14.85.H08.1.454.CMB.1.raw
  modified_base (338)..(338): a, c, t, g, unknown or other
  misc_feature (338)..(338): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactatctctactggagctggactccgccacgcccccgagggagggctggagtggagtaggggaactcgagtacaagtggaggacaaccaagtaccacccgtccncgagagtcagtcacatactacaatacgacacgtccaagaatcacgttcctcccgtagacggctcgacttacgtgtacgacacggccgaccggacgaccgggtctaggttgtaacttcgtgtggcgtacgtacgtttccgtttcggcttggtacctcttcgttgacctcggtcgggccgtaaccgggtaccctcgggtacctaccgttcgttcccgttcgaccggtccccaccggtacccgacgggtacccc

SEQ ID NO: 228330 - DNA, 651 bp, Homo sapiens
  misc_feature: GYAE6OF02JBSR6.14.85.H08.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (447)..(447): a, c, t, g, unknown or other
  misc_feature (447)..(447): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggngttataagtntgtctctggtaccaacaacaccaggcaaacgcccccaaatcatgatttangagtcagtaactcgcctgtagggtttctaatcgtcttctcgtcgctaccaagtctggacaacgccggcctccctgacctatcgtctcgggtcctccgaggctaggaggacgtagtctcgtaatttattagttcccgagtactccgttanacttaagtcggacctaccgtaggaccagtaccgtaactcgtaacgttcggtttagggtttacccgggggaccgggggttaaccgtaaagggtccggttaacccgggttacccgttaaaggggttcccgaacggtaacccccggtaagggttaccctccccgggttacccccgtttacccgggttacccttaaccgtttccccgg

SEQ ID NO: 228331 - DNA, 661 bp, Homo sapiens
  misc_feature: GYAE6OF02GA0P9.14.85.H08.1.454.CMB.1.raw
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
  modified_base (389)..(389): a, c, t, g, unknown or other
  misc_feature (389)..(389): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggncttatactttgtctcctgtaccaacagccaccaggaccaaacgcccccaaactcatgtatttangtacgtacaagtaacgcggtcccgtcggggtccctgacgtcgcttctcgtggcctaccgaagtctggacaacgaccggtccctccncggtacccgttctccggtcgggtcctaccgaggctaggaacggacgtagtcgtagtaatttagttattcgactacggtcttacctaagttatcgtaccctaccgttagggactacgtacctaactcgtaagttcgggtttacggggtttccggggaaccggggggtaaccttaacgggtccggttacccggtaccgttacggggtaccctacggaccccgtaacgggtccctacccggtccccccgttacgggttaccctacccgttccccg

SEQ ID NO: 228332 - DNA, 593 bp, Homo sapiens
  misc_feature: GYAE6OF02GB9K2.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgccgtccctcaactaatcctctactggagctggactccgccacgccccccaggggaaggggctgggagtggagttgggggaaatcgagtacaaagtggaggacacgaagtaccaacccgtccacgagagtcggagtcacatactacaagagacaccgttaccaagtaactctacgttcctcccgtaggacgtctgacttctgttcgactggccgtacggacacggcgtgtgtaattacgtgcggacgagtactcgtttcggcgttcgtacgtcttcgttagtaccgttacggcggggtaccgacgggtacccgtcggtacctccgtaccgttcttacgccgtccccgtaccacccggacggtaccccg

SEQ ID NO: 228333 - DNA, 683 bp, Homo sapiens
  misc_feature: GYAE6OF02JSNMF.14.85.H08.1.454.CMB.1.raw
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
  modified_base (625)..(625): a, c, t, g, unknown or other
  misc_feature (625)..(625): n is a, c, g, or t
tcagcgtctagtaccacgaccggtgctcgatttagtatcactcagtcgcggggggggtcgtcgaggaggcgagcgctctcaggacgtcaccaccatgcctggctctgctcctcctcacgcctcctcactcgaggcacagggtcctggcccagtctgccctgactccagccctcctccgcgtccggtcctcctggacacgtcacgtcaccatacgcctgcactggaacccngccagtcgtacgttggtcttaatactttgtctctcgtacacancaccacgcaaaccgaccccaactcatacgtattacgtagtacgtacgtaaactaacggaccggtcccgtaccggggtcccgtcgtacgtcgtcctttctcgttacgccgttcaacgtcgtcggtacaaccgtaccggtccttaccccgtcggtaacccgttcgtacccgtcggtccctaccggcgtcctacggtacgtacggcgtaggcgttacgtaacttagttactagccgtacgccttaccgtacacggttcaccgtacgtacgtacttaaacggtttcgggttttaccggttccgggacggtaaccgggtacgaaccgttcgaccggtaccgtaccggtaacgttacnccggtaacccgaagttccgtcccggtaccctcgggtaacccttcgaccgtttcccccg

SEQ ID NO: 228334 - DNA, 667 bp, Homo sapiens
  misc_feature: GYAE6OF02G6JBI.14.85.H08.1.454.CMB.1.raw
  modified_base (207)..(207): a, c, t, g, unknown or other
  misc_feature (207)..(207): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctnacctgcgctgtcaatggtgcgtccctcactaatctctactggatcgtgatccgcacgcccccagggacggggctggagtaggacgttagggggaaattcagtacgaaaaggtgggaaggaccaccgaaagtaccaacccgtccctacgagagtccgagtcacatanacaananacacgttacaagaacgtctacgttctacccgtgacggtcctaggtactttcctggtagacgtaacgcccggacggaccgtacccggtctcgttagtacgtttaacgtcgtaggccgagtacgttcgtttccggtacgttagggttaccgtccgttacgtttacgacgttacccgggtcggggtaccccgtaacgggggtaaccccgttggggtaccctaacccggtttccgtaccgttttaccgaccgtacccctaccccggtacccggaaccgggttaaccccccg

SEQ ID NO: 228335 - DNA, 789 bp, Homo sapiens
  misc_feature: GYAE6OF02HZ3FM.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcaggtggggcgcaggactgttgaagtccgttcggacgtaccccgtcgtaccctccaccgtgcgctgtcaagtggtcgccgttcccctctaacttaactctactactggacgctcggacgtcccgccgaccggacccccggaggggaacggggcgtgggaggtgggtaagttacggggaaatccgtaaggtacgaaaggtggacggacaaccgtaaacgtaacccgtaaccccggttcccgtacggtaacggtacgtaccggtaacgaccaacctatactaactaacgtaacgaacctaccgttaaccgaagtaacttaccgtagtttaccctaccgttaggacgggtaccttcgtaacctttcgtaggtacgaccgtacggtacccgggacggtaaccggtacggtcgttacgttacggtttaactttacgtacgtacggtaccgtaacgtaccgtttcggttaccggtcgttacggggttccctaggtttaccgttacgtaccgttaccgggtaacggggacccggaaacccgggttcccgttacgggttacccctaccgggtttaaccttcccgtttaccgaccccgtaaccggttaccccgtaacccgggacccggttacccgg

SEQ ID NO: 228336 - DNA, 645 bp, Homo sapiens
  misc_feature: GYAE6OF02GSXRV.14.85.H08.1.454.CMB.1.raw
  modified_base (226)..(226): a, c, t, g, unknown or other
  misc_feature (226)..(226): n is a, c, g, or t
tcagcgtctagtaccacgaccggtgctcgatttagtatcactcagtcgcggggggggggtctcaggaggcagcgctctcaggacgtcaccaccatggcctgggctctgctcctcctcagcctcctcactcagggcacagggtcctgggcccagtctgccctgactcagcctgcctcgtgtctgggtctcctggacagtcgatcaccatcctcctgcactggaaccngcaggtgtacggtttgggtagtttaataagttatgtctccgtcggtaccaacaaccacccaggacaaaccgcccccaaactcaatgtactttataggaggtacagtaacgtccggtcctcggtagggtttctaacgtcgtcttcttcgtgtcctacacgtcgtgacaacgtccgccctccgtcgacctactccgtcgtcggtcctcgaggtcgtaggaggtacgtagtctacgttatttattagttcgactacgtctactaattgtaccgaccttacgtcgactaacgtacctaacgtcgtacgtttgggttacgggtttccgggggacggggtaacccgtaacggggttaccggtacccggttacggtacgtacggacccgaccggaacggtccgtcccgtccccggtcggttacccg

SEQ ID NO: 228337 - DNA, 660 bp, Homo sapiens
  misc_feature: GYAE6OF02HS3IF.14.85.H08.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (460)..(460): a, c, t, g, unknown or other
  misc_feature (460)..(460): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacgagggtcctgggcccagtctgccctgactcagcctccctccgcgtccgggtctcctggacagtcagtcaccatatcctgcacgtcggaaccngcagtgacgttggngtcttatactttgtctcgtgtacacngcaccagacaacgccccaatcatgtattntgactacaatacgccggcccgtccgggtcctgacgtcgtcttctcgtcggcctactagtcgtcggaccaacgccgtccctcccgtcggacccgttccgtacgtcgggtcctaccggacggtctacggaacgtagtcggacgtacttagttaactttacgttcncgtacacgtacctacacgtagtcgtacgtacgtactaaggttaaccgtttacgggttttccgggggtttaacggacgggtaacgggtaaccgaggtccggttaccgtaaccggttaacgttaaccgcgtaacccggtacccgaacggtcccgttaccccggtccccgttacggttaccctaccgttcccgttaacccccg

SEQ ID NO: 228338 - DNA, 811 bp, Homo sapiens
  misc_feature: GYAE6OF02GIA8H.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcaggtggggcgcaggactgtgaagccttcggacgaccctgtccctcacctgcgctgtcaagtggtcgccgtccctcactaactctctacgtggagtcgtggacctccgaccgaccggcccccggtaggggaacggggcgtagggaggtggtaggtaggggaaatcgaagtacgaaaggtggacgaccaaccgtaacgtaacccgaaccccgtccgtacggaacgtacggtcgtaactaccgaacctaagtactacaaacgtaacgtaaccgtaccgttaccaaagtaacttaccgtaacgtttaccctcccgtaggaacggtccttacggtacctttaccgttaggtacggtaacccgtacgggacccccgggaccgggtaaccgtaacccgggtcgttaacggttacggttacgtttaaccgttgggtaccgggtacggtaacggttacgtttcccgggtttaccgggtcggtttaaccgggtccgttaccgtttccggttacggtaacccggtttacgggacccggggttaccccgggtaaaccgggttaacccggttccgggttaaccccggttacccgttttcgttacccgttccggtacccgttacccccgtcccggtaaaccccggtacccgggttacccccg

SEQ ID NO: 228339 - DNA, 692 bp, Homo sapiens
  misc_feature: GYAE6OF02I21EO.14.85.H08.1.454.CMB.1.raw
  modified_base (164)..(164): a, c, t, g, unknown or other
  misc_feature (164)..(164): n is a, c, g, or t
  modified_base (176)..(176): a, c, t, g, unknown or other
  misc_feature (176)..(176): n is a, c, g, or t
  modified_base (365)..(365): a, c, t, g, unknown or other
  misc_feature (365)..(365): n is a, c, g, or t
tcagcgtctagtaccacgaccggtgctcgatttagtatcactcagtcgcgggggtgctttctgagagtcatggacctcctgcacaagaacatagaaacacctgtggttcttcctcctcctggtggcagcctcccagagtgggtcctgtcccaggtgcagctacngcgaggtgggcncgaggactgttgaacgccgttacggacgcctcgtccctcacgtcgcgtctgtcagtggtgccgtcctatactatctactcgtggactcgtcggactccgccgaccggacccgaggggacggcgtggaggtcggtaggttacgggaatcgagtacgaaggtgacgcaacgacgtaccgaccgtccgtagngtacgtcgtacgtaccactagtactactaaagtacgtaaccgtaccgtaaccgaagtaacgtacgtaccgttcctccggtaacggcgtacgttacgtacctgttacggcgtaaccggtacggccggtacgaccgtacgggtaccgttgtaaccggttacgtttacgccgggttaagaccgttaacgttacgtttccggtacgttccgttagggtcctacgttcggtacgttcccgtaggtccggggaaaccgttcggaacccgtttgtaaccccgtccgttgttcccgtaccgacccgtcggtaacccctcgggtaacttcccccgg

SEQ ID NO: 228340 - DNA, 657 bp, Homo sapiens
  misc_feature: GYAE6OF02F5Z5R.14.85.H08.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (475)..(475): a, c, t, g, unknown or other
  misc_feature (475)..(475): n is a, c, g, or t
tcagcgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctcctccgcgtccggtctcctggacagtcagtcaccatatctgcactggaaccagcagtgacgttggtnacttattaactttntactccgtgtaccaacagccaccaggacaaacgccccaactcatgactttanagacgttanaacgtaacggcggtcccgtcggggtccctgacgtcgtccttcgtcgtcggtactaccgaagttctacggacctaaccgacggtccctcccgtacgacccgttactcgtccggtctaccgacggtcgtagaacgtagtacggacggtctagtaacttacttacgngactacctcgtactaatcgtacgtaccgagtacgtaaacgttaacgttaacggttttcggggttcgtacgggaaacggtaccgaagttccgtacggaacccgttaccgtaacgtaccgaccgtaacccgtaaggtccctacccggccccgtttaccggtaccgtaccctttccgtaccccgg

SEQ ID NO: 228341 - DNA, 808 bp, Homo sapiens
  misc_feature: GYAE6OF02G9P5D.14.85.H08.1.454.CMB.1.raw
  modified_base (158)..(158): a, c, t, g, unknown or other
  misc_feature (158)..(158): n is a, c, g, or t
  modified_base (170)..(170): a, c, t, g, unknown or other
  misc_feature (170)..(170): n is a, c, g, or t
  modified_base (235)..(235): a, c, t, g, unknown or other
  misc_feature (235)..(235): n is a, c, g, or t
tcagcgtctagtaccacgaccggtgctcgatttagtatcactcagtcgcgggggtgctttctgagagtcatggacctcctgcacaagaacatgaaacacctgtggttcttctcctcctggtggcagctccagatgggtcctgtcccaggtgcagctanagcagtggggcncaggactgttgaagccttcggagaccctgtaccctcacctgccgtctgtcaatggtgccggtccngtactaatctctacgtggagtcgtaggacgtcccgccgacgccccccgaaggggaacgggtcggtcgggtagtacgggaacgttagggggaaatcgtaacggttacaaacggttggacgggacctaaccgaaaggtacccgaaacccggtccgtaaccggtacggtaacggtccgacggtaccggaacctacgttaacgtacctaaaacgttaacggaacctaccggtttaccgaaaccggtaacgttacccggttaaacgtccggtttaccccgtaggtaccggtaccgtagtttaacccgtcgtttacgacgtacgacgggtaccgacggaaccgtaccgggtcgttacggtgtttaacttacgtaggtttacggcggtaaacgttcgttaccggttcggtaaccgtttcgggtaccgttacggttcgttacggttaccgttacgggttccggggtaacccggtaacgggggtaaccccgtttacggtacccgggtacccgtttacccgttcccggtttaccgtaccgggttacccccttaacccggtaccccgtaaacgggttccccccg

SEQ ID NO: 228342 - DNA, 756 bp, Homo sapiens
  misc_feature: GYAE6OF02HC7ZN.14.85.H08.1.454.CMB.1.raw
  modified_base (598)..(598): a, c, t, g, unknown or other
  misc_feature (598)..(598): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctccagatgggtcctgtcccaggtgcagcctacagcaggtggggcgcaggactggttagaacgccttcggacgacccctcgtccctccacctgccgctgtcaagtggtcgccgtcccctcaacttatctctacgtggtagcgtggacgtcccggaccaccggacccccggaagggggtaacggggtccgtagggaggtggtacggttagggggtaaactccggtaagtacgtaaaggtggaacggaccaaccggtaacgtacccaaccccgtcccgacggacggtagtaccgacgtccaaccgataactagtaaactacgtaacctacggttacccaaggtaactttacctacgttttacccgtcccgtaacggacggtacgtttaccgtacgtttccgttaggtaacctacggaccggtccggacccgggtacccggtacgtcggttacgttacgtttaagtttaccggnggttacggtacggttacgttaccgtttccggttcggtccggtttaacgggttcctcgttacgtaccgttaccggtccgggaccgggtacccggtaaccgggttaccggtccggtacctaccgttcctcgtaccgcgtccccaccgtaccggcgacccg

SEQ ID NO: 228343 - DNA, 667 bp, Homo sapiens
  misc_feature: GYAE6OF02JNONV.14.85.H08.1.454.CMB.1.raw
  modified_base (172)..(172): a, c, t, g, unknown or other
  misc_feature (172)..(172): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagcgtctagtaccacgaccggtgctcgatttagtatcactcagtcgcggggtgctttctgagagtcatggacctcctgcacaagaacatgaaacacctgtggttcttcctcctctggtggcagctcccagatgggtcctgtcccaggtgcacgctacgagcgagtgggcncaggactggttgaacgccttcggacgtacccctgtccctactaccgtgccgtcgtacgtacaagtcggtcgccgttccctactacttaattcctacgtacgtggactcgtgactccgcctacgaccccggagggacggctggacgtggtagtacgggaatcgacgtagtaacggtggagaccgtaacgaagtaccctaaccgccgtagacggacgtacgacgtccacgtanactacacgtaancgtacgtacaagtactacgtacgttctcgtacgtacgtctagtacttacgtgacgtacgacgccggtacgacgtaccgtacgttagtcgttacgtactcggctaacggtacgttaccgtttcgttacggtccggttacgttctccgtttactccgtacgtcggttaccgggaccgtaaaccggttccgtacgtaccgtacctttacggtcttaacccgtccggtaccccacccggtaccggtaccgtccccg

SEQ ID NO: 228344 - DNA, 726 bp, Homo sapiens
  misc_feature: GYAE6OF02FP1W8.14.85.H08.1.454.CMB.1.raw
  modified_base (172)..(172): a, c, t, g, unknown or other
  misc_feature (172)..(172): n is a, c, g, or t
  modified_base (256)..(256): a, c, t, g, unknown or other
  misc_feature (256)..(256): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgccgctgtcaatggtcgaccgtccctcactaatctctactggacnctggatccgcacgcccccgagggaacggggtctaggacgtggacgttagggggaaatcgagtcaaaaggtggaacggcaaccgaagtaccaaaccccgtccctacggacgagtacgagtaccacctaagtactacaaataacgacctaacggtttacccaagtaaactaccgtaacgtttcccgttaccctaggtacggtccgttacgtaaccgtttcgttaggtacgtaacccgtacggtcccgggaccggtaacgaaccggtccgttagttacggttaactttaccggtcggttcggcgtaagtacgtttccgttttacgggctttacggggtaaccttccgtttaccgttggtaacccttaccgggtacgggggtacccctaaacgggggtaaccccttcggggttaacccaccgggtttaccttccgtacgtccggttccccacccgtacccggagggtaaccccc

SEQ ID NO: 228345 - DNA, 670 bp, Homo sapiens
  misc_feature: GYAE6OF02JGQVJ.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcaggtggggcgcgaggactgttgaagccttcggacgaccctgtccctcacctgcgctcgtcaagtggtcgccgtccctcactaatctactacgtggagcgtggactcccgaccaccggcccccggagggggaacgggcgtcgggaggtgggtagtagggggaatcgaggtacgaaaggtgggaacggaccaaccgtaacgtaacccgaacccgtcccgtacggaggtacggtcgaacgtaccaacgtataacgtactaaagtacgaaccgtaaccgttacaacgtaatccgtaacgtttcctacccgtggacggtctacgttaccttcgttacggtcgacgtacggacccggacgacgcggtcttggtagttacttacggtgtcgacgtagtacgttcgtttaccggcgttacggtacctcgttcgtacgtacgtacggtcgggaccgtaacggtaccgtcggtaccctccgtatcctccgaccgtcctacccgacgtacccggtccg

SEQ ID NO: 228346 - DNA, 633 bp, Homo sapiens
  misc_feature: GYAE6OF02HNZMI.14.85.H08.1.454.CMB.1.raw
  modified_base (589)..(589): a, c, t, g, unknown or other
  misc_feature (589)..(589): n is a, c, g, or t
tcagcgtctagtaccacgaccggtgctcgatttagtatcactcagtcgcgggggtgcttttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgctgtcaatggtgcgtccctcactaatctctactggagctggatccgccacgcccccgagggaacgggcgtagggagtggagttaggggaaactcgaggtacaaaggtggaacggccaaccgaacgtaccaacccgtccctacgagacgtcgacgtcaccatactacaatacgactacgttacagaatctagtttcctacctggacggtctagtacttcgtagtcgacgacggcccggacggacgcggtcttgttagtacttacgtgtggacgagtacgttccgtttcggcgttgggttaccgtcttacgtttcgaccgttacgggtcggggtacccgaacggggttaccccgtgggtcccgtaaccccggttnttccctttacgacccgtccctacccaaccggaacccggtccccg

SEQ ID NO: 228347 - DNA, 686 bp, Homo sapiens
  misc_feature: GYAE6OF02H1Y3Z.14.85.H08.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (489)..(489): a, c, t, g, unknown or other
  misc_feature (489)..(489): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagtcctcctcacctcgacgggcacagggtcctgggcccagtctcgccctgactcacgccctcccgtccgcgtccggtctcgtgacagtcagtaccacatactctgcactcggaaccngcagtcgacgttgngtcttatactttgtactcgtggtaccacncgaccaccgagaccaaccgtccccaatnatagtattntacgatactaataccggtccggtacccggtcggtctaggctccgtactcgtctcgtacctaccgatcgtacgaccacgtaccggtcctaccgtcgtacccgtctacggtccggcgtaccgacgtctacgggactcggtacgggagtacgtacgtaactttacgttactacggggtnaccgttacctacgtacgtacgtactacgtaacgtaacgtaacgttaaccggttttacggtttccggggtttaacgggcgggtaaaccgggacttaaccgggtctacccggtaaccgtcgtaaccgtaccgacccgtaaccgaccgttacccgtcccggtaaccctcccgggtacctacccgttccgttaccccccgg

SEQ ID NO: 228348 - DNA, 732 bp, Homo sapiens
  misc_feature: GYAE6OF02G2ID9.14.85.H08.1.454.CMB.1.raw
  modified_base (557)..(557): a, c, t, g, unknown or other
  misc_feature (557)..(557): n is a, c, g, or t
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctcgtcaatggtgccgtccctcactaatctctactggagcgtggactccgccacgacccccggagggaacggggcgtgggacgtggtacgttaggggaaatcgagtacgaaaggtgggacgaccaccgaacgtaaccgaaccccgtcccgtacgagacgtccgagtaccaaccgatatacaatacgaacgtacgttaccgaagtaactacctacgtttccctacccgtaggtaaccgggtccttacgtactttccgtaggttcgaacgtacggcccggtacggaaccgacggtcgttgttacgttacttacgtggtcgaacgtagtacgtttacgtttccggtntttccgggtaaccgttccgttacgtttacggacccgtttacgggtacccggggtaccggtaacggggttaaacccccgttggggttaaccccgtacccggttttcccttaccgtttaaccggtaccccgtacccccggtttacccgaaccccgggtaacccgggttaaccccccg

SEQ ID NO: 228349 - DNA, 645 bp, Homo sapiens
  misc_feature: GYAE6OF02I0R10.14.85.H08.1.454.CMB.1.raw
  modified_base (460)..(460): a, c, t, g, unknown or other
  misc_feature (460)..(460): n is a, c, g, or t
tcagcgtctagtaccacgaccggtgctcgatttagtatcactcagtcgcggggggggggtctcaggaggcagcgctctcaggacgtcaccaccatggcctgggctctgctcctcctcagcctcctcactcagggcacagggtcctgggcccagtctcgccctgactcagccctccctccgcgtccgggtctcctggacagtcagtcaccatactcctgcactacggaaccagcagtgacggttggtgtacttatactttgtctccgtaggtaccaacagaccaccgaggacaaaccgacccccaaactcatagtatttagtacgacgtacaagtaacggccggtcccggtccggggttcctacgtacgtccggtcttccgttcgtcggtccttaaccgaagttcgacggacaaccgtaccgtccctacccgtacgaccctcgtcgtcggctaccgcgtcncgacgtagtaggacgtactagttattactacgtcacgtacgctacatatcgacgtacgtctaaacgttacgttacggtttacgggttagggacggaacggacgagtaccgtggtacccgtcggtacgacgtaccgtaccgtacggtcccgtccgtccccgtacggtcctaccgttcccgtcccgg

SEQ ID NO: 228350 - DNA, 801 bp, Homo sapiens
  misc_feature: GYAE6OF02GM8P4.14.85.H08.1.454.CMB.1.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagccctcctccgcgtccgggtctcctggacagtcagtcaccattactcctgcactggaaacccagcagtgacgttggnctttaataactttgtctcctaggtaccaacagaccaccgacggaccaaacgaccccccaaactactatagtaacttttangtaactacaagtaacggccggtacccgtcgggggtacccttgacttccgtcttccgtacgtcggtccttaccgaacgttcgaggtaccgaaccgacccggtcccttacccgtacggtacccgttccgttaccgttcggggcccttacccggaacgggtcccgtaacggtaccggtaatcggtaacgggtcctttagggtaaacttttaacgttaaccttacgaccgtacggaccttacctaacctatacgggtacctaaggtacggtaaagttaaaccgtttaacgggttttttacccggggggttttaccgggaaccggggtaacgggtaaacccgtaacgggtacctaaccggggtaccccgttaaccggttaaaccgtaaccggtaccggtaaacccccgtaaggggcccccgttaacccgggttacccccccggttacggtacccgttacccgttccggttttaacccccccgg

SEQ ID NO: 228351 - DNA, 670 bp, Homo sapiens
  misc_feature: GYAE6OF02FK2FW.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcaggtggggcgcaggactgttgaagccgttcggacaccctgtccctcacctgcgtctgtcaagtggtcgccgtccctactactaacttctacgtacgtggacgcgtggacgtcccgcccgaccggacccccggaaggggacgggcgtgggcggtgggtagtacggggaatcgagtacgaaggtggaggaccacgtaacgtacccaacccgtcctacgagtacgtcgtacgtaccacctatactaccgtaagtacgaacgtacgttaccgaagtaactactacgttcctaccgtgacggtcgtagtcttcgtgtacgacgcgccggacgtacgcgtcgttgttacgtactatgtacgcgtagtctttcgttcggtcgttacgttcgtcttcgtacgttacggttacggtcccgggtaccggtaaccgggtccccgttacgggtacccgttaccggttccgttaccgtccgtacccgttacccgtaccccgaccgggtaccgtaccccgg

SEQ ID NO: 228352 - DNA, 748 bp, Homo sapiens
  misc_feature: GYAE6OF02I8CFM.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagcctcccagatgggtcctgtcccaggtgcagctacagcaggtggggcgcaggactgttgaagccttcggagacccctgtccctcacctgcgctgtcaatggtcgccgtccctcactaactctactacgtggacgctggactcccgccacgccccccgaaggggaacggggctagggaggtggtagttagggggaaactcgtaggtacgaaaggttcgggaggaccaaccgaagtaccgaaccccgtcccgtcgagtacgtcgacgtaccaccatactacaaactacggaacctacgttacccgaagtaacttccgtaacgtttcccgtacccgtgaccggtactacgtacctttcgagttcgaccgtacggcccggacggtaaccgaccgggtcttaggttacgttacttacgtcggttcggacggttacggtacgttttccgtttcgggtaccgtttcgggttaaccggtccttttacggttacgttaaccgttacgggtaccggggtaacccgttaacggggggttaaccccttcgggggttaaccccttaccgggtttcccgtttaccgttacccgacccggttaccccgtacccgaaccccggtaccggggtaccccg

SEQ ID NO: 228353 - DNA, 692 bp, Homo sapiens
  misc_feature: GYAE6OF02J2HF0.14.85.H08.1.454.CMB.1.raw
  modified_base (220)..(220): a, c, t, g, unknown or other
  misc_feature (220)..(220): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
  modified_base (563)..(563): a, c, t, g, unknown or other
  misc_feature (563)..(563): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcacctcagggcacgacgggtcctcgggcccaggtctcgcccctgacctcgacgtcccgtccctccggtccggtcccgggtctcccgtagggaaccnggttccaggtccacctacttaactccgtcgacctacgtacggaaccacgtccaggtcgtacggttggtcgtacttacgttacgtttcgtcctccgtacgtaaccacgacgcctaaccggacgaaccaaccgtacccctaagtctagtcgtattacagtacactaacggtaccggccgttcccggtcgggtactcgtaccgtccttccgtccgtctcggtacctacgacgtcgtacggaccctaccgaccgtccctcgtaccggtcctcgacgtccggtctaccgagtcgngtaaccnggtacgtacgtntactagttccacgctcagccttacactcggtacncgttataccggtaattaccgggttagggtttccgggaaacgtcggtacgacttcgacgtaggtaccctaggacctgaaacccgtcgccggtacctacccggccttacggacgtcccttacgtacccccg

SEQ ID NO: 228354 - DNA, 690 bp, Homo sapiens
  misc_feature: GYAE6OF02GT1EN.14.85.H08.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (270)..(270): a, c, t, g, unknown or other
  misc_feature (270)..(270): n is a, c, g, or t
  modified_base (345)..(345): a, c, t, g, unknown or other
  misc_feature (345)..(345): n is a, c, g, or t
tcagcgtctagtaccacgaccggtgctcgatttagtatcactcagtcgcgggggggggtctcaggaggcagcgctctcaggacgtcaccaccatggccctgggctctgctcctcctcagcctcctcactcgagggcacagggtcctgggcccagtctcgccctgactcacgtcctccctcgcgtccgggtcctccgtggaccngtcagtccaccatctcctgcctactcggaaccnggctagtgacgtttggcactttaacttacgtttnccgttccgttcggtaaccaacgtagacccgtaacccgaggaccaaacccggcccccaaactctactgtactttancggtaacgtacaaagtacggcccggtacccgggtccggggttccctaggccttacggcctttcgcgtcgacctacgagttcgacggaccacgaccgtaccctcctcggtaccctgtcgtccggctccgagtctacgagacgtaggcgtctaggtacttacgtacgttcgtacgcttactccgactacgtccgactagttacgaacgtttacggtttaaggtttccggggttacggacgggtaaccggtatacggtaccgtcgtaacccgtcgtttaacggacctacggttacccgaacggtccctacccggacccgttacccgaccgttccggtaccttccccgg

SEQ ID NO: 228355 - DNA, 853 bp, Homo sapiens
  misc_feature: GYAE6OF02F1AHS.14.85.H08.1.454.CMB.1.raw
  modified_base (117)..(117): a, c, t, g, unknown or other
  misc_feature (117)..(117): n is a, c, g, or t
  modified_base (189)..(189): a, c, t, g, unknown or other
  misc_feature (189)..(189): n is a, c, g, or t
  modified_base (281)..(281): a, c, t, g, unknown or other
  misc_feature (281)..(281): n is a, c, g, or t
tcagcgtctagtaccacgaccggtgctcgatttagtatcactcagtcgcgggggggggtctcaggaggcagcgctctcgaggacgtcaccaccatggcctgggctctgctcctcctnagcctcctcactcagggcacagggtcctgggacccagtctgccctgactcagccctcctccgcgtccggtcncctggaccagtcagtccaaccgatactcctgccatcggaaccaggcagtgacgttgtgactttagtaacttgtctccgtacggtaccaaacncgtaccacccgaggtacccaaaaccgtaccccccaaaacgttccaaagtcgtaacgtttaatcgtaaaccggtaccgaaaagtttaaacggaccgggtccccgtaccggggggttaccccttacggtaactccggtttaccctttacgtccggttcggacccgttaacccggaagtttcccgtacggggaacaaacccgtaccgggtacccccgtttacccgtaaccgttacccggtcccgttaaccgggttcgggtacccgtacccgaaccgggtaccggtaacgtaaccgggtaacgttaacgggacgggtaccggttaacgttaagttttaaccgttaacgttacgtccgtaaccgtacccggttaaccgtacgtacgtcgtaccggtaccgtaaccgtaaacgttaaaccgtttaacgggttttccggggggttttaacgggaccgggtaaccgggtaaccgtacggtacgttaccggaaccgttacggtaacgtacccgaccggtaacccgtaacggtcccgttacccggtaccccgttccgttacccgtaacgtcccttaacccgg

SEQ ID NO: 228356 - DNA, 676 bp, Homo sapiens
  misc_feature: GYAE6OF02IGCZI.14.85.H08.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (499)..(499): a, c, t, g, unknown or other
  misc_feature (499)..(499): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgcctgactcagccctcctcgcgtccggtctccgtgacngtcagtcacntactctgcacgtgaaccngcagtgacgttggncttatactttntctctggtaccanacgccaccgaggacaacgacccccaacnctatgtactttagcgtacgactaagtacgccggtcccgtccggggtcctgactcgtccttcgtcgtcgtacctacgtaacgtcgcggtacaaccgaccggtcccttacccgtcgtaacccgttccgtacggtccggtacctccgtacggtccgtacggacgtacgtcggacggtacgtagtaacgttttactacgttcgtacacggttaccnctacgtaacgtcgacgtaacgtcgtaacgtttaaaccgttagggtttttaccggggttacggtaacgggaacgggtaaccgacgtacggtcgttacccggtagtaccggacgaacccgtacgaacggttcccgacccggtccccgttacggtacccttccggtccgttaccccccgg

SEQ ID NO: 228357 - DNA, 854 bp, Homo sapiens
  misc_feature: GYAE6OF02GSWRZ.14.85.H08.1.454.CMB.1.raw
tcagcgtctagtaccacgaccggtgctcgatttagtatcactcagtcgcgggggtgctttctgagagtcatggacctcctgcacaagaacatgaaacacctgtggttcttcctcctcctggtggcagctcccacgagtcgggtcctgtcccaggtcgcagctacgaggcacggtggggcgcaggacttgttgaacgtccgttcggacgtacccgtcgtccctacacctcgcgtctgttcaagtggtccgaccgtccctacgtactaacgtctactacggtacgcgtcggtcggacctccgcccgtaaccgacccccggtaagggggacggggtcgtaggtacggtggtaacggttagggaacgtacgtacggttaacgaaacggttaggacggacctaaccgaaggttaccccaaaccccgggttccgtaacggacgtacggaccgtaagttacccaaaccgttaatacgtaacgaaaacgttaaggacccttaccgttaaccgaattaacgtccttaaccggtttacccgtcgtaccggtaacggtaccgttacgttacctttacggtggtaaacgtccgaaccgggtaccggaccgggaaccgtacgggtaccggttagttaaccgtttattaccggtcggttccgggaataagggttccgtttacgtttacgggttacgtaccggggttaccgtcgtttaacgtccgtttaaccggtacgggggttcccggaaaccggggttaaccccgggttaacggttccgggtaaccccgttaccggtttaacctttcccggttaaccgtaccccgtaccgtttaacccggaacccggttaccccgggttacccccgg

SEQ ID NO: 228358 - DNA, 769 bp, Homo sapiens
  misc_feature: GYAE6OF02JVM59.14.85.H08.1.454.CMB.1.raw
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
tcagcgtctagtaccacgaccggtgctcgatttagtatcactcagtcgcgggggggggtctcaggaggcagcgctctcaggacgtcaccaccatggcctgggctctgctcctcctcacgcctcctcactcacgggcacgagggtcctcgggcccagtcctcgccctgacctcacgtccctccctccgccggttccgggtcctccgtggactacgtcacgtccacctatactccgtcgcacgtacggaaccacgcgtacgtacggtccgtttgggtacgtaccttaacttaacgttttgtccttaccgtacggtaaccaaacacgaccgaacccgaggtaacccaaccgaccccctaactccgtactacgtacttacncggttaacctanaacgtacggtccggtacccggttccgggtacctagtacgtcgtaccttcgtccgtacgtcctacgtagtctagtaccgacgtccgtcctccgtcgtaccgttcgccggtacggtcctccggtagccggtacgacgacggttacgacgtcgtacttagtcctacgcgtacctacgttccacgttacacgttacaccggttacgtaaccgtaacggtttaaccggtttccgggtttttaccggggtaaccggtagggaaccgtacgtaacggttccgtaccggtaacccgttaacgttaacctacccggaaccttaccgggaaccgttcccgttaacccggtcccgttaccgttaccgttaccgttccctttacccccgggg

SEQ ID NO: 228359 - DNA, 534 bp, Homo sapiens
  misc_feature: GYAE6OF01AX948.4.49.E05.1.454.CMB.1.raw
  modified_base (410)..(410): a, c, t, g, unknown or other
  misc_feature (410)..(410): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttagtcatgtatcaaacttcgaggcgcccctcaggagtccctgaacgctttcgggctccaagtctggggacacagccactctgactattaccgggcccagggccatcgatgagggagacttttacngtcagggcgtggacagcacacttccatctcggcgagggacaggatgaccgtcgtggtccagcccaaggcctgcccccgtcggtccaccgtcctcgttcccccgcccttccctcccgtactaccg

SEQ ID NO: 228360 - DNA, 527 bp, Homo sapiens
  misc_feature: GYAE6OF01CVT76.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttagtcatgtatcaaacttcgaggcgcccctcaggagtccctgaacgcttttcgggctccaagtctggggacacagccactctgactattaccggggcccaggccatcgatgagggagacttttactgtcaggcgtgggacagcacaacttccatcttcggcggagggacacggatgaccgtctgggtcagcccaaggctgccccctggccactcctcgttccccaccctcctcctctacgg

SEQ ID NO: 228361 - DNA, 605 bp, Homo sapiens
  misc_feature: GYAE6OF01CCKAM.4.49.E05.1.454.CMB.1.raw
  modified_base (531)..(531): a, c, t, g, unknown or other
  misc_feature (531)..(531): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctaggaaacaacgttggggtccagatatgtttcctggtatctccagacggccaggccactcccctattttacgcatgtatacaaacttcgaggccgccctcacggcgtccctagaaccgtcgttttccgggctaccgaaacgtcgtacggggaccacgacggcctaactcgtacgaacttacggttaccccggggaccctagggcccagtcgaagtcggaagggtacgtaacttttacgtgtacgagggtcggtagggaccagcaactaacttccattcgtacgggcggaaggacacggatcgaccgtcgnggtccacgacccgagccgtccgcccccgtcggtccaccttcgtcccgttccccgcccttccctcctacgtaccg

SEQ ID NO: 228362 - DNA, 552 bp, Homo sapiens
  misc_feature: GYAE6OF01CGMU9.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaacaacttggggtccagatatgtttcctggtatctccagaggccaggccactcccccattttagtcatgtatcaaaacttcgaggcgcccctcaggagtccctgaacgcttttcgggctccaagtctggggacacagccactctgactattaccgggccaggccatcgatggagggagtacttttactgtcagggcgtgggacagcacaacttccatcgttcggcggagggacacggatggaccgtccgtgggtcacggacccgaaggcctcggacccccctgggtacccaccttcgtcgttcccccgccctccctcctaccgtacgg

SEQ ID NO: 228363 - DNA, 586 bp, Homo sapiens
  misc_feature: GYAE6OF01BQDK1.4.49.E05.1.454.CMB.1.raw
  modified_base (325)..(325): a, c, t, g, unknown or other
  misc_feature (325)..(325): n is a, c, g, or t
  modified_base (437)..(437): a, c, t, g, unknown or other
  misc_feature (437)..(437): n is a, c, g, or t
  modified_base (487)..(487): a, c, t, g, unknown or other
  misc_feature (487)..(487): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggaccggacagccgtcatgacctgctctaggaacaacgttggggccagatatgtttcctggtatctcagaggccaggccacctccccctattttacgtcattgtactacaaacttcgacggccgcccctnacggacgtcccctgaaccgtcgttttccgggcttaccgaagtcgtgggacacgacgccactctcgactacgttacccgggccaggccatcgatcggaggtagtactttacgngtcgaggtcgtggacagcacaacttcatcgtcggcggagggacacggtancggtaccgtcgtgggtccacggacccaaggtccgtaccggcccccgttcggtacctaccttccgtcccgttacccccacccttccctccgtccgtacgg

SEQ ID NO: 228364 - DNA, 707 bp, Homo sapiens
  misc_feature: GYAE6OF01ERMU0.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatcccctctcttcctcggcgtccttgcttactgcacgaggagttccggggcctcctatacaactgactcacgcccaccctcagtcgtccgtcctccccgaggaccggacacgccgtcatcgacctgctcgtaggaaactacgttcggggtaccagatattcgtttccgtggtactcctaccaggacggccgacggccacccctcccccttaatttttacgcctagttgttactacctaaaaccgttcggacggcccgtcccctagaacgggtaccttccccgtaggaaccgttccgttttccgggcctaccgaagtcggtaggggaccacgacgacccactcgtacgtaacttacggttacccggggcccacggaccagtacgagtcgggagggtacttaacttttacgtgtacgagggtcggtagggacagccaactaccttcattccgtacgggacgggtaggaccgacggtatcggacccgtcgtgggtaccaccggacccgaacgggtcctacccgggtccccccgttcggtaccctaccgttcccgtttcccggttaccccccaaccccctttccccttacccgtaaccgtaccggg

SEQ ID NO: 228365 - DNA, 538 bp, Homo sapiens
  misc_feature: GYAE6OF01BZR6P.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccatttagtcatgtatcaaacttcgaggcgcccctcaggagtccctgaacgtcttttcgggctccaagtctggggacacagccactctgactagttacccggggcccaggccagtcgatgagggatacttttactgtcaggcgtgggacagcacaacttccatcgttcggcggagggacacggatcgaccgtccgtgggtcacgcccgaggcctcgccccgtcggtccacctctcgttccccaccctcctcctctacg

SEQ ID NO: 228366 - DNA, 541 bp, Homo sapiens
  misc_feature: GYAE6OF01B9C0S.4.49.E05.1.454.CMB.1.raw
  modified_base (410)..(410): a, c, t, g, unknown or other
  misc_feature (410)..(410): n is a, c, g, or t
  modified_base (506)..(506): a, c, t, g, unknown or other
  misc_feature (506)..(506): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccatttagtcatgtatcaaacttcgaggcgcccctcaggagtccctgaacgctttcgggctccaagtctggggacacagccactctgactattaccggggcccaggccatcgatgagggagacttttacngtcaggcgtgggacagcacaactccatcttcggcggagggacacggatgaccgtccgtgggtcacgccccaagggccttcggcccccttcgggccnccgtcctcgttccccacccttccctccctacgtcg

SEQ ID NO: 228367 - DNA, 538 bp, Homo sapiens
  misc_feature: GYAE6OF01AQ2W0.4.49.E05.1.454.CMB.1.raw
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttagcatgtatcaaacttcgaggcncccctnaggagtccctgaacgctttcgggctccaagtctggggacacgagccactctgactagtacccggggccaggccagtcgatggagggtacgtacttttacgngtcaggcgtgggacngcacactccatcgtcggcggagggacacggatcggaccgtcgtgggtcacggcccaaggcctcggccccctggtccactcctcgtccccaccctcctcccgtcgtcg

SEQ ID NO: 228368 - DNA, 520 bp, Homo sapiens
  misc_feature: GYAE6OF01BEJ55.4.49.E05.1.454.CMB.1.raw
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccatttagtcatgtatcaaacttcgaggcgcccctcaggagtccctgaacgctttcgggctccaagtctggggacacgagccactctgactagttaccggggcccaggccatcgatgagggatactttacngtcaggtcgtgggacagcacactccatctggcggaggacacggntcgaccgtcgtgggtcagcccaaggcctgcccctggtccactctcgtccccacctcctcctctacg

SEQ ID NO: 228369 - DNA, 582 bp, Homo sapiens
  misc_feature: GYAE6OF01DS0ME.4.49.E05.1.454.CMB.1.raw
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
  modified_base (550)..(550): a, c, t, g, unknown or other
  misc_feature (550)..(550): n is a, c, g, or t
  modified_base (574)..(574): a, c, t, g, unknown or other
  misc_feature (574)..(574): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacgttggggccagatatgtttcctggtatctccagacggccaggccactccccctattttagcatgtactcaaacttcgacggccgcccctcaggacgtcccctaggaaccgtcgttttccggggcctccgaaggtcgtggggaccacacggcccaactcctagaccttacgttacccggggcccagggcccagtcgagtggagggtattactttacgngtacgagggtcgtgggacngcactaacttccagtccgttcgggacggagggacgacggatcggcccgtcgtcggtcacgacccaggcctcgcccctcggccnccgtcctcgttccccacccttccncctcgtcg

SEQ ID NO: 228370 - DNA, 616 bp, Homo sapiens
  misc_feature: GYAE6OF01AXLNL.4.49.E05.1.454.CMB.1.raw
  modified_base (452)..(452): a, c, t, g, unknown or other
  misc_feature (452)..(452): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccacctccccctattttacgtcatgtatcaaacttcgaggccgcccctcacggacgtccctggaaccgtcttttccggggccttccgtaagttcgtcgggggaacacgacggcccactctacgactacgttacccggggcccagggcccagtccgagtcggaggggtacgtacttttacgngtcgagggtcggttgggacagccactaacttccatcgttcggcggacgggtacacgggtatacggaccgtccgtgggtacacggcccgaagggtcctccggcccccgttcggtcctaccgttccgtccggttacccccgccccttcccttcccgtacgtaccgg

SEQ ID NO: 228371 - DNA, 543 bp, Homo sapiens
  misc_feature: GYAE6OF01BPGGQ.4.49.E05.1.454.CMB.1.raw
  modified_base (421)..(421): a, c, t, g, unknown or other
  misc_feature (421)..(421): n is a, c, g, or t
  modified_base (436)..(436): a, c, t, g, unknown or other
  misc_feature (436)..(436): n is a, c, g, or t
  modified_base (482)..(482): a, c, t, g, unknown or other
  misc_feature (482)..(482): n is a, c, g, or t
  modified_base (509)..(509): a, c, t, g, unknown or other
  misc_feature (509)..(509): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttacgtcatgtatcaaacttcgaggcgcccctcaggacgtccctgaacgtcttttcgggctccgaagtcgtcggggacacgagccactctgactagttacccggggcccaggccatcgagtgagggatactttacngtcaggtcgtggacngcacactccatcgtcggcggaggacacggatcgacgtccgtggtcncgcccgaaggctcgccccgtcggtccncctcgtcgtcccccaccctccctccgtccgtacg

SEQ ID NO: 228372 - DNA, 634 bp, Homo sapiens
  misc_feature: GYAE6OF01D3OVC.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatcgacctgctctaggaaacaacgttggggtccagatatgtttcctggtatctccagacggccaggccacctcccccattttacgcatgtatcaaacttcgaggccgcccctcgacggacgtccctagaaccgtcgtttcgggctccgtaagtcgtggggacacacgccactctcgactacgttaccgggcccaggccaagtcgagtggaagggtagtactttacgtgtacgagggtcgtgggacagcaacgtaacttccagttccgttaccgggcggacgggaccacgggtactcggacccggtccgtagggtccaccggacccgaacgggtcccgtaccggccccccgttcgggttaccctacccgttcccgttacccggttccccccgtacccctttccccgttcccgtaaccggtaccgg

SEQ ID NO: 228373 - DNA, 661 bp, Homo sapiens
  misc_feature: GYAE6OF01BVLVN.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatcgacctgctctaggaaactacgttggggtccagatatgtttcctggtatctccagacggccaggccacctccccctatttacgcatgtactacaaacgttcgacggccgtcccctgacggacgtcccgtgtaaccgtccgttttccggggccttccgaaggtccgtggggaccacgacgcctaccgtctacgtaccgtacgttacccggggcccacgggtaccagtcggagtggacgggattaccgttttacgcgtacgagggtcggtgggacagcctaacgtaccttccagttccgtacgggacggagggtaaccgtacgggtacgtcggtacccggttccgtacgggtaccaccggacccgaaggtcccgtacccggtcccccgttccggtacctacccgttccgttcccggtttcccccgaccccttcccgtcccgtaccgtacgg

SEQ ID NO: 228374 - DNA, 624 bp, Homo sapiens
  misc_feature: GYAE6OF01DOPDS.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtctccccaggacggacagccgtcatgacctgctctggaaacacgttggggtccagatattgttcctggtatctccagaggccacggccacctcccccctattttacgtctattgtataccaaaacttcgacggccgcccctgacggcgtccctgaaccgtctttccgggctccgaagtcgtggggacacgacgccactctcgactacgttacccggggccctaggccagtcgagtggagggtattacgttttactgtcgagggtcggtgggacagaccactaacttccatcgttcgggacggtaggggacacgggtactcggtacccgtcgtcgggtacaccggtcccgaacgggtcctacccggtcccccgtccgggtcctacccgttacccgttcccggttacccccgccccgtttcccctcctacccgtacgg

SEQ ID NO: 228375 - DNA, 540 bp, Homo sapiens
  misc_feature: GYAE6OF01BV6HL.4.49.E05.1.454.CMB.1.raw
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (408)..(408): a, c, t, g, unknown or other
  misc_feature (408)..(408): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccatttagcatgtatcaaacttcgaggcnccctnaggatcccngaacgtctttcgggctccgaagtctggggacacagccactctgactagttacccgggcccaggccatcgatgagggatactttangtcagggtcgtgggacagcacaactccatcgtcggcgagggacacggatcgaccgtcgtggtccaggcccgaaggcctcgcccccgtcggtccacgtcctcgttacccccacccgttccctccgtacgtacg

SEQ ID NO: 228376 - DNA, 578 bp, Homo sapiens
  misc_feature: GYAE6OF01CYR3N.4.49.E05.1.454.CMB.1.raw
  modified_base (560)..(560): a, c, t, g, unknown or other
  misc_feature (560)..(560): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtcctccccgaggaccggacacgccgtcatcgacctgctctaggaaacacgttggggtccagtatattgtttcctggtatctccagacggccacggccacctcccctattttacgtcattcgtactacaaacttcggacggccgcccctagacggacgtcccgtagtaaccgtcgttttccgggcttaccgaagtcgtggggacacacgccactctcgactacgtacccggggccaggccatcgagtggaggtatactttacgcgtacgaggcgtaggacacgcaactactccatcgtcggcggagacacggctcgccgtcgtggtcacgccgaacggtcctccgccccgtcgccaccgtccgtccgtccccncccttcctccgtacgtcg

SEQ ID NO: 228377 - DNA, 677 bp, Homo sapiens
  misc_feature: GYAE6OF01BC3YM.4.49.E05.1.454.CMB.1.raw
  modified_base (470)..(470): a, c, t, g, unknown or other
  misc_feature (470)..(470): n is a, c, g, or t
tcagagcactgtagcacgaccggtgctcgatttagagcgactagcaacgtacggacaaaggggctgggcctcaggaagcagcatcggaggtgcctcagccatggcatggatccctctcttcctcggcgtccttgcttactgcgacaggattcggggcctcctatcaactcgactcacgccaccctcagtcgtccgtctccccgaggaccggacacgccgtcatcgacctgctctaggaaactacgttggggtaccagtatatgttcctggtatctccagacggccacggccacctacccctatttacgtctagttcgtactactaaacgttcgacggccgccctgaggacgtcctagtaccgtcgtttccggctacgagtcgtcgggacacgacgcctacgtctacgtaccgttacgttacccgggaccacggaccacgtacgagtacggagggtacgttacgtttacgngtacgagggtcggtacgggacacgctaactacgttccacgttccgtacgggacgggacgggtacggtacggtcgtacgtaccggtcggtacgggtaccgaccggtacccggaacggtcccgtacccgggtcccccgttcgggtaccctcccgttacccgttcccggttacccccgtccccgtttacccgtccccgtaccgtaccggg

SEQ ID NO: 228378 - DNA, 582 bp, Homo sapiens
  misc_feature: GYAE6OF01EO5CF.4.49.E05.1.454.CMB.1.raw
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttacgtcatgtatcaaacttcgaggcgcccctnaggcgtccctgacgtctttcgggctccaagtcgtggggacacgacgccactcngactacgttacccgggcccaggccagtcgagtggagggtagtacttttacgtgtcgaggcgtgggacagccactaacttccagttccgttcggcggagggtaccgacggtagtcggaccgtccgtgggtaccacggcccgaacggccgtccggcccccgtcggtaccctaccgttccgtccgttcccccgcccctccctcccgtcgtacgg

SEQ ID NO: 228379 - DNA, 590 bp, Homo sapiens
  misc_feature: GYAE6OF01AETDX.4.49.E05.1.454.CMB.1.raw
  modified_base (427)..(427): a, c, t, g, unknown or other
  misc_feature (427)..(427): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgttcctggtatctccagaggccaggccacctccccctattttacgtcatgtatcaaacttcgaggcgcccctcaggacgtccctgaacgtctttcgggctccgaagtcgtggggacacgacgccactctgactacgttacccggggcccagggccagtcgatggagggtagtacttttacgngtcgagggtcggtagggacagacacaacttccagttccgttcgggaccggaggggtaccacgggtatcggaccgtccgtgggtccacggacccgagggtccctccggcccccgtcggtaccacccttcgttccgttcccccgccccttccctccgtcgtccgg

SEQ ID NO: 228380 - DNA, 564 bp, Homo sapiens
  misc_feature: GYAE6OF01EM789.4.49.E05.1.454.CMB.1.raw
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttacgcatgtatcaaacttcgaggccgcccctcgacggacgtccctgaacgtcgtttcgggctccgaagtcgtgggacacagccactctgactacgttacccggggccaggccagtcgatggagggtatacttttacngtcgagggtcgtggacngcacacttcatcgttcggcggagggacacggatcggaccgtccgtggggtcacggcccgaagggcctcggcccccgttcggtccaccgttccgtccgttccccaccccttccctccctcgtacgg

SEQ ID NO: 228381 - DNA, 879 bp, Homo sapiens
  misc_feature: GYAE6OF01C2ZJ4.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcgggcctcctatcaactgactcacgcccaccctcagtcgtcccgtcctccccgaggaccggacacgccgtcatcgacctgctacgtaggaaaactacgttcggggaccaagtattagttcgtttacccgtaggttaactccgtaccgaggaccggacccgacggaccctaccctccccctaagtttttaccgctaagttcgtaacttaccgtaaaaccgttccggaacggtccccgtacccccgttacgaacgggtaaccgttcccccgtaacggtaacccggttcccgttttttaccgggggacccttaacccggtaaacggttcccgggtacggggaacctaaccgtaccggaccctaaccgttccgtacggtaaccgttaaccgggttaaccccgggggaccctacgggacccctaagttacccgggaaggttacgggaaacgggttaccggttttaaacctttttacccggaggtttaaccggaacgggggttccgggttaacggggaaacccgtacggtaaccccttaaaccggttaaaccttttaccccgaaggtttccccggttaccggggggaccgggaaaccgggtaccgtaacgggtactacccgggtaacccggtccggtacgggtaccaacccgggcccgaaccggtcccgtacccgcccccgttggtccctaccgttcccgttcccgtaccccgtcccccttccgtcccgtacttccggg

SEQ ID NO: 228382 - DNA, 588 bp, Homo sapiens
  misc_feature: GYAE6OF01EGD12.4.49.E05.1.454.CMB.1.raw
  modified_base (319)..(319): a, c, t, g, unknown or other
  misc_feature (319)..(319): n is a, c, g, or t
  modified_base (566)..(566): a, c, t, g, unknown or other
  misc_feature (566)..(566): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacgttggggtccagatatgtttcctggtatctccagaggccaggccactcccccattttagcatgttactcaaacttcgaggcgcccctnacgagtccctgaaccgtcttttcgggctccgaagtcgtggggactacacgccactctcgactaacgttacccggggaccagggcccaagtccgaagtggaacggggtattacgttttacgtgtacgagggtcgtagggacagcaactaacttccagtcgttacggacggacgggacacggatcggaccgtccgtgggtcagcccgaggcctcggcccctcggtcctaccgtccgttccgttaccccncccttccctccgtacgtaccgg

SEQ ID NO: 228383 - DNA, 523 bp, Homo sapiens
  misc_feature: GYAE6OF01D2XB1.4.49.E05.1.454.CMB.1.raw
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (348)..(348): a, c, t, g, unknown or other
  misc_feature (348)..(348): n is a, c, g, or t
  modified_base (414)..(414): a, c, t, g, unknown or other
  misc_feature (414)..(414): n is a, c, g, or t
  modified_base (457)..(457): a, c, t, g, unknown or other
  misc_feature (457)..(457): n is a, c, g, or t
  modified_base (495)..(495): a, c, t, g, unknown or other
  misc_feature (495)..(495): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagagccaggccactccccattttagcatgtatcaaacttcgaggccnccctnaggactccctgaacgtctttcggctccaagtcgngggacacgacgccactctcgactacgttaccggggcccaggccatcgatggagggagtactttacngtcagggcgtggacagccatactcatcgtggcggaggacaggntcgaccgtctggtcacggccaggcctcgcccctggccnctcctcgttccccacctccctctcgtcg

SEQ ID NO: 228384 - DNA, 561 bp, Homo sapiens
  misc_feature: GYAE6OF01C6J7U.4.49.E05.1.454.CMB.1.raw
  modified_base (417)..(417): a, c, t, g, unknown or other
  misc_feature (417)..(417): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactccccatttagtcatgtatcaaacttcgacggcgcccctcaggagtccctgaaccgcttttcgggctccaagtctggggacacagccactctgactagttacccggggcccagggccatcgatgagggtagtacttttacngtcaggtcggtgggacaggcacaaccgtttccattccgtcggcggagggacacgggatcgccgtccgtgggtcaggcccgaaggccgtcgcccccgtcgggtcctacgttcctccgttccccaccccttccctcccgtactacg

SEQ ID NO: 228385 - DNA, 746 bp, Homo sapiens
  misc_feature: GYAE6OF01C0S2D.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcgggcctcctatcaactgactcagccaccctcagtgtccgtctccccaggacggacagccgtcatgacctgctctaggaaactaacgttggggtaccagatatgtttcctggtactctccagacggccaggccacctcccctatttacgctatgtactcaaacttcgaggcctccctgacggactcccgtagtaaccgtcgttttccgggcttccgaacgttcgtacggggacaacgcggaccctacgttaccgtcgtaacgtaccggttacccggggacccaacggggacctaacgttccggaagttcgggaacgggtacgttacgttttacgcgttacggacgggtcgggttacgggaaccgtacggacctaaccgtaaccgtttcccgaacgtttccggttaccggggaccgggtaaacggggtaccgaaccggggtacttaccgggaccccgttccggttacggggttacccgaaccggtacccccggaaacggggtcccctacccgggtacccccccggttggtaaccccgttaccttcccgttaccccggtttacccccctaccccgttccccgtacccgtccgttaacccggg

SEQ ID NO: 228386 - DNA, 545 bp, Homo sapiens
  misc_feature: GYAE6OF01ERIXV.4.49.E05.1.454.CMB.1.raw
  modified_base (319)..(319): a, c, t, g, unknown or other
  misc_feature (319)..(319): n is a, c, g, or t
  modified_base (417)..(417): a, c, t, g, unknown or other
  misc_feature (417)..(417): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccacctcccccattttacgcatgtatcaaacttcgaggccgcccctnaggatccctgaacgtcgttttcgggctccaagtctggggacacagccactctgactagttacccgggcccaggccagtcgatggagggatactttacngtcgaggcgtggacagcacactcatcgtcggcggaggacacggntcgaccgtcgngggtacacgcccgaggcctcgcccccgtggtccaccgttccgtccgttccccacccttccctccctcgtacgg

SEQ ID NO: 228387 - DNA, 550 bp, Homo sapiens
  misc_feature: GYAE6OF01E3YNG.4.49.E05.1.454.CMB.1.raw
  modified_base (441)..(441): a, c, t, g, unknown or other
  misc_feature (441)..(441): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctcccccaggaccggacagccgtcatgacctgctctaggaaacaacttggggtccagatatgttcctggtatctccagaggccaggccacctccccctatttagtcatgtatacaaacttcgacggccgcccctcgacggacgtccctgaaccgtcgttttccggggcctccgaagtcgtggggacacgacgcccactctcgacctacgttacccggggcccacggccagtcgagtgagggagtacttttacngtcgaggcgtgggcagcacactccatcgtcggcgnggacacggntcgaccgtcngggtcacgccgaggctcgcccctcggcnctcgtccgtcccnccctcctctcgtcg

SEQ ID NO: 228388 - DNA, 661 bp, Homo sapiens
  misc_feature: GYAE6OF01A1D0R.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgttcctggtatctccagaggccaggccactcccccatttagcatgtatcaaacttcgacggccgcccctcgacggacgtccctgtaacgcttttaccgggctccgaagtcctaggggacaccgagcctactcctgactacgttacccggggcccacgggccctagtccgagtcggacgggtagtaccttttacgaggtccgagggtcggtacggggacacggcaacgtaaccttcccagttccgtttccggggaccggtaggggacccgtaacgggtactacgggacccgtccgttcgggtccgtacggtccccgtaaacgggtcccgtaccggcccccccggttacgggtccctaacccgtttccgttacccgttcccccggtacccctttccccgttccccgtacggttaccgg

SEQ ID NO: 228389 - DNA, 573 bp, Homo sapiens
  misc_feature: GYAE6OF01DZVD0.4.49.E05.1.454.CMB.1.raw
  modified_base (432)..(432): a, c, t, g, unknown or other
  misc_feature (432)..(432): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
  modified_base (554)..(554): a, c, t, g, unknown or other
  misc_feature (554)..(554): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctaggaaaccaacgttggggtaccagatattcgtttcctggtatctccagagccaggccactcccctatttagcatgtatcaaacttcgaggccgccctcgaggacgtccctagacgtcgtttccgggctcgaagtcgtggggacacacgccactctgacctacgttacccggggcccaggcctatcggagtggagggtacgtacttttagngtacgagggcggtagggacagccaactaacttccagtcgttcgggcggaggacgacggntcggaccgtcgnggtcaccgccgaacggcctcgcccccgtgccctacgtccgttccgtccccnccccttccctcctgtccgg

SEQ ID NO: 228390 - DNA, 548 bp, Homo sapiens
  misc_feature: GYAE6OF01A7U68.4.49.E05.1.454.CMB.1.raw
  modified_base (425)..(425): a, c, t, g, unknown or other
  misc_feature (425)..(425): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagattatgtttcctggtatctccagaggccaggccactcccccattttagcatgtatcaaactttcgaggccgcccctcgacggacgtccctgaacgtcttttcgggctccgaagtcgtggggacacgacgccactctgactacgttaccggggcccaggcccatcgagtgagggatacttttacngtcgaggcggtgggaccagcaactacttccattcgttacggcggagggacacgggntcggaccgtcgtgggtcngcccgagctcgccccgtgccnctctcgttcccaccctcctccgtactcg

SEQ ID NO: 228391 - DNA, 752 bp, Homo sapiens
  misc_feature: GYAE6OF01DK6JR.4.49.E05.1.454.CMB.1.raw
  modified_base (538)..(538): a, c, t, g, unknown or other
  misc_feature (538)..(538): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcgggcctcctatcaactgactcacgcccaccctcagtcgtcccgtcctccccgaggaccggacacgccgtcatcgacctgcctcgtaggaaacctaacgttcggggtaccagtatagttcgtttccgtaggttactcctaccgaggtacggccgacggcccctaccctcccccttagttttacgtcctaagttcgttaactacctaaacgttccggacggtcccgtcccctacgtacgggtaccgttcccgtacggtaaccgttcgttttccggggaccttaccgtaacgttcggtacgggacctacgacgcctacgtcctacgtaccgtaacggttaccccggggaccgacggtcctagtcgagtacggacgggttacttacgttttacgnggtacgaggtcggtacggacctagccctaaccgtacctttcgacgttcggttaccggggacggtaacgggtaccgacgggtacgtacccggtacccggttccggtacgggtaccaccggacccgtacgggtcccgtacccggtcccccgttggtaccctacccgtttcccgttccccgttacccccaccccgtttcccgtacccgtcggtaccg

SEQ ID NO: 228392 - DNA, 793 bp, Homo sapiens
  misc_feature: GYAE6OF01CFLGU.4.49.E05.1.454.CMB.1.raw
  modified_base (330)..(330): a, c, t, g, unknown or other
  misc_feature (330)..(330): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtcccgtcctccccgaggaccggacagccgtcatgacctgctctaggaaactacgttggggtccagatatgtttcctggtatctccagacggccaggccacctccccctatttacgtcatgtactcaaacgttcgaggccgcccctnacggtacgtccctgaaccgtcgttttccgggctaccgaagtcgtggggacacacgccactctgacctacgttacccggggcccacggccctagtaccggacgttagggaacggggtacgttaccgtttttaacgtcggttaccgtaacggggtccggttacggggaaccgtacggtacccgtaaaccgtaacccttttacccgtaacgttcccggttttacccgggggaccggggtaaccgggggtaaccgtaaccggggtaacgttaccgggtaacccccggtttcccggttacgggggtacccgaaccgggtaacccccggtaacggggtcccccgttacccgggtacccccccccggttcggggttacccccttaaaccccgtttccccggttaccccgggttttaccccccccctaaccccccgtttccccccgttaccccgttaacccgttacccggg

SEQ ID NO: 228393 - DNA, 639 bp, Homo sapiens
  misc_feature: GYAE6OF01A7X7Y.4.49.E05.1.454.CMB.1.raw
  modified_base (328)..(328): a, c, t, g, unknown or other
  misc_feature (328)..(328): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggaccggacagccgtcatcgacctgctctaggaaacaacgttggggtccagatatgtttcctggtatctccagacggccaggccacctccccctattttacgtcatgtatcaaacgttcgacggccgcccctnacggacgtccctgaaccgtccgttttcgggctccgaagtcgtacggggacacgacgccactctacgacgtaacgttacccggggcccagggccctaagtcggagtacggaggggtacgttaccgttttacgtcgttacgagggtcggtacgggacgacgacgaacctaactttccaacgttccgtacgggacggacgggtacgacgggatacggaccgtccgtgggtaccgacgcccgaaggccgtaccggacccccgtggtaccctaccgttccgtcccgttccccgaccccttccctcccgtcgtacgg

SEQ ID NO: 228394 - DNA, 593 bp, Homo sapiens
  misc_feature: GYAE6OF01D7SBF.4.49.E05.1.454.CMB.1.raw
  modified_base (453)..(453): a, c, t, g, unknown or other
  misc_feature (453)..(453): n is a, c, g, or t
  modified_base (507)..(507): a, c, t, g, unknown or other
  misc_feature (507)..(507): n is a, c, g, or t
  modified_base (573)..(573): a, c, t, g, unknown or other
  misc_feature (573)..(573): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtctccccaggacggacagccgtcatcgacctgctctaggaaacacgttggggccagatatgttcctggtatctccagaggccaggccactccccctattttacgcatgtactcaaacttcgaggccgcccctgacggtacgtccctagaaccgtccgttttccggggctccgtaaggtcgtcggggaccacgacgccctactcgtcgacgttacgttacccggggacccagggccaacgtcgaagtggagggtatacttttacgngtcgagggtcgtgggacagacactacttccatccgttcggacggagggcacggngtacgaccgtcgtgggtcacgcccgaggcctccgcccccgtggacctccgtccttccggttccccnccccttccctccgtcgtcgg

SEQ ID NO: 228395 - DNA, 686 bp, Homo sapiens
  misc_feature: GYAE6OF01C3KFK.4.49.E05.1.454.CMB.1.raw
tcagagcactgtagcacgaccggtgctcgatttagagcgactagcaacacacaaaggggctgggcctcagggaagcagcatcggaggtgcctcagccatggcatggatccctctcttcctcggcgtccttgcttactgcacaggattcggggcctcctatcaactgactcagccaccctcagtcgtccgtctccccaggaccggacagccgtcatgacctgctctaggaaacaacgttggggtccagtatatgtttcctggtactctccaggaggccaggccacctccccctatttagctatgtatcaaacttcgacggctccctcgaggactcccgtagaaccgtctttccggctccgaacgtcgtcgggacacacgccactctgactacgttacccgggccgacggccatcgagtggaagggtattaccgtttagtcgtcggagggtcgtacggggacacggacctaacgtaaccttaccgtacgtttccggttaccggggaccggggtacggggtaaccgacggggtacgttaccgggtacccggttaccggtcgggggtacccaccgggtacccccgaacgggtccccgtacccggtccccccgttccgggttccctacccgttcccgtttccccggttacccccctacccccgtttccccttccccgttaccgtacccggg

SEQ ID NO: 228396 - DNA, 806 bp, Homo sapiens
  misc_feature: GYAE6OF01CKQP3.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacgaggattccggggcctcctatcaactgactcagcccaccctcacgtcgtcccgtctccccgaggacggacacggcctacatcgacctgctacaggtaacacgttgggccagtatagttcgtttaccgtggtactcgtaccgagacggaccacggtacccctaccttaccccctagttttacgtacctagttacgtacttaccgtaaaaccgtttcggaaccggtcccgtaccccgtacgtaacggtaccgtcccgtaggtaaccgttcgtttaccggacctaccgtaacgtcggtacgggacacgacgaccgtacttcgtacgacgttaccggtacccggggccctaaggcctaacgcggtaacgcgggtaacgggtagtttaacctttacggtacggtacggtacgggtacccgggtaggtaacgacgttaaccgtaaccgtacccgtttaccgacgggtttaacccgttccgggggaaccggttaacgggggaccgtaaccgggtacggtttaaacccgggcccggttacccggtttaccgggcccggaaaaccgggtccccgtaacgggtcccgaccccggttacccccggtccggtaccccgttaccgttccccgttcccgttacccccgtccccgttcccccttacgtcccggtaaccggg

SEQ ID NO: 228397 - DNA, 584 bp, Homo sapiens
  misc_feature: GYAE6OF01DFRGT.4.49.E05.1.454.CMB.1.raw
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
  modified_base (361)..(361): a, c, t, g, unknown or other
  misc_feature (361)..(361): n is a, c, g, or t
  modified_base (414)..(414): a, c, t, g, unknown or other
  misc_feature (414)..(414): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgtcacaggattcggggacctcctatcaactgactcagccaccctcagtcgtccgtctccccaggacggacagccgtcgactgacctgctctggaaacacgttgggtccagatatgtttccnggtatctccagngccaggccactccccatttgcatgtatcaacttcgagcgccctnaggacgtcctgacgtctttcggctcaagtctgggacacgcgcactctnactagttacccgggccacgggccagtccgagtcggaagggtatacttttacgngtcgagggcgtagggacagcaactacctcagtccgttacgggccggagggaccagggtatcggaccgtccggagggtaccacggcccgaaaggcctccggacccccccgttgggtaccctaccttccggttacccgttacccccaccccttacccttccgtactaccggg

SEQ ID NO: 228398 - DNA, 876 bp, Homo sapiens
  misc_feature: GYAE6OF01CJ6V4.4.49.E05.1.454.CMB.1.raw
tcagagcactgtagcacgaccggtgctcgatttagagcgactagcaacacacaaagggctgggcctcaggaagcagcatcggaggtgcctcagccatggcatggatccctctcttcctcggcgtccttgcttactgcacaggattcgggcctcctatcaactgactcagccaccctcagtcgtcccgtcctccccaggaccggacacgccgtcatgacctgctcgtaggaaactaacgttggggtccagtatagttcgttttcctggttactccgtccaggacggcccacggcccacctcccccctaattttacgtcctattcgttactacctaaaccgtttcggaacggtcccgtcccccgtacgaacgggtaccgttaccccgttacggtaaacccggttccggtttttacccggggacctttaccccgtaaaggttcccggtacggggggaacctaaccgaccggtaccctaaccgttaccgttacggtaacccgtttaaccggtttaccccgggggaccccgtaacgggtaccccgtaagttacccgggtaacgttacggggaacggggttaaccggtttaacccgtttttaaccggtcggtttaacccggtaacgggggtaccggttacgggggaacccgtaacggtacccgtaacccgttaacccgtttaccccgtaacgtttcccggtttaccgggggtaccgggtaaccggggtaaccggtaaccgggtacgtacccggtaccccggttccggtcggggtacccgaaccggtccccggaaacgggtcccgtacccggtccccccggttcggttccctacccgttccgttcccgttaccccccgccccttccgttcccgtacgttaccg

SEQ ID NO: 228399 - DNA, 857 bp, Homo sapiens
  misc_feature: GYAE6OF01B8ZBE.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtcgtccgtctccccaggacggacagccgtcatgacctgctcaggaacacgttgggtccagatatgtttcctggtactctcgagacggccacggccaccttccccctattttacgtactatagtactactaaaacgttccggaacggcccgtacccctacgaacgggtaccgttccccgtaggaaccgttccgttttaccggggccttaccgtaaaggttccggtacgggggaaccaccgtaacggccctaaccgttcgtacggtaaccgttaaccggtttaaccccgggggcccctaacgggaccccgtaacgttaccgggaagttacggggaacgggggtaacgtttaaccgtttttacggtacggttaccggaaggggttccgggttacggggaaccgtacgggtaccctaaaccgttaaccgtttcccgaacgtttcccggtttaccgggggaccgggtaaacggggtaccgtaaccgggtaacgttaccgggtaccccgggttcccggttaccgggggttacccgaaacccgggtaccccggtaaaccgggtcccgttacccccgggtacccccccggttccgggttacccccgtaacccggttttccgttccccggtttaccccgttccccggttaccccccctttccccggttaaccccgttaaacccggg

SEQ ID NO: 228400 - DNA, 547 bp, Homo sapiens
  misc_feature: GYAE6OF01BMJWA.4.49.E05.1.454.CMB.1.raw
  modified_base (430)..(430): a, c, t, g, unknown or other
  misc_feature (430)..(430): n is a, c, g, or t
  modified_base (480)..(480): a, c, t, g, unknown or other
  misc_feature (480)..(480): n is a, c, g, or t
  modified_base (518)..(518): a, c, t, g, unknown or other
  misc_feature (518)..(518): n is a, c, g, or t
  modified_base (534)..(534): a, c, t, g, unknown or other
  misc_feature (534)..(534): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaacacgttggggtccagatatgttcctggtatctccagagccaggccactcccctatttagcatgtatcaaacttcgaggccgcccctcgaggacgtccctagtaacgtccgttttcggggctccgaagtcgtcggggacacgacgccactctgtactacgttacccgggccaggccagtcgagtggaagggtagtacgtttacgngtacgaggtcgtggacacgcactacttccatcgtcggcggaggacgacgntcgaccgtcgtggtcacgccgagcctcgccccgtgccncctcgtccgttccccncctcctctcgtcg

SEQ ID NO: 228401 - DNA, 742 bp, Homo sapiens
  misc_feature: GYAE6OF01C62KK.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagcccaccctcagtcgtccgtctccccaggaccggacagccgtcatcgacctgctctaggaaacaacgttggggtccagatattgtttcctggtactctccagacggccaggcccacctcccctatttacgtctatagtactactaaacttcggacggtccgccccgtacgacgggtacgtcccctaggtaaccgtcgttttaccgggccttaccgaagtcgtacggggaccacgacgcctactcgtacgaccgttacgttacccggggcccacggcctacgtccgagtggaacgggtacgttacgttttacgtcggtacggtacggggtcggttacgggacacggtacctaaccgtaacccgtttccacgtttaccggttaccggggaccggggaacggggtaccgtaacgggtacgttaccgggtacccggttaccggtacggggtacccgaccggtacccgaaacggtcccgttaccccgggtccccccggttccgggttacccgtaccccgttcccgttccccggttaccccccttaccccgttccccgttacccgttccgtaaccggg

SEQ ID NO: 228402 - DNA, 643 bp, Homo sapiens
  misc_feature: GYAE6OF01D539G.4.49.E05.1.454.CMB.1.raw
  modified_base (179)..(179): a, c, t, g, unknown or other
  misc_feature (179)..(179): n is a, c, g, or t
  modified_base (484)..(484): a, c, t, g, unknown or other
  misc_feature (484)..(484): n is a, c, g, or t
  modified_base (558)..(558): a, c, t, g, unknown or other
  misc_feature (558)..(558): n is a, c, g, or t
  modified_base (569)..(569): a, c, t, g, unknown or other
  misc_feature (569)..(569): n is a, c, g, or t
  modified_base (607)..(607): a, c, t, g, unknown or other
  misc_feature (607)..(607): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctnagtcgtccgtctccccaggacggacagccgtcatcgacctgcctcgtacggaaaccaacgttggggtaccaaggtactattcgttccgtggtatcctcgagaggccaaggccccacctccccctagttttacgctatcgtaatacaaacgttcggacgtccgacccctgaacggtacgtcctacggaaccgtcgttttccggactaccgtaagtcgtacgggacacgacgccactcgagtaactacggtacccggggacccacggccaacgtcggtaagtcggtaacgggtactacgttttaacnggttacgacgggtcggtacgggacacgactacgtaaccttcgacttcgttacgggacgtacgggtacacgggtntcggacgtcgngggtccacgtccgaacgtccgtcgtccccgtcggtacnccgttccgtcctccccgtcctccccttcgacgtacg

SEQ ID NO: 228403 - DNA, 627 bp, Homo sapiens
  misc_feature: GYAE6OF01BW9LS.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagcccaccctcagtcgtccgtctccccaggaccggacagccgtcatcgacctgctctaggaaactacgttggggtccagatagtgtttcctggtatcctccgagacggccacggccacctccccctattttacgtcatgtataccaaacttcggacggccgcccctcacggacgtcccgtagtaaccgtcgttttccgggctccgaagtcgtcggggacacgacgcctactctcgtactacgttacccggggcccacgggcccagtcgagtggagggtacgtacttttacgtgtacgagggcggtgggacagcaactacttccatcgttcggcgggacgggacacggatcggtaccggtccgtgggccaccggacccgaacggcctacccggtcccccgtcggtccctaccgttcccttcccggttaccccctaccccgttccctcccgtagtaccgg

SEQ ID NO: 228404 - DNA, 637 bp, Homo sapiens
  misc_feature: GYAE6OF01DMRQY.4.49.E05.1.454.CMB.1.raw
tcagagcactgtagcacgaccggtgctcgatttagagcgactagcaacacacaaaggggctgggcctcaggagtcagcatcggaggtgcctcagccatggcatggatcctctcttcctcggcgtccttgcttactgcacaggattcggggcctcctatcaactgactcagccacctcagtcgtccgtctccccaggacggacacgccgtcatcgacctgctctggaaacacgttgggccagactatcgtttcctggtactctccagtacgccaggccactccccctatttacgtcatgtactcaaacttcggacgcgccctcacggactcctgaacgtcgtttcggctccgaagtcgtgggacacgacgccaactcgtacgacgttacgttacccggggacccagggccctagtccgagtggaagggtatacttttacgcggtcgtacgggtcggtagggacaggaccaacgtaacttccagttccgttcgggaccgggagggtacaccgggatacgggtacccgtacggttcgggtaccaccgggaccctaacgggtcctaccggcccccgttacgggtcctaccgttccgttcccggtttacccccacccgtttccctacccgtacgtacccggg

SEQ ID NO: 228405 - DNA, 646 bp, Homo sapiens
  misc_feature: GYAE6OF01BLU8R.4.49.E05.1.454.CMB.1.raw
  modified_base (461)..(461): a, c, t, g, unknown or other
  misc_feature (461)..(461): n is a, c, g, or t
  modified_base (549)..(549): a, c, t, g, unknown or other
  misc_feature (549)..(549): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcacgccaccctcagtcgtcccgtcctccccgaggacggacacgccgtcatcgacctgctcgtaggaaaccaacgttcggggtccagatatgtttcctggtactctcagacggccacggccacctcccctattttacgctatcgtatctaaacttcgacggccgccctcgaggacgtccctggtaaccgtcgtttccgggctaccgaacgtcgtacgggacacacgccacttcgacgtaccttacggtacccggggccaggccagtcgagtcggaacgggtactacttttacgnggttacacgggtcgtagggacaggaccaacgtacttccgagttccgtacgggacggaacgggtacaacggactccggaccgttccggngggtaccaaccggacccgtaacgggtccctacccggtcccccgtggtccctaccgttcccgtacccgttaccccaccccgttcctacccgtcgtacg

SEQ ID NO: 228406 - DNA, 884 bp, Homo sapiens
  misc_feature: GYAE6OF01ESJU7.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtcccgtcctccccaggaccggacagccgtcatcgacctgcctcgtacggaaactacgttcggggtaccagtatagttcgtttccgtgtactctcagtaggccacggaccacctccccctagtttcgtacatagtactactaacgttccggacggtcccgtccctacgacggtaccgtccccgtacggtaaccgttccgttttccgggaccttaccgtaaacggtccggtacggggaaccaccgtacgaccctacgttacgtacgtaaccgttaaccgggtttaaccccggggaccccgtaaccgggtacccgtacgttaccggtaacgtacggggtaaacggggtactttaaccgtttttaccggtaggtaccggtacggggtccggttagggaccgtacggtacctaacgttaacccgttccgtaacgtttcccgggtaccggggttaccggggaacgggggtaacccgtaaccggggtacgttaaccccggggacccggtttacccggggttaccgggttaacccgaaccccggggtaacccccgggtaaccgggttcccccggtacccccgggttaccccccccggttacggggtacccccgtttaaaccccgttttccccggttaaccccccggtttacccccccgtaaccccccgtttacccccgtttacccccgttaaacccggttacccgggg

SEQ ID NO: 228407 - DNA, 850 bp, Homo sapiens
  misc_feature: GYAE6OF01EEA1L.4.49.E05.1.454.CMB.1.raw
tcagagcactgtagcacgaccggtgctcgatttagagcgactagcaacacacaaaggggctgggcctcaggaagcagcatcgggaggtgcctcagccatggcatggatccctctcttcctcggcgtcttgcttactgcacaggattcggggcctcctatcaactgactcacgcccaccctcacgtcgtcccgtcctccccgaggaccggacacgccgtcatcgacctgctctacggaaacctaacggttcggggtaccagtacttagttcgtttccgtaggtacttcctccgaggacggccgacggaccctaccttccccctagttttacgtacacttacgttaactacctaaaccgtttccggacggtcccgtcccctagaccggtaccgtacccgtacgtaaccgttccggtttaccgggccttaccgtaacggttccggtacgggggtaccacgtaccggtccctaacgttccgttacgtaacccgttacgggttaaccccggggacccctacggggaccctaacggtacccgggaaggtacgggtaacggggttaactttaaacccgttttacggtccggttaacggcgggggtaccgggttacgggaaacgaccgtaccgtaaacctttaccggtccctaaaggtttccccgggtcggggaaccggggtacgggaacccgtaggggttaccgtaccgggttaccccgttaccggggtacgggaccgtacccggtaacccgtaccgggtccctacccgggggtccccccctgggttaccctaccccctttacgtttcccccggtacccctaaccccccggtttcccgtaccgtaacccggttccgg

SEQ ID NO: 228408 - DNA, 742 bp, Homo sapiens
  misc_feature: GYAE6OF01DWKM4.4.49.E05.1.454.CMB.1.raw
  modified_base (178)..(178): a, c, t, g, unknown or other
  misc_feature (178)..(178): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggccgtccttgcttactgcacaggattcgggcctctatcaactgactcacgccacctnagtcgtcccgtctccccgaggacggacacgccgtcacgtcgacctgaccgtctacggaaactacggttcggggtaccaaggtattacgttcgtttccgtggtactccgtcgaggacgccgacgcctacctccccgtattttacgctattcgtactaccgtaaacgttccggacggtcccgtcccctacgaacggtaccgttccccgtaggtaacccggttcgttttccggggaccttaccgtaacggtccggtacgggacacgtacgcctacgtcgacgtaaccgtacgtacccgggcctacggccagttacgacgtagggaacgggtactttaccgttttcgacgggtacacggggtggtacggactacgccgtaacctaacgttcccaaggttcccggtacgggaccgggacggtaccgacgggtcgtccggtacccggtcggtcggggaccaccgggtacccggtacggtcccgttcccggcccccgttccgggtacctaccccggtttccgttcccccggtttacccccgccccgtttacccctaccgtacggttcccgg

SEQ ID NO: 228409 - DNA, 559 bp, Homo sapiens
  misc_feature: GYAE6OF01DYA9B.4.49.E05.1.454.CMB.1.raw
  modified_base (310)..(310): a, c, t, g, unknown or other
  misc_feature (310)..(310): n is a, c, g, or t
  modified_base (365)..(365): a, c, t, g, unknown or other
  misc_feature (365)..(365): n is a, c, g, or t
  modified_base (442)..(442): a, c, t, g, unknown or other
  misc_feature (442)..(442): n is a, c, g, or t
  modified_base (542)..(542): a, c, t, g, unknown or other
  misc_feature (542)..(542): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtctccccagggacggacagccgtcatcgacctgctctaggaactaacgttgggtccagatatgttctggtatctcagagcaggccactcccctatttagctatgtatctaacttcgaggccnccctgacggagtccctagacgtcgtttcggctacaagtctggggacacagccacnctgactacgttaccgggcctaggccacgtcgacgtggaacgggtatactttactggttccgagggtcggtagggacnggaccaactacttccaattcgtacgggcggagggacacggatcgaccgtcgtggtcagcccgaaggtctcgcccctcggtacacgtccttcgtacccccnccttccctcctgtacgg

SEQ ID NO: 228410 - DNA, 665 bp, Homo sapiens
  misc_feature: GYAE6OF01ECYLG.4.49.E05.1.454.CMB.1.raw
  modified_base (179)..(179): a, c, t, g, unknown or other
  misc_feature (179)..(179): n is a, c, g, or t
  modified_base (345)..(345): a, c, t, g, unknown or other
  misc_feature (345)..(345): n is a, c, g, or t
  modified_base (473)..(473): a, c, t, g, unknown or other
  misc_feature (473)..(473): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctnagtcgtcccgtctccccagggaccggacacgccgtcatcgacctgcctcgtacggaaaccacgttcgggggtaccagtattactgtttcctgggttatcctccagacggccaggcccacctcccccctattttacgcatgtactactaacttcgaggccgcccctnacggacgtccctgaacgtcgtttccgggctccgaagtcgtggggaccacgacgccactctacgtacctacgttaccccggggacccacgggaccctagtccgagtcgggagggacgttacttttacgngtccgtaggcggtaggaccagccaactactcctattccgtacgggacggacgggtaccgacgggtacttacggacccgtccggtgggtaccgaccggtacccggaacgggtcccgtccgtccccccggtccggtcccgtacccgtccggttccccggttccccccaccctttcccctcccgtcgtacccggg

SEQ ID NO: 228411 - DNA, 551 bp, Homo sapiens
  misc_feature: GYAE6OF01A1NSW.4.49.E05.1.454.CMB.1.raw
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
  modified_base (487)..(487): a, c, t, g, unknown or other
  misc_feature (487)..(487): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtgtccgtctccccaggacggacagccgtcatgacctgctctggaaacaacgttggggtccagatatgtttcctggtatctcgagaggccaggccactccccccatttagtcatgtatcaaacttcgacggcgcccctcaggacgtccctgacgtctttcggctccaagtctggggacacagccactctgactagtaccgggccaggtccatcgatcgagggactacttttacgngtacaggcgtgggacngcaactacttcactcgttcgggcggacgggacacggtatcggaccgtcgtgggtacncggacccgaggcctccggccccctcggtccacttcgtcgttccccgccctccttcccgtctcgg

SEQ ID NO: 228412 - DNA, 634 bp, Homo sapiens
  misc_feature: GYAE6OF01DVUK7.4.49.E05.1.454.CMB.1.raw
  modified_base (267)..(267): a, c, t, g, unknown or other
  misc_feature (267)..(267): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtcctccccaggacggacacgccgtcatgacctgctctaggaacaacgttggggccagatatgtttcctgtatctccagngccaggcccactcccccattttacgtcatgtactctaaacttcgacggccgcccctcgacggtacgtcccctagtaccgtcgtttcgggcctccgaacgtcgtcggggtaccacgacgcctacctctacgtactacgtacccggggtcccacgggccagtcgagtggagggtacgtactttacgtgtcgagggtcgtacgggacagaccgaactaccttaccgacgttccgttcgggacgggacggtacgaccgagtaccgccgttccggtaggtaccgacggacccgacggtcctccggcccccgttcgggtcctacccgttcgttccccgttacccctacccccttaccctcccgtagtacccgg

SEQ ID NO: 228413 - DNA, 752 bp, Homo sapiens
  misc_feature: GYAE6OF01DP0FV.4.49.E05.1.454.CMB.1.raw
tcagagcactgtagcacgaccggtgctcgatttagagcgactagcaacacacaaaggggctgggcctcaggaagcagcatcggaggtgcctcagccatggcatggactccctctcttcctcggcgtccttgcttactgcacaggagttcgggcctcctatcaactgactcacgccaccctcgacgtcgtcccgtcctaccccgaggacggacacgccgtcagtcgacctgctacgtacggaaaacctacggttcggggtaccagtattacttcgtttccgtggtactcctccgagacggccacggccctaccttaccccttagttttacgctattacgttactacctaaacgttccggacgtcccgtccctacgacggtaccgtaccgtacggtaccgttcgtttccggaccgttaaccgtaacggttccggtacgggaacctacgaccgtaccctacgttaccgtacggtaaccgttaaccggttaccccggggacccgtacgggtaccctacggtaccggtaaggttacggggtaaacggggttacgtttaacgttttacggcggtacgtacggggtcgggtacggactacgaccgtaacctacgttcacggttccgtcgggacggacggtacgacgtcgtacggtccgtcggtacgggaccgaccggaccgtacggtcccgtcccgccccggttcggtcccgtaccttccgttccccgtaccccctacccgttccctaccgtacgttcg

SEQ ID NO: 228414 - DNA, 659 bp, Homo sapiens
  misc_feature: GYAE6OF01CHCV5.4.49.E05.1.454.CMB.1.raw
  modified_base (525)..(525): a, c, t, g, unknown or other
  misc_feature (525)..(525): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacgttggggtccagatatgtttcctggtatctccagaggccaggccacctccccctatttagtcatgtatccaaactttcgacggcgcccctcacgggacgtcccctaggtaaccgtccgttttcgggccttaccgaagtccgtggggaaccacgacgccactcgtcgactacgttacccggggcccaggcccagtccgagtggagggagtacctttagtcggtcgtagggcggtgggacacggacaccgaactttccaacttcgtttaccgggcgggaagggtaccacgggtacncggacccgttacggtcgggttccacggtccccggaacggtcccgtaccggcccccccgttgggtcccgtaccccttccgttacccggtttccccccgtaccccccttcccccgttacccggttacccgtaccgg

SEQ ID NO: 228415 - DNA, 870 bp, Homo sapiens
  misc_feature: GYAE6OF01CSFYO.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtctccccaggacggacagccgtcatgacctgctctaggaaacaacgttggggaccagatattgtttcctggtactctccgagacggccacggccacctccccctattttacgtctattcgtactacctaaacgttcggacggtcccgccccctacgacgggacgttccccgtaggtaacccgttcggtttttccggggacctttacccgtaaacggttccggtacgggggtaacccaacgtaccggaccctaaccgttcgttacggtaaccggtttaaccggtttaccccggggggacccctaacggggtaccccgtaacgtcccgggtaagtacggggtaacgggggtaacgtttaccgttttttaacggtcgggttacccgtaacgggggtccgggttacggggaaccgtacgggaccctaaccgttaacccgtttacccgaacgttttcccgggttaccgggggacccggggtaaacgggggtacccgtaacggggtaaccgttaccgggtaaccccggttccgggttaccgggggtaccgaacccgggacccccgaaacggggtccccgttaccccgggtcccccccggttcggggtaccccttacccggtttccccggttaccccggtttcccccccggtacccccgtttcccccgttacccgttaccggtacccgg

SEQ ID NO: 228416 - DNA, 827 bp, Homo sapiens
  misc_feature: GYAE6OF01DV6OA.4.49.E05.1.454.CMB.1.raw
  modified_base (600)..(600): a, c, t, g, unknown or other
  misc_feature (600)..(600): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcacgccaccctcagtcgtcccgtctccccgaggacggacacgccgtcatcgacctgcctcgtacggaaaacctaacgttcgggggtaccagtattagttcggttttcccgtgggttaacttccgttacccgaaggtacgggcccgaacgggtccccacccttaccccccctagttttttacgtacctagttacggttacttacctaaaccgtttccggaaccgggtcccgtccccccgttacgaacgggtaccgttccccgtacggtaacccggttccgtttttccggggaccctttacccgtaaacggttccggttacggggacccaacgaccgaccctacctcgtaccggtaccttaaccggttacccggggcccgacgggcctacgtacggaagttgggagggtaacttacgttttacgtggtaccggnggggttaccggtagggaccgacgtaccgtaaacctaacccgttcacgttccgtaccggggacggtaacgggaccgtacgggtactaccgggtacccgttcggtacgggtaccaccgggtacccgtaacgggtcccggttaccccgtccccccggttcgtaacccctccgttaccccgttcccgggttacccccccggacccctttcccggtcccttacggtacccgg

SEQ ID NO: 228417 - DNA, 765 bp, Homo sapiens
  misc_feature: GYAE6OF01AEG5F.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagcccaccctcagtgtcccgtcctccccgaggacggacacgccgtcatcgacctgctcgtaggaaaccaacgttggggtccagattattcgtttcctggttactcctccgaggacggccacggcccacctccccctattttacgtctatgtactactaaacgttcggacggccgtcccctcgtacggaccgtcccgtacggtaaccgtccggtttttccgggaccttaccgtaacggttccggtcgggggtaaccaccgtacgtccccaacgttccgtacgtaaccgttaaccggttaccccggggaccccgaacggggtcctacgtaccggacgtagggacgggtacgttacgtttttacgcggtacggacgggtcggttacgggaccgacgtccaaaccgttaccttacccgtacgtttcggttacccgggggacggacggggtaccgaacgggtcgtaccggtacccggttcccggtacgggcccgtaacggaccccggaacggtcccgtacccggttcccccgtcgggttccctacccgtttcccgttcccgttacccccctacccccgttcccttacccgtaccgttccgg

SEQ ID NO: 228418 - DNA, 771 bp, Homo sapiens
  misc_feature: GYAE6OF01EAZQZ.4.49.E05.1.454.CMB.1.raw
  modified_base (757)..(757): a, c, t, g, unknown or other
  misc_feature (757)..(757): n is a, c, g, or t
tcagagcactgtagcacgaccggtgctcgatttagagcgactagcaacacacaaaggggctgggcctcaggaagcagcatcgggaggtgcctcagccatggcatggatccctctcttcctcggcgtccttgcttactgcacaggattccggggcctcctatcaactgactcacgcccaccctcagtcgtccgtcctccccgaggacggacacgccgtcagtcgaccgtcgctactacggtaaactacggttcggggtaccaagtacttagtttcgtttccgtaggttacttccgtaccgaggacggtcccgacggtcccctaacccttaccccctaagtttttacgtctaacgttacgttaacttaccgtaaacgttcggaccggcccgtaccctacgtacggtacgtccccgtacgtaccgtccgttttaccgggacctaccgtaacggtcgtacggggacctacgacgcctacgtcctacgtaccgtaccgggtacccgggccctacgggccctacggtcggacgtagggaacgggttacttacgtttacgtcggacggtcgggtcggtacgggacacgaccgtaacctaaccgtccgtaacgttccgggtaccgggacggtaccggggaaccgtacggtacgttccggacccggttacggtccgggtaccgacccgtaaccggacggtccccgttacccggccccgttacggtccctaccgtttccccgtcccgtttcccccgcccctttaccncccgtcggtacccg

SEQ ID NO: 228419 - DNA, 945 bp, Homo sapiens
  misc_feature: GYAE6OF01C6TAF.4.49.E05.1.454.CMB.1.raw
tcagagcactgtagcacgaccggtgctcgatttagagcgactagcaacacacaaaggggctgggcctcaggaagcagcatcggaggtgcctcagccatggcatggactccctctcttcctcggcgtccttgcttactgcacaggattcggggcctcctatcaactgactcagccaccctcagtcgtccgtctcccgaggacggactagccgtcatcgacctgcctcgtaggaaacctaacgtttcgggggtaccaaggtacttaagttcggtttttcctagggttaacttccgttacccggaacggaacgggacccacgggtacccctaacccgttaccccccgttaagtttttaacggtcctaagtttacggttaaccttaccgtaaaaccgtttaccgggaccgggtacccgtacccccgtacggtaacgggtaccgttccccgttacggtaacccggttcggtttttaaccgggccttaccggtaacggtttaccgggtacggggaaccctaacggtaacggacccttaaccgttaccgttacggtaacccgtttaaccgggtttaacccccggggggaccccgtaacgggggtacccctaacggtccgggtaacttacgggggtaaaccggggtaacgttttaaccgtttttaacggaccgggttacggtacgggggtaccgggtccgggaaccgtacgacccgttaaaccgtaccttaccggtacgttaccgggttacgggaccgggtaaggggtacctaacggggtcgttaacccggtccggttacccggtcggggtaacccgaccggtacccggtaaccgggtcccttacccccggggtaacccccggtttaccggggttaacccctttccggtttacccccggttaccccccggtccccctttaacccggttacccgtaccggttacgggttacccg

SEQ ID NO: 228420 - DNA, 650 bp, Homo sapiens
  misc_feature: GYAE6OF01DRL5F.4.49.E05.1.454.CMB.1.raw
  modified_base (446)..(446): a, c, t, g, unknown or other
  misc_feature (446)..(446): n is a, c, g, or t
  modified_base (467)..(467): a, c, t, g, unknown or other
  misc_feature (467)..(467): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctctatcaactgactcagcccaccctcagtcgtcccgtctccccaggaccgacagccgtcatgacctgctctaggaaactacgttgggtccagtatatcgtttccgtggtactctccgagacggccacggccacctccccctattttacgtctattagtactacaaacgttcggacggccgcccctcgacggtaccgtccctagaaccgttccgtttcgggcctaccgtaacgttcgtcggggacaactacgcctactctcgtacgtacgttaccgggaccagccctatcggangggacgggtattactttacgngtccgagggtccgtaggaccgagaccagtaccttcctatccgtcggacggacggtacgtcggactcggtaccgtaccgtgggtaccacggtacccgaaggcccgtaccgccccccggttgtcccgtaccctaccgttccccgttacccccgtaccccccttacttcccccgtaggttaccccg

SEQ ID NO: 228421 - DNA, 682 bp, Homo sapiens
  misc_feature: GYAE6OF01D6Z38.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtcctccccgaggacggacagccgtcatcgacctgcctcgtaggaaaccaacgttggggtaccagtatattcgtttcctggtatcctccagacggccacggcctacctccccctattttacgtctatgtatactaacgttcgacggccgccctgaggactccgtagacgtcgtttcggctccgtaagtcgtacgggacacgacgccacgtctacgtaccgttaacgttacccggggaccctacgggaccctaggtccggtaagtgggaaacggggtacttaccgttttacgtgttaccgagggtcggtacggacacgaccacgtaaccttcgtacgtccgttcgggacggtacgggtacgaccggtagtacggaccgttccggtacgggtaccgaccggacccgtaagggcccgttacccggcccccgttccgggtaccctacccgttcccgttcccggttacccccgtccccttcccgtcccgtaccgtaccgg

SEQ ID NO: 228422 - DNA, 874 bp, Homo sapiens
  misc_feature: GYAE6OF01DXWBZ.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctctcctcggcgtccttgcttactgcacgaggattcgggcctcctatcaactgactcagccacctcagtcgtccgtcgtccccgaggaccggacacgaccgtcaacgttcggacctgacttacgtacggaaaacctaacggtttcggggaccaggtaattacgttacggttttcccgtagggttaacttcccgttaccgtaacggaaccgggtacccgtaacggggaccccctaacccctttaaccccccgttaagttttttaaccggtacctaacgtttacggttaaacttaaccgtaaaaccgtttccggaacggtcccgtaccccgttacgaaacgggtaccgttccccgttaaggaacccggttcgttttaccggggaccttaccgtaaacggttccggtaggggaaccacgaacgtaccgtacttacgtacgtaaccgttaacggttacccggggacctacggtacctaagtacgaacgtacgggtaacgggttaacgtaaccgtttttaagcggtacgtagggtacggttacgggacctacggacctaaacccgtaaccttccgtaacgttccgttacggggacgggaacggtaacccgaagggtccgtaccggtacccgtcggacgggttaccaccgggtaacccgtaacggtcccgtaccccggccccgttaacccgggtacctaacccgggtttccccgttacccggttaccccctaacccccgtttcccgttaacccgaccggttaacccggg

SEQ ID NO: 228423 - DNA, 833 bp, Homo sapiens
  misc_feature: GYAE6OF01DHC43.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtcccgtcctaccccgacggaccggacacggtccgtacacgtcgacctgcctacgtaacggaaactaaccggttcgggaccaagtataacgtttcggttttcccgtagggttacttaccgttaccgaggtaaccggtacccgacgggaccccccttaaccgttacccccccttaattttttaaccggtcctaaagttcgttaaactacctaaaacgttccgggaccggtacccgtccccgtacgtacggtaccgtcccctacgggtaacccgttccgttttaccggccctaccgtaacggttccgtacggggacctacgtcggaccctactcgtacgtaacgttaccggtcccggggaccctaggtaccctaagtcggtacgtacgggaagggtacgtttacgtttacgacggttacgacgggtacgggtcggaacacgctaaccgtacttaccgtacgttccggtaccgggacgggtaacgggacctaacgggacgttccggtacccggtccgggtacggttccgaaccggtacccgaaccgggtcccgtccccgggttacccccgttaccgggttccctaccccggtttacccttcccccgggttaacccccttacccccgttaacccgttcccgtacgttacccggg

SEQ ID NO: 228424 - DNA, 677 bp, Homo sapiens
  misc_feature: GYAE6OF01EZHYQ.4.49.E05.1.454.CMB.1.raw
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
  modified_base (563)..(563): a, c, t, g, unknown or other
  misc_feature (563)..(563): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcacgcccaccctcacgtgtcccgtcctccccgaggaccggacacgccgtcatcgacctcgctcgtagaaactacgttcgggccagtatatgtttccgtggtatcctcaggacggccgacggccctacctccccctaatttttacgtctagtgttactacctaacgttcgacgccgcccctgaggtctccngaccgtcgtttcggctccgaagtcgtggacacgcgccnctcgtgtactacgtacccgggccgacggcctagtccgtaagtcgggaacgggttacgttaacgtttacgtggtaccgaggggtcgtcgggtacacgaccgtaactaacccgttcgaacgttccgtacggggaccggacggggtacacggtactcggacccgtccggngggtaccaccggaccgtaaccgggtccctcccggtcccccggtcgttcccgtaaccttcccggttacccggttccccccaacccgttttccccgttcccgtaaacgttcccggg

SEQ ID NO: 228425 - DNA, 917 bp, Homo sapiens
  misc_feature: GYAE6OF01BE0XZ.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttccctcggcgtccttgcttactgcacgaggacttcggggcctcctatcaactgactcacgcccaccctcagtcgtcccgtcctccccgaggaccggacacgcccgtacatcgacctgctcgtacggaaactacgttcggggtaccaagtattacgttacgttttccgtggttaactccgtaccgaaggacggtccgaacggtccccctaacccgttaccccccttaagtttttaccgtacgtaacgtttacgttaaacttaccggtaaaaccgttccgggtaaccgggtacccccgtcccccgttaacggacgggttaccgttacccccgttaacgggtaacccggtttccgggttttcccggggaacccttaccggtaaacgggtttacccgggtaccgggtaaccaaccgtaccgtacccgttaacccgttcggtaccggtaaacccgtttaacccggggttaaccccggggaccccgaaccgggtacccttaccggttacggtaacggttaacgggggtaaccgggttaacgtttaaaccgtttttaccggcgggtttaaccgggacggggtccgggttacgggaaaccgttccggaaccctaaacggtttaacccgtttaccgacggtttccggttaccgggggaaccgggtaacggggaccgtaaccggggtaattccccggggtaacccgtcgggttacgggacctacccggacccgtaggtccccgtccgcccccggttcgtcctaccccgtcgttaccccgttcccccgactttccccgtacccgtggtacccg

SEQ ID NO: 228426 - DNA, 831 bp, Homo sapiens
  misc_feature: GYAE6OF01EH4JT.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtcgtccgtcctcccgaggaccggacagccgtcatcgacctgctctacggaaacacgttgggtaccagatattgttccgtggtatctccagacgccacggccacctccccctattttacgctattcgtactaccgtaaacgttcggaacggtccgtccccgtacgacggtacgtcccgtagtaaccgttcgttttccggggaccttacccgtaaggttcccggtaggggtaaccacgtacggtaccctaacgttccgtacggtaaccgttaccggttaacccgggggtaccccgacgggtaccctacgtaccgggtaacgttacggggaacggggtaacgttacctttttaacggtcggtttaccggacggggttccggttacgggggaaccctaacgggtacccgtaaaccgttaacccgtttaccgtaacggttcccggtttaccgggggacggggtaacggggtaacccgtacggggacgttaccgggaaccccggtttcccgggtaggggttcccgaaccgggtaaccccggtaaacgggtcccgttaccccgggaccccccggttccgggtaccccgttacccgtttcccgttcccggtttaccccccctaccccgtttacccccgtcccgttaacccgttaccggg

SEQ ID NO: 228427 - DNA, 895 bp, Homo sapiens
  misc_feature: GYAE6OF01CJ82M.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacgaggagttcggggccctcctatcaactgactcacgcccaccctcagtcgtcccgtcctccccgagggaccggacacggcccgtacattcgacctgcttacgtacggtaaacctacggttcggggtaccagtattagttcgttttaccgtggttactccgtaccgacggaacggcccgacggacccctaacccttacccccttaattttaacggtaccttagtacgttaacttaccgtaaaaccgttccggaacggtcccgtaccccgtacggaacggtaaccgttcccgtaacggtaccggttccgttttccggactacccggtaagttccgggtacgggacaaccgtacgaccctacttcgtacgtaacgttaccggtacccggggacccgtacggacccgttacggtacggtacgtaggggtaacgggttaacttaccggtttttaacgcggttacgggacgggtacggggttaaccgggacctacggaacccgtaaccgtaaccgtttccaacggtttccgggttaaccgggggaccggggaaccggggtaaccggaacggggttacccgaccggggttacccggttacgggtacccgggttacgaaccccgtacccggggaaacccgggttccccggttacccccccgggtccccggtttaacccggtaccttcccccggtttaccggttacccccccggtttaccccccgttaccccttccccccggttttaccgaacccggtacccggg

SEQ ID NO: 228428 - DNA, 795 bp, Homo sapiens
  misc_feature: GYAE6OF01A8BTM.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtctccccaggacggacagccgtcatcgacctgccttctacggaaacctaacgttcgggggtaccaggtacttattcgttttaccgtggttactcctccgaggacggccacggtcccacccttccccctaattttacgtctattcgttactaccgtaaacgttcggacggtccgtccccctagaggtaccgttccccgtaggtaaccggttccgttttccggggccttacccgtaaacggttccggtacggggtaccaccgacgtacccgtacttaccgtacgtaaccggttaccggttaaccccgggggcccaacgggtccctaaggtccggaagtcggggaacgggtaaggttaaccttttacgcggtcgaacggggtcggtaacgggaccaggtacctaacgtaaccgttacacgtttccggttccggggacgggtaacgggtacgtaaccggtacgtaccggtacccggttccggtcgggtaccgacccggtaccgtaaccggggtcccttacccggcccccgttcgggttaccctacccgtttccccggttacccgtttaccccccctaaccccgtttccccgttacccgtaccgttaccggg

SEQ ID NO: 228429 - DNA, 1017 bp, Homo sapiens
  misc_feature: GYAE6OF01DJWPD.4.49.E05.1.454.CMB.1.raw
tcagagcactgtagcacgaccggtgctcgatttagagcgactagcaacacacaaaggggctgggcctcaggaagcagcatcggaggtgcctcagccatggcatggactccctctcttcctcggcgtccttgtcttactgcacaggtagttccggggcctcctatcaactgactcacgcccacctcacgtcgtcccgtcctaccccgaggaccggaccacggcccgtcacgtcgtaccctgtcgttacgtaacggaaaccgttaaccggtttacgggggtacctaagtagttaacgtttcgttttacccgttacgggttaactcccttaccgaacggtaaccggacccgtaccgggtaccccctacccttaccccccttacgtttttacgtaccgttacgtacgttaacttaaccgtaaaccgttaccggtaccggtccccggttacccccgtacggtacgggtacccggttaccccgttaaccggttaaccggtttcccggttttaccggggtacccgttaaccgtaacgggttccggtaccggggtaacccgaaccgaaccgtccctaacgttccgttacgtaccggttaaccgggttaccccgggacccgtacgggaacccttaacggtccggtaaggtacggtaaacggggttaaccgttttacgttttacggtacggtaccggtcgggggtacggtaccggggtaacctaaccggtaaccttaaccgttaacccgtttcccgtaacgggtttcccgggttaccggggtaaccggggtaaacggggttcccggtaaaccggggttacgtaacccggggttcccgggtttaacccggggtccggggttaaccccgacccgggtaaacccggacccgggtttcccccggttaccccggttaccccccccgggtttccgggttacccccttaacccgttttcccccgttaacccccgggtttacccccccttaccccccgttaccccggttaccccgttaacccgggtttacccggg

SEQ ID NO: 228430 - DNA, 861 bp, Homo sapiens
  misc_feature: GYAE6OF01BMI9R.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctctcctcggcgtccttgcttactgcacaggagttcggggcctcctatcaactgactcacgcccacctcagtcgtccgtcctccccgaggacggacacgccgtcatcgacctcgcctcgtacggaaacctacgttcggggtaccagtattattcgtttcctggttactcctccgaggacggccacggaccccaccttccccctattttacgtctagttcgttaactacctaaaccgttcggaccggtcccgtcccctacgaacgggtaccgttacccctacggtaacccggttcccggttttccggggtacccttacccggtaaacggttcccgggtacggggaacctaacgaccgtaccctacgtacccgtacgtaaccgttacccgggttaccccggggaccctacgggtaccctacggtacggtaaggtacgggtaacggggtaacgtttaacgttttacgtcggtaccggtaggggtccgggttacgggaccgtacgaccgtaaccttaaccgtttacccgacgtttacccgggttaccggggaccgggggtaaccggggtaaccgggaccgggttaacggttacccggacccggggttaccgggttacccggggaccgtaccccgggacccggtaaccgggtccccggtccccggtcccccggttaccggttcccttacccggttaccccgtttcccccgttaaccccctacccccgtttccctaccccggttacgttaccccgg

SEQ ID NO: 228431 - DNA, 755 bp, Homo sapiens
  misc_feature: GYAE6OF01DI0HZ.4.49.E05.1.454.CMB.1.raw
tcagagcactgtagcacgaccggtgctcgatttagagcgactagcaacacaacaaaggggctgggcctcaggaagcagcatcggaggtgcctcagccatggcactggatccctctcttcctcggcgtccttgcttactgcacaggattcggggcctctatcaactgactcagcccacctcagtcggtccgtcctccccacgggacggacacgccgtcactcgaccctggctctacggaaacacggttcgggtaccagtatattacgtttctaggtactcctaccgtagacggaccacggacctacctacccctatttacgtactatagtatactaacgttcggacggccgccctacgacggactcctacgtacgttcgttcggctcacggtcgtacggggacacgtacgcctaactcgtacgtaccgttaacggttacccggggaccgacggaccgtaactccggaaggtgggaaacggggtcctttaacgttttacgtacggtccggacggggcggtaccgggacgtacgacgtaacccgtaacgttcctaacggttccggttacggggaaccggggtaagggtaacccggtaacgggtacgggttaccggaacccgggttccgggaacggttacccggacggtaaccccgaacgggttcccgtaaccccgggtcccccgttacgggtaacccgtcccgttacccggttcccgttaacccccggtcccctttacccgtaacccttcggtaccgg

SEQ ID NO: 228432 - DNA, 906 bp, Homo sapiens
  misc_feature: GYAE6OF01B50SO.4.49.E05.1.454.CMB.1.raw
tcagagcactgtagcacgaccggtgctcgatttagagcgactagcaacacacaaagggctgggcctcaggaagcagcatcggaggtgcctcagccatggcatggatccctctcttcctcggcttcccttgcttactgcacaggattcgggcctctatcaactgactcagtccaacctcagtgtcccgtctccccgaggaccggacacgccgtcatcggacctgacctcgtaggaaacctaacgttcggggtaccaggtacttagttggtttaccttcggttaactccgtaccgtacggacggtaccgacggcccctaccgtaccccccttaatttttacggtacttacgttacgttaacgttaaccgttaaaccgtttaccggacggtacccgtaccccgttaccgtacgggttaccgtttaccccgtacggtaacccgttccgtttttaccgggccgttacccgtaacgggttccggttaccggggaacctaccgtacgaccctaacgttccgaccgttacgttaaccggttacccggggtaccctacggtacccgtagtaccggtacggtacgggaacggggttacccttaaccggttttaccgtacggtaaccggacgggttaccgggttaaggggaacctaccgggaacctaaccggtaacccgttaccgaccgtttccggttaccggggaacccgggtaccggggtaacccgtaacggggtacccttaccgggtaaccccgggtttcccgtagggggttaaccccgaccggtaaccccgggtaaacggtccccggtaacccggttacccccccgggttaggtttacccccgtaacccgttccgtttaacccccggtcccccggttacccttccccccggttaaacgtcccccgggtaaccg

SEQ ID NO: 228433 - DNA, 685 bp, Homo sapiens
  misc_feature: GYAE6OF01A4SWU.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggagtccttgcttactgcacaggattccggggctcctatcaactgactcacgcccacctcagtcgtccgtcctccccgaggaccggacacggccgtacactcgacctgctcgtacggaaactacggttcggggtaccagactatcgttttcctggtactcctaccgaaggtacggaccacgggcccctaccctccccccttattttacgcctattcgttactaccgtaaacttcggacggcccgtccctacgacggtacgtcccgtacgtacgtccgtttcggcctaccgtaacgtcgcgggtaacaccgtacggccactctacgtaccgttacggtacccggggcctacggcctagtcgtagtacgggaacggggttactaaccgttttcgacggtacggacgggtcggtacgggactacgaccgacttaaccgtcctacggtccgttacgggcgggaacggtacgacggtctaggaccctaggaccgtcgggtaccacggtcccgacggtcacccggtccccgtacgtcgtcccgtcttcccggcccctcccttcgccgtacg

SEQ ID NO: 228434 - DNA, 897 bp, Homo sapiens
  misc_feature: GYAE6OF01D4IPX.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgttccttgcttactgcacaggattcggggcctcctatcaactgactcagccaccctcagtcgtccgtcctccccaggaccggacacgccgtcatcgacctgctcctaggaaacctacgttcggggtaccagtattacttgtttccgtggttacttcctccaggtacggccgacggccctacccttccccctaactttttacgacctagtacgttaactactaaaccgttcggacggcccggtccccttacgacgggtacgtcccgtacgtaaccggttccgttttccggggactacccggtaacgttccggtacggggtaaccaccgtaacggccctaacgtccgtacggtaaccgttaacggttaccccgggggaccccgtacggggcccctaaggttaccgaacgggttcggaaacgggggtttaaccgtttaaccggtttttaaccgttacgggtaccggtacggggttacccgggtttacggggaaccgtacggtaccccgtaaacgttaacccgtttacccgtacgttaccggtttacccgggggacggggtaaccgggggtacccgtaaacggggttacctacggggttaccccggttaccgggttacgggtaccggtaacccgggtaaccccgtaaacggggtcccccgttaccgggttaccccccccgttcgggttaacccccgtacccggtttacccggtttcccccgggtttaccccccggtaccccctttaccccccggttacccgttacccgggttacccgg

SEQ ID NO: 228435 - DNA, 649 bp, Homo sapiens
  misc_feature: GYAE6OF01AY5ET.4.49.E05.1.454.CMB.1.raw
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
  modified_base (559)..(559): a, c, t, g, unknown or other
  misc_feature (559)..(559): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtcgtcccgtcctccccgaggaccggacaggccgtcatcgacctgcctctacgggaaacctaacgttcggggtaccagtattattcgtttcccgtaggttactctccgtaggacggtccgacggcccaccgttccccctaattttacgctatcgtactactaaacgttcggacggccgccctagacggtacgtccctagaccgtccgtttcgggacctccgtaaggtcgagggacacgacgccacttcgtagtaaccgtacgttacccgggacctacgggcctagtcgagtggagggtactactttacgngtcgacggnggtcggactacgcactacttcagtcgtacgggcgtaggaccgtaggacgtcggaccgtcgngggtccacggacccgacggtccgtcccgaccccggtcggtacctccgttcccgttcccgttacccctacccgttccctaccgtcgtacgg

SEQ ID NO: 228436 - DNA, 838 bp, Homo sapiens
  misc_feature: GYAE6OF01AMNM5.4.49.E05.1.454.CMB.1.raw
tcagagcactgtagcacgaccggtgctcgatttagagcgactagcaacacacaaagggctgggcctcaggaagcagcatcggaggtgcctcagccatggcatggatccctctcttcctcggcgtccttgcttactgcacaggattccggggcctcctatcaactgactcagcccaccctcagtcgtcccgtccgtccccgaggaccggacacgccgtcactcgtacctcgtctcgtacggaactaaccgttcggggtaccagtattacgttcgttttcccgtaggttactccgtaccgtacggaccgggccgaaccggcccctaaccccgttaccccccgttaacgttttttacgtaccttacgtacggttaactaccgtaaaaccgtttccggacggtaccccgtacccccgttacgaacgggtacccgttcccggtacggttaacccggttcccggttttccgggacccttaccgtaaacggtcccggttagggggacctaccggacccgtacccgtaccgttcgttaccggtaaccgtttaacccgggtacccccgggggtacccaacccggggtccctaacgtaccggtaacgtggggaacgggttaacttaccgttttacgtcgggtaccgacgggtcgggtacggaccgaagtcccgtaacgtaccgtttcgacgttccgtaccgggtacggggacggtaccgaccgggtacgtaccggtaccggtccgtagggtcctacccggacgtaccggtccgtaccccggtccccgtccggttccctacgttcccgttcccttacccccgtccctccccgtacccgttacgtcccgg

SEQ ID NO: 228437 - DNA, 866 bp, Homo sapiens
  misc_feature: GYAE6OF01A1DS6.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacgaggatcggggcctcctatcaactgactcagccacctcagtcgtccgtcctccccgaggaccggacagccgtcatcgacctgctcgtacggaaacacgttacggggtccaggattacgttacggttttacccttgggttaacttccgttaccgaggtacggtacccgagggtaccccctaccgttaccccccgttatttttaaccggtactaagttacggtttaactaccgtaaaaccgttttccggtaccgggtacccgtcccccgttacgaacgggtacggttaccccgttacggtaaccggttccgtttttaccgggggacctttaccccggtaaacggttccgggttacgggggaacctaaccgtacggtacccgtaacccgtttcgtacggtaacccgttaacgggtttaaccccggggacccgaacgggtccctaagtacccgggagttacgggaaggggttaaccgttaccgttttaacgtacgggttaaccggtacggggtacccggttagggggaacctacggtaccaacgttaccgttaccgacgtttccgggtacggggaccgggtaagggaaccggtacgggttaacgtccggaccggttccggtcgggtaccgtaccggtacccggtaagggtcccgtacccggccccggttaccggttcacccgttccgttcccggtaccccgttacccttccgtttacccgccgttacggg

SEQ ID NO: 228438 - DNA, 812 bp, Homo sapiens
  misc_feature: GYAE6OF01A21JV.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcacgcccaccctcagtcgtcccgttcctccccgaggaccggacacggcctcatcgacctgctcgtacggaaacctacggttcggggccagtattagttcgtttaccgtaggttacttccgttaccgacggacggacccgacggtacccctaaccccttcccccttaatttttacgacctaagtttacgttaactttaacctaaaaccgtttccggtaccgggaccccgtccccgttacgacgggtaccgttaccccgttacggtaacccgttccggtttttccgggccttaaccgtaacgggttcggtacgggggaacctaccgacggtccctaacctcgtacgttaaccggtacggtttacccggggaccctaacgggccctaaggtaccgtacggtacgggacgggttaacgttacttttacggtcggttacggacgggtacgggtacgggacacggacctacgtaaccttcctacgttccgggtaccgggacggggtaacgggtacgaacgggtacgtacgggtacccgtcggtaccgggtcacccggtacccggacggcccgtacccggtccccggtaccggtccgttacccttcccgttacccgttcccccaacccgtttccctcccgtaacggttccg

SEQ ID NO: 228439 - DNA, 740 bp, Homo sapiens
  misc_feature: GYAE6OF01C0S63.4.49.E05.1.454.CMB.1.raw
  modified_base (142)..(142): a, c, t, g, unknown or other
  misc_feature (142)..(142): n is a, c, g, or t
  modified_base (632)..(632): a, c, t, g, unknown or other
  misc_feature (632)..(632): n is a, c, g, or t
tcagagcactgtagcacgaccggtgctcgatttagagcgactagcaacacacaaaggggctgggcctcaggaagcagcatcgggaggtgcctcagccatggcatggactccctctcttcctcggcgtccttgcttactgcanacggattcgggcctccatcaactgactcacgccacctcagtcgtccgtcctaccccgaagggacggacagcccgtacactcggtacctgacctacgtacggaaacctaacggtttggggtaccctaaggtattaacgttcggttttacccgtaggttaactccgttaccgaacggacggtaccgaccgggtacccctaccgttaccccccgttaagttttaacgtaccgtaattaacgtaacttaaccgtaaacgttaccggaccgtcccggtaccctacgtaacgggtaccgttacccgtacggtaacgttccgttttacgggacctaccgtacggttacgacgggactacgacgtcctaactcgtaacgtactaacggtaccgggacacggcctatacgagtaggaacggttagttactttagagtcgtaggtcggtacgacgacgaacctaactaccgtacgacgttggtaccggacggtacggganaccggtataccggtacgtcggtagcccacggtaaccgacggtccctccggtcccgtaccgtaccgtacctccgtcccgttaccccgccttacccaccgtactacccgg

SEQ ID NO: 228440 - DNA, 810 bp, Homo sapiens
  misc_feature: GYAE6OF01CZQPR.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgttccttgcttactgcacaggattcggggcctcctatcaactgactcacgcccacctcagtcgtcccgtctccccgaggacggacacgccgtcagtcgacctgctacgtaggaaactacgttggggtaccagacttattcgtttcgtaggtactcaccgtagacggccacggacctaccctacccccgttattttacgtacctagttacgttaactaccgtaaaaccgtttccggaacggtcccggtacccctacggtaacgggtaccgtttaccccgtacggtaacccgtttcccggttttaccggggaccgttacccgtaaacgggttccggtaacggggggtaaccaaccggacggtaccctaacgtttaccgtaccggtaaccgttaacccggtttaccccgggggacccctacgggaccctacgtacggtacgtacgggaacggggtacgtttaacgttttaccgcggttacggacggggtaccggtacgggaacgtacgaccgtaacctaacgttcctacgttccggttaccgggacgggtaacggaccgtaacgggtactaccgggtacccggtacggtcgggtaccaccggtacccgaacgggtccctcccggtaccccggtcgtacccgtcccgttccgtaccccgttaccccacccgttcccctaccgtcgtaccgg

SEQ ID NO: 228441 - DNA, 825 bp, Homo sapiens
  misc_feature: GYAE6OF01B8HKX.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggagttcggggcctcctatcaactgactcagcccaccctcagtcgtccgtcctcccgaggaccggcacgtccgtcagtcgacctgcctacgtaggaaactaacgttcggggaccaggtactagttcgtttccgtaggtacttctaccgacggtacggccgtacggccctacctcccccgttaattttaccgtactagttacgtacttaaccgtaaacggttccggaacggtccgtcccctaggtacggtaaccggtccctagggtaacccgttcgtttaccgggtacttaccggaacggttaccggcggggtaaccaccgtaccggacctacgtccgttacggtaaccgttacccgggtttacccggggcccgtaacgggtaccctaggtaccggtacgtagggtaaccggggttaactttaccgttttaacgtcggttacgggacgggttcgggtacggaactaccgtaaccgaacttaacccgttacacggttccggttacggggacggtaaccgggtcgtaaccgggtacgtccggttacccgtccgggttaccggtaccgaccggtacccggaagggttccccgtaccccgggtaccccctttcggggtaccctaccccggtttcccgttacccggtaccccccgtttccccttaacccggtcccgttaacggtcccggg

SEQ ID NO: 228442 - DNA, 875 bp, Homo sapiens
  misc_feature: GYAE6OF01ETQOK.4.49.E05.1.454.CMB.1.raw
tcagagcactgtagcacgaccggtgctcgatttagagcgactagcaacacacaaaggggctgggcctcaggaagcagcatcgggaggtgcctcagccatggcatggatccctctcttcctcggcgtccttgcttactgcacaggagttcggggcctcctatcaactgactcacgcccaccctcagtcgtccgtcctccccgaggacggacacgccgtcatcgacctgctcgtacggaaacacgttgggtccagatattgtttcctggtactcctccgagacggccacggccctacctcccctattttacgctagtcgtactaccgtaaacgttccggacggccgtccccgtagacgggtacgtcccgtacggaaccgttccgttttccggggaccttaccgtaacggtccggtacggggaaccacgacggccctaacgttccgtacggttaaccgttaaccgggttaccccgggggacccctaacggggtaccctaacgttaccgggaagttacgggtaaacgggggttacgttttaaaccgtttttaccggtcgggttaccggagggggttaccggttacgggggaacctacggtacccgtaaacccgttaaccccgtttccgtaacgtttcccgggttaccgggggaaccgggggtaacggggtaacccgtaaccggggtaacgttaccccgggtaaccccgggttccggttacgggggtaaccccgaaaccgggtacccccggtaaacggggtccccgttaaccccgggtacccccccgttacggggttcccctaacccggtttccccgttacccccgggttacccccccgttacccccgttacccccgtttacccgtaccggttacccggg

SEQ ID NO: 228443 - DNA, 697 bp, Homo sapiens
  misc_feature: GYAE6OF01CAVU3.4.49.E05.1.454.CMB.1.raw
  modified_base (207)..(207): a, c, t, g, unknown or other
  misc_feature (207)..(207): n is a, c, g, or t
tcagagcactgtagcacgaccggtgctcgatttagagcgactagcaacacacaaaggggctgggcctcaggaagcagcatcggaggtgcctcagccatggcatggactcctctcttcctcggcgttccttgcttactgcacaggacttcggggcctctatcaactgactcacgccacctcagtcgtccgtcctcccgaggacggacncgcctcatcgacctgctactaggaaactacgttcgggacagatattgttccgtgttactctccgaggacgccacgtccctaccttccccttagtttacgtctagttacgttactacgtaacgttcggacggtcccgtccccgtacgacgggtacctccgtagtaaccgttcgtttccggctaccgacgtcggacgggacacgacgcctacgtcgtacgtaccgttaccggttacccgggcctacggtaccgtacgtacggtacgtagggtacgggtaacgtttaccgtttacgtcgtacggacgggtcggtacgggactacgtacaacgtaccttcgacgttccggtacgggaccgggacgggtaccgacggtcgtaccgtacccggttggtccggtacgaccggaccgtacggtcccgtacccgtaccccggtcgtccctaaccgttcccgttacccgtacccctacccgttcccttccgtaccgtcgg

SEQ ID NO: 228444 - DNA, 784 bp, Homo sapiens
  misc_feature: GYAE6OF01DR4VE.4.49.E05.1.454.CMB.1.raw
tcagagcactgtagcacgaccggtgctcgatttagagcgactagcaacacacgaaaggggctgggcctcaggaagcagcatcggaggtgcctcagccatggcatggactccctctcttcctcggcgtccttgcttactgcacaggagttcggggcctcctatcaactgactcacgccacctcgagtcgtccgtcctcccgaggacgacacgccgtcacgtcgacctgctacgtacggaaaccgtaacggttcggggtaccagtattagttcgtttccgtaggtacttccgtaccgaggtacggaccgacggcccaccttacccccttatttacgtctacgttagtactaaccgtaaacgttccggtaccggcccgtaccccgaccgtacgggtaccgttccgtacggtaaccgttccgtttccgggtccgtaccgtacggtacgtacgggtaccacgacgacctacgtcgtacgtaaccgttaccggtacccgggacccgtacggtacctacggtaccgtagtaggggaacggttaacgtttaccgtttaacggtcggtaccggtaggggtccgtacgggaaccgcgtaacccgtacttaacccgttacgtaacgttccgggtaccgggacgggtaaccggggaacacgggttacgtacccgggtaccggtaccggtccgggaccgtacccgggtccgtaccggtcccgtccccggtacccgtccggtaccttcccggtccccgttcccgttcccccgacccctttccgtacccgtacggtcgg

SEQ ID NO: 228445 - DNA, 970 bp, Homo sapiens
  misc_feature: GYAE6OF01DJ8YO.4.49.E05.1.454.CMB.1.raw
  modified_base (138)..(138): a, c, t, g, unknown or other
  misc_feature (138)..(138): n is a, c, g, or t
  modified_base (257)..(257): a, c, t, g, unknown or other
  misc_feature (257)..(257): n is a, c, g, or t
tcagagcactgtagcacgaccggtgctcgatttagagcgactagcaacacacaaaggggctgggcctcaggaagcagcatcggaggtgcctcagccatggcatggactccctctcttcctcggcgtccttgcttactncacaggattcggggcctctatcaactgactcagcccaccctcagtcgtcccgttcctcccgagggaccggacacgccgtcatcgacctgcctacgtacggaaactacggttaggggganagtatattgtttccgtaggtactcgtaccgaggacggaccgacggacccctacccttccccgttatttacccgtaggttacctagttacgttaactaacccgtaaaaccttacggaacggtccccgaccccgttacggtaccgggggtcccctacgggtaccggttccgtttccgtttttccggtaacggggtcccttaacccggtaacgggtttacccgggtacggggggtaaaccctaaccggtacccgtaccccgtaccggtttaccttaccgggttacccgttacccggttccccggggttaccccgggggacccctacccggggtaccctaacggttaccgggtacggtacgggggtaacgggtaaacgtaccggttttacttaccggttacggttaccgggtaccgggggtaccgggtacgggggtaaccctacgggtaaccgtaaaccggtaccggttaccggtaaccgggttacgggttacccgggtttaccgggggaaccggggggtacccggggtaacccggggtaacggggttacccggggttacccggttaccggggttaaccggggtacccgggaaacccgggtaccccgggtaaccgggttacccccggttaccccgggtaccccccccggtttcgggtaacccgttaccccggtttaccccgggttcccccggttttacccccggttaacccccccgg

SEQ ID NO: 228446 - DNA, 725 bp, Homo sapiens
  misc_feature: GYAE6OF01BCL6P.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggagttcggggcctcctatcaactgactcacgccaccctcagtcgtcccgtcctccccgagggacggacacgccgtcactcgacctgctacgacggaaactacgttggggtaccagtatacttcgtttcctaggttacttcctccgaggacgccacggccctaccttacccctattttacgtctattcgttactacctaaacgttcgacggtccgtccccgtcgacgggtaccgtcccgtaggtaaccgttccgtttccgggacctaccgtaacggtcggtacgggacacgacgacctacgtctacgtaccgttaccggttcccgggaccacgggcctacgtcgagtcgggtaggtaccgttacgtttacgcgttacggacgggtcggtcgggactaggaccctaacgttaccgtaccttacggtcccggttacggggaaccgggtacgggtaccgtaccgggtagtccgggtacccggttcggtacgggaccaccggaccgtacgggtcccgtcccgtcccccggtcggttccctacccgttccgtcccggttcccccgtaccttcccgtacccgttcgtacg

SEQ ID NO: 228447 - DNA, 781 bp, Homo sapiens
  misc_feature: GYAE6OF01C2V44.4.49.E05.1.454.CMB.1.raw
  modified_base (582)..(582): a, c, t, g, unknown or other
  misc_feature (582)..(582): n is a, c, g, or t
tcagagcactgtagcacgaccggtgctcgatttagagcgactagcaacacacaaaggggctgggcctcaggaagcagcatcgggaggtgcctcagccatggcatggatccctctcttcctcggcgtccttgctttactgcacgaggagttccgggggcccttcctatacaactcgaactcgacgccctaccctcgacgttcgtacccgtcctaccccgagggaccggaccacgcccgtacagtcgacctcgcctcgtaacggaaactaacggttcgggggtaccagtacttacgttcgtttccgtaggttactcctaccgaggaacggccacggtccccaccttccccctattttacgctagtagttactaccgtaacgttcggacggacccgtcccctagacggtcctcccgtacgtacgttcgtttccggctaccgacgtcggtagggacctacgacgcctacgtcgtacgtaccttacgggtaccccgggaccgacggcctacggtacggtagtacgggtaacgggttacgtttaacgtttcgtaggttaccggacggggttaccggtacggggaaccngtaacccgtaaccgttaccgttaaccgtcgttaccggtaccgggtaacggggaccggtaccgacgggtaactcgggtaacccgtcgggtacgggacgtacccggtacccggaacggtccccgtacccgggttacccccggttggtacccctaccgttcccttcccggtaccccctcccgtaccccgttctcggtaccgg

SEQ ID NO: 228448 - DNA, 887 bp, Homo sapiens
  misc_feature: GYAE6OF01A1PQX.4.49.E05.1.454.CMB.1.raw
tcagagcactgtagcacgaccggtgctcgatttagagcgactagcaacacacaaaggggctgggcctcaggaagcagcatcggaggtgcctcagccagtggcatggactccctctcttcctcggccgtccttgcttactgcacgaggtagttccggggcctcctatcgaactcgactcgacgcccaccctcgtaggtcgtcccgtacctacccgagggaccggacgacggtccgtacgtactcgtaccgtcgtacctacgtaacggaaaccttacggttcgggtacctaagtattacgttcgttccgttagtactaccgtacgtaaggaccggaccgacgacccctacccgttacccccgttaagttttaccgcgtaagttcgttaaccgtaaccgttaaaccggtccggaccggtcccgtacccgtaggtaccggtaccgttacccgtacgggtaccgtttacccgggtttaccggaccctacggttaacgcgggttaaccggaccctaaccggaccgtaccctaccgttaccgtaacggttaacccgttacccgggtacccggggacccgtaacggtacccgtaggttaccggtaacgggtacggtaaaccgggttacgttttaaccggttacggtacggtaccgggaaccgggtagggtaccggaacctaccgtaaccgtaccttaacccggtaccgttaacgttcccgggtaccggggacggtacggggtaacccggaagttcccggtaaccgggtacccgtcgggtaccgaccggacccggacccggttaccgtcccggttaccccgtacccgggttccgtaccggttacccttccccggtttacccgtccccccgttactaccccgtgttcccgtaccggg

SEQ ID NO: 228449 - DNA, 520 bp, Homo sapiens
  misc_feature: GYAE6OF02IOMB6.4.49.E05.1.454.CMB.1.raw
tcagagcactgtagcacgaccggtgctcgatttagagcgactagcaacacacaaagggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttagtcatgtatcaaacttcgaggcgcccctcaggagtccctgaacgctttcgggctccaagtctggggacacagccactctgactattaccggggccaggccatcgatgagggagactttactgtcaggcgtgggacagcacaacttccatcttcggcggagggacacggatgaccgtcctgggtcagcccaaggctcgcccctcggtcactctcttcccaccctcctcctacacg

SEQ ID NO: 228450 - DNA, 528 bp, Homo sapiens
  misc_feature: GYAE6OF02INIZG.4.49.E05.1.454.CMB.1.raw
  modified_base (413)..(413): a, c, t, g, unknown or other
  misc_feature (413)..(413): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttagtcatgtatcaaacttcgaggcgcccctcaggagtccctgaacgcttttcgggctccaagtctggggacacagccactctgactacttaccggggcccaggcccatcgatgagggagacttttacngtcaggcgtgggacagcacaactccatcttcggcgagggacacggatcggaccgtcctgggtcagcccaggctcgcccctggtccacgtcctcgttcccgccctcctcctactcg

SEQ ID NO: 228451 - DNA, 538 bp, Homo sapiens
  misc_feature: GYAE6OF02G9SF2.4.49.E05.1.454.CMB.1.raw
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttacgtcatgtatcaaacttcgaggcgccctcaggagtccctgaacgtctttcgggctccaagtcgtggggacacagccactctgactacgttacccggggcccaggccatcgatgagggagtacttttacgngtcaggcgtggacngcacactcatctcggcggagggacacggatcggaccgtcgtgggtcacggcccaagggcctcgcccccgtggtccactcctcgttccccgccctccgtcctactcg

SEQ ID NO: 228452 - DNA, 533 bp, Homo sapiens
  misc_feature: GYAE6OF02IBFK2.4.49.E05.1.454.CMB.1.raw
  modified_base (409)..(409): a, c, t, g, unknown or other
  misc_feature (409)..(409): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttagcatgtatcaaacttcgagcgccctcaggactcctgacgtctttcgggctccaagtcgtgggacacagccactctgactagtacccggggcccaggccagtcgatgagggagtactttacngtcaggcgtggacagcacactcatcgttacggcgagggacacggatcgaccgtcgtgggtcacgcccgaaggcctcgcccccgtggtccacgttcctcggttccccaccctcctccctacgtcg

SEQ ID NO: 228453 - DNA, 528 bp, Homo sapiens
  misc_feature: GYAE6OF02I14I2.4.49.E05.1.454.CMB.1.raw
  modified_base (316)..(316): a, c, t, g, unknown or other
  misc_feature (316)..(316): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttagtcatgtatcaaacttcgaggcgcccctnacggagtcctgaacgctttcgggctccaagtctggggacacagccactctgactattaccggggcccaggccatccgatcggagggagtacttttacgtgtcaggtcgtgggacagcacactccatcgttcggcgagggcncggatgaccgtcngggtcagcccaaggctcgccccgtcggtcactcgtcgttcccaccctcctcctactcg

SEQ ID NO: 228454 - DNA, 578 bp, Homo sapiens
  misc_feature: GYAE6OF02HUATP.4.49.E05.1.454.CMB.1.raw
  modified_base (434)..(434): a, c, t, g, unknown or other
  misc_feature (434)..(434): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccacctcccccctatttttacgtcatgttactacaaacctttcgacggccgcccctcgaggacgtccctagaacgtctttcggctccaagtcgtggggacacagccactctgactacgttacccgggcccaggccagtcgatggagggtagtacttttacgngtcgaggcggtgggacagccaactaacttccatcgtcggcggacgggacacggatcgaccgtccgtgggtcacgcccgaaggcctaccgccccgtcggtccaccgttccttccggttccccgcccttccctacccgtactacgg

SEQ ID NO: 228455 - DNA, 528 bp, Homo sapiens
  misc_feature: GYAE6OF02FM5N2.4.49.E05.1.454.CMB.1.raw
  modified_base (409)..(409): a, c, t, g, unknown or other
  misc_feature (409)..(409): n is a, c, g, or t
tcagagcactgtagcacgaccggtgctcgatttagagcgactagcaacacacaaagggctgggcctcaggaagcagcatcggaggtgcctcagccatggcatggatccctctcttcctcgcgtccttgcttactgcacaggattcggggcctcctatcaactgactcagccaccctcagtgtccgtctccccaggacggacagccgtcatgacctgctctggaacaacttggggtccagatatgtttcctggtatctccagaggccaggccactccccccatttagtcatgtatcaaacttcgaggcgcccctcaggagtccctgaacgcttttcgggctccaagtctggggacacagccactctgactattaccggggcccaggccatcgatgagggagacttttacngtcaggcgtggacagcacaacttccatcttcggcggagggacacggatgaccgtctgggtcagcccaaggcctgccccctcggtcaccgttctcgttccccaccctccctcctactacg

SEQ ID NO: 228456 - DNA, 556 bp, Homo sapiens
  misc_feature: GYAE6OF02IS40E.4.49.E05.1.454.CMB.1.raw
  modified_base (315)..(315): a, c, t, g, unknown or other
  misc_feature (315)..(315): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttacgtcatgtatcaaacttcgagcgccctnaggatccctgacgtctttcgggctccaagtctgggacacgagccactctgactagtaccgggcccaggccatcgatggagggatacttttactgtcgaggcgtgggacagcacactccatccgttacggcggaggacacggatcggaccgtccgtgggtccacggacccgaagggcctccggcccccgtcggtccaccgttccgttccgttccccaccccttccctacccgtacgtaccgg

SEQ ID NO: 228457 - DNA, 579 bp, Homo sapiens
  misc_feature: GYAE6OF02GDMZR.4.49.E05.1.454.CMB.1.raw
  modified_base (425)..(425): a, c, t, g, unknown or other
  misc_feature (425)..(425): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactccccccattttagtcatgtatcaaacttcgaggccgcccctcaggacgtccctgaacgtcttttcgggctccaagtctggggacacgagccactctgactacgttacccggggcccaggccagtccgatggagggagtacttttacgngtcaggcgttgggacgagcacaacttccatcttcggacggacgggacgacggatcgaccgtccgtgggtcacgcccgaagggcctaccggccccccgtcggtcctaccgttccgttccggtttccccgccccgtcccttccccgtacgtaccgg

SEQ ID NO: 228458 - DNA, 550 bp, Homo sapiens
  misc_feature: GYAE6OF02I2X87.4.49.E05.1.454.CMB.1.raw
  modified_base (535)..(535): a, c, t, g, unknown or other
  misc_feature (535)..(535): n is a, c, g, or t
  modified_base (542)..(542): a, c, t, g, unknown or other
  misc_feature (542)..(542): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacgttggggtccagatatgttcctggtatctccagaggccaggccactcccccattttacgtcatgtatcaaaacgttcgaggccgcccctcgaggacgtccctagaacgtcgttttcgggcctccgaagtcgtcggggacacacgaccactctcgactacgttacccggggccctaggccagtcgagtggagggagtactttacgtgtcgaggcggtggacagcacaactcatcgtcggcggtaggacacggatcgtacgtccgtggcacgccgaaggcctccgcccgtcgtcactcgtcgtcccnccctccncctacacg

SEQ ID NO: 228459 - DNA, 534 bp, Homo sapiens
  misc_feature: GYAE6OF02G5G3R.4.49.E05.1.454.CMB.1.raw
  modified_base (412)..(412): a, c, t, g, unknown or other
  misc_feature (412)..(412): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttagcatgtatcaaacttcgaggcgcccctcaggactccctgaacgtcttttcgggctccaagtctggggacacacgccactctgactagttacccgggcccaggccatcgatgagggatactttacngtcgaggcgtgggacagcacactccatcgttcggcggaggacgacgatcgaccgtcgtggtcacgccgaggtcctcgccccgtcggtcctacgtctcggttcccgccctcctcctacgtcgg

SEQ ID NO: 228460 - DNA, 525 bp, Homo sapiens
  misc_feature: GYAE6OF02H1807.4.49.E05.1.454.CMB.1.raw
  modified_base (409)..(409): a, c, t, g, unknown or other
  misc_feature (409)..(409): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagagccaggccactccccattttagcatgtatcaaacttcgagcgcccctcaggagtcctgaacgcttttcggctccaagtctggggacacagccactctgactacttacccggggcccaggccatcgatggagggagtactttacngtcgaggcgtgggacagcacacttccatcttcggcgagggacacggatgaccgtccgtgggtcagccgaggctcgcccccgtggtccacgtctcgtccccacctcccttccactcg

SEQ ID NO: 228461 - DNA, 568 bp, Homo sapiens
  misc_feature: GYAE6OF02JNBNU.4.49.E05.1.454.CMB.1.raw
  modified_base (309)..(309): a, c, t, g, unknown or other
  misc_feature (309)..(309): n is a, c, g, or t
tcagagcactgtagcacgaccggtgctcgatttagagcgactagcaacacacaaagggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgttcctggtatctccagaggccaggccactccccatttacgcatgtatcaaactcgagcgccctnaggacgtcctgaacgtctttcggctccgaagtctgggacacgacgccactctcgactacgttaccggggccctaggccatccggatcggaagggtacgtacgttttactggtccgaggcgtcgggacagccaactaacttccatccgttcggacgggacgacgacggatcgaaccgtccgtgggtaccacgcccgtagtccggctcggcccccttcggtccaccgttcgtaccggttccccacccgttcctcccgtacg

SEQ ID NO: 228462 - DNA, 543 bp, Homo sapiens
  misc_feature: GYAE6OF02HP185.4.49.E05.1.454.CMB.1.raw
  modified_base (306)..(306): a, c, t, g, unknown or other
  misc_feature (306)..(306): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtcccgtctccccaggacggacagccgtcatgacctgctctggaaacacttggggtccagatatgttcctggtatctcagaggccaggccactccccattttagtcatgtatcaacttcgagcnccctcagacgtccctgaacgtctttcggctccgaagtcgtggggacacgacgcctactctcgacttacgttaccggggcccacggccactcgagtcgagggagtacgtttacgtgtcgtaggcggttgggacagccaactactccagtccgttcggcggacggacgacggatcgacgccgtggcacgccaggctccgcccgtcgtccacgtctcgtcccgtccctcctcctataccg

SEQ ID NO: 228463 - DNA, 554 bp, Homo sapiens
  misc_feature: GYAE6OF02I0UPQ.4.49.E05.1.454.CMB.1.raw
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagagccaggccactccccattttagcatgtatcaaacttcgagcgccctgagatccngacgctttcggctcaagtcngggacacagccactctgactacgttaccgggccaggccagtcgatggaggtacgtactttacgtgtcgaggtcgtggtacagccactactcatcgttacggcggtacggacacggactcgaccgtcgtagggtcacgaccgaacgggtctaccggccccgtacggtccgtacttccgttccgttacccctacccgtcccgttacctacccgtacgg

SEQ ID NO: 228464 - DNA, 555 bp, Homo sapiens
  misc_feature: GYAE6OF02IA0U7.4.49.E05.1.454.CMB.1.raw
  modified_base (311)..(311): a, c, t, g, unknown or other
  misc_feature (311)..(311): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacgttggggtccagatatgtttcctggtatctccagaggccaggccactcccccattttacgcatgtatcaaacttcgaggcnccctcaggactccctgacgtctttcggctccaagtctggggacacgagccactctgactacgttacccggggcccaggccagtcgagtggagggagtactttactgtcgaggtcggtggacagcacacctcatcgttcggcggaggacgacggatcgaccgtccgtgggtcacgcccgaggtcctccggtcccccgtcgtcctaccgtccgttcgttccccgcccgttccctcccgtactccgg

SEQ ID NO: 228465 - DNA, 547 bp, Homo sapiens
  misc_feature: GYAE6OF02HJW6K.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttacgtcatgtatcaaacttcgagcgccctcagagtcctgaacgcttttcgggctccgaagtcgtggggacacagccactctgactagttaccggggccaggccatcgatggagggagtactttacgtgtacgaggtcgtgggacagcactaactccatccttcgggcgagggacacggatcgaccgtcgtgggtcacgcccgaaggccgtcgcccctcggtccaccgtccgttcgttccccacccctcccttcctactccg

SEQ ID NO: 228466 - DNA, 689 bp, Homo sapiens
  misc_feature: GYAE6OF02JH771.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcgggcctcctatcaactgactcagccacctcagtgtccgtctccccaggacggacagccgtcatgacctgctctggaaacaacttggggtccagatatgttcctggtatctccagacggccaggccacctccccctattttacgtctatcgtactacctaaacgttcggaacggccgtcccctacgacgggtacgttcccgtaggtaaccgttccgttttccgggaccttaccgaacgttcgtacggggtaccacgacgtaccgtactcgtacgtaccgtacggtacccgggaccacgggaccacgtacgacgtgggacggtacttacgttttacgcgtacgacgggtcggtacggacacgtacctactaacgttcccagttaccgttacggggaccggtagggtaaccgtacgggacgttccggaccggttacccgtagggtaccacggacccgtaaggtcccgtaccgtccccggtaccggtacctacccgttccgttcccggttaccccctcccggtttacccctaccgttaccgtccgg

SEQ ID NO: 228467 - DNA, 579 bp, Homo sapiens
  misc_feature: GYAE6OF02G7N4Z.4.49.E05.1.454.CMB.1.raw
  modified_base (421)..(421): a, c, t, g, unknown or other
  misc_feature (421)..(421): n is a, c, g, or t
  modified_base (436)..(436): a, c, t, g, unknown or other
  misc_feature (436)..(436): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttagtcatgtatcaaacttcgagccgcccctcaggacgtccctgaaccgtcttttcggggcctccgaagtcgtggggacacgagccactctgactacgttaccgggccaggccatcgatgagggagtacttttacngtcgaggcgtggacngcacaacttccatcttcgggcggacgggcacgggatcggacccgtccgtgggtccaggtcccgaagggcctccggaccccccgttcgggtacccaccgttccgttacggttcccccgtccccgttcccttccctaccgtacgg

SEQ ID NO: 228468 - DNA, 533 bp, Homo sapiens
  misc_feature: GYAE6OF02GG3HU.4.49.E05.1.454.CMB.1.raw
  modified_base (412)..(412): a, c, t, g, unknown or other
  misc_feature (412)..(412): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactccccccattttagtcatgtatcaaacttcgaggcgcccctcaggagtccctgaacgcttttcgggctccaagtctggggacacagccactctgactagttaccgggccaggccatcgatgagggagacttttacngtcaggcgtgggacagcacacttccatcttcggcggagggacacggatcgaccgtcgtgggtcacgccaaggcctgcccccgtggtccactccgtcgttccccgccctccttcctactcgg

SEQ ID NO: 228469 - DNA, 533 bp, Homo sapiens
  misc_feature: GYAE6OF02IK3I2.4.49.E05.1.454.CMB.1.raw
  modified_base (322)..(322): a, c, t, g, unknown or other
  misc_feature (322)..(322): n is a, c, g, or t
  modified_base (414)..(414): a, c, t, g, unknown or other
  misc_feature (414)..(414): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactccccccattttagtcatgtatcaaacttcgaggcgcccctcaggngtccctgaacgtctttcgggctccaagtctggggacacagccactctgactattacccggggcccaggccatcgatgagggagtactttacngtcaggcgtgggacagcacacttccatcttcggcggagggacacggatcgaccgtccgtgggtccagcccgaggctcgccccctggtccactcgtcgttccccaccctcctcctactcg

SEQ ID NO: 228470 - DNA, 538 bp, Homo sapiens
  misc_feature: GYAE6OF02F1LPK.4.49.E05.1.454.CMB.1.raw
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgttcctggtatctccagaggccaggccactcccccattttagtcatgtatcaaacttcgaggcgcccctcacggagtccctgaacgcttttcgggctccaagtctggggacacacgccactctgactagttacccgggccaggccatcgatgagggtagacttttacngtcaggcgttgggacagcacgtactcatcttcggcggaggcacggntgaccgtcgtgggtcacgcccaaggcctcgcccccgtcggtccaccgtcgttcgtccccgtccctccctccgtactcgg

SEQ ID NO: 228471 - DNA, 570 bp, Homo sapiens
  misc_feature: GYAE6OF02GQT0Y.4.49.E05.1.454.CMB.1.raw
  modified_base (418)..(418): a, c, t, g, unknown or other
  misc_feature (418)..(418): n is a, c, g, or t
  modified_base (466)..(466): a, c, t, g, unknown or other
  misc_feature (466)..(466): n is a, c, g, or t
tcagagcactgtagcacgaccggtgctcgatttagagcgactagcaacacacaaagggctgggcctcaggaagcagcatcggaggtgcctcagccatggcatggatccctctcttcctcgcgtccttgcttactgcacaggattcgggcctcctatcaactgactcagccaccctcagtgtccgtctccccaggacggacagccgtcatgacctgctctggaaacacttggggtccagatatgtttcctggtatctccagaggccaggccactcccccattttagcatgtatcaaacttcgaggcgcccctcaggacgtccctgaaccgtcgttttccgggctccaagtctggggacacgagcccatctgacttattacccggggcccaggcctatccgatgagggatacttttacgngtcaggcgttgggacagcactactccatcgttcggcgagggacacggntcgaccgtccgtgggtccacgcccaagggtcctaccggtccccccgtcgggtcctaccgttccgttaccgttcccccgtacccctcccgttaccctacgtaccg

SEQ ID NO: 228472 - DNA, 533 bp, Homo sapiens
  misc_feature: GYAE6OF02GOL7W.4.49.E05.1.454.CMB.1.raw
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttagtcatgtatcaaacttcgaggcncccctnaggngtccctgacgctttcggctccaagtctggggacacagccactctgactagttacccggggccaggccatcgatgagggatactttacngtcaggcgtgggacagcacacttccattctcggcggaggacacggatcgaccgtcgtgggtcacggcccaaggcctcgcccccgtggtcctaccgtctcgttccccgccctcctccctatccgg

SEQ ID NO: 228473 - DNA, 543 bp, Homo sapiens
  misc_feature: GYAE6OF02GMX9I.4.49.E05.1.454.CMB.1.raw
  modified_base (416)..(416): a, c, t, g, unknown or other
  misc_feature (416)..(416): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttggggtccagatatgtttcctggtatctccagaggccaggccactcccccattttagtcatgtatcaaacttcgaggccgcccctcaggagtccctgaaccgcttttcgggctccgaagtctggggacacagccactctgactagtaccggggcccagggccatcgatggagggagtactttacnggtcagggcgtggacagcacacttccatcgtcggcggagggacacggatgacccgtcgtgggtcacgcccgaggcctccggcccccgtcggtccacgttcctcgttccccaccctcctcctacgtcg

SEQ ID NO: 228474 - DNA, 566 bp, Homo sapiens
  misc_feature: GYAE6OF02GS6UO.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttagtcatgtatcaaacttcgaggcgcccctcaggagtccctgaacgtcttttcgggctccaagtctggggacacagccactctgactacgttacccgggcccaggccatcgatgagggagtactttactgtcgaggcgtgggacagcacgacttccatcgttcggcggacgggacacggagtcgaccgttcgtgggtcacgcccgaagggcctacggccccccgtacggtccctaccgttccgtccgtttacccccaccccttcccttccctactaccgg

SEQ ID NO: 228475 - DNA, 555 bp, Homo sapiens
  misc_feature: GYAE6OF02I930N.4.49.E05.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
  modified_base (508)..(508): a, c, t, g, unknown or other
  misc_feature (508)..(508): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccaggaggccaggccactcccctattctagtcatgtatcaaactacgaagccgcccctnacggggtccctgacgcgtcttttcnggctccaagtcgtggggacacaggcccacttcgngtactcgtccgtcccggggcccaggcccagtcgagtggaacgggngtactagttactggtacgagggtcgtgggaccagactacaactgcagtccgttcgggcggagggaccgagggtcgaccgttccgngggtcacggcccaaggcctcgccccgtcgccgactccgtcgtccccg

SEQ ID NO: 228476 - DNA, 569 bp, Homo sapiens
  misc_feature: GYAE6OF02H7DX0.4.49.E05.1.454.CMB.1.raw
  modified_base (429)..(429): a, c, t, g, unknown or other
  misc_feature (429)..(429): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacgttggggtccagatatgtttcctggtatctccagaggccaggccacctccccctattttagcatgtatcaaacttcgagccgcccctcaggactccctgaacgtcttttcgggctccgaagtcgtggggacacgacgccactctagacctacgttacccggggcccagggccagtcgagtggagggagtacttttacgngtcgaggtcggtggacagcacactccattcgttacgggcggaggcacggatcggaccgtcgtgggtccacgcccgaagggtcctccgccccgtcggtccaccgttcgtccgttccccctaccctcccttcccgtatccgg

SEQ ID NO: 228477 - DNA, 695 bp, Homo sapiens
  misc_feature: GYAE6OF02ITG24.4.49.E05.1.454.CMB.1.raw
  modified_base (324)..(324): a, c, t, g, unknown or other
  misc_feature (324)..(324): n is a, c, g, or t
  modified_base (425)..(425): a, c, t, g, unknown or other
  misc_feature (425)..(425): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctcccaggacggacagccgtcatgacctgctctaggaaacaacgttggggtccagatatgtttcctggtatctccagacggccaggccacctcccctatttacgtcatcgtatacaaacttcgacggccgcccctnaggacgtccctgaaccgtcgtttcgggcctccgaagtcgtgggactacgacgccactctacgtactacggtaccgggccaggccagtcgatggaacgggtntacctttacgcgtacgacgggtcgtcgggtaaccacgtccaacgtaaccttcccgaacgttcggttaccgggacgggtaacggggaccgtacgggacgtacggtaacccggttccggtacgggtaccgaccggtaccccggaaacgggtcccgttaccccgggacccccccggttacgggttacccccgtaaccggttccccgtttaccccgggtttacccccccggtacccccttttaccccggtacccccgtaaccggttaccccggg

SEQ ID NO: 228478 - DNA, 658 bp, Homo sapiens
  misc_feature: GYAE6OF02IGNNS.4.49.E05.1.454.CMB.1.raw
  modified_base (211)..(211): a, c, t, g, unknown or other
  misc_feature (211)..(211): n is a, c, g, or t
  modified_base (333)..(333): a, c, t, g, unknown or other
  misc_feature (333)..(333): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtctccccaggacggacagccgtnatcgacctgctcgtaggaaacaacgttggggccagatatgttcctggtatctcagacggccaggcctactcccctatttacgctatcgtactacaaacttcgacgcgccctgaggacgtccngtaacgtcgtttacggctccgtaagtcgtggggacacgtacgacctactcgtacgacttacgttaccgggcccaggaccacgtcgatggacggtacgtactttacgtgtacgaggtcgtacgggactacgacaacgtaacgttccgaagttccggtaccgggtaccgggtaacgggaccgtaacgggtataccggtacccggttacccgtggggtaccgtaccgggcccgtaacgggtccgttacccggtcccccggttaccggttacctaccgttacccgttccggttacccctaccccgttacccttacccgtacttaccggg

SEQ ID NO: 228479 - DNA, 636 bp, Homo sapiens
  misc_feature: GYAE6OF02JVUBP.4.49.E05.1.454.CMB.1.raw
  modified_base (179)..(179): a, c, t, g, unknown or other
  misc_feature (179)..(179): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctnagtgtccgtctccccaggacggacagccgtcatcgacctgctctaggaacaacgttggggtccagatatgtttcctggtatctccagaggccaggcccacctccccctattttacgcctagtcgtatacctaaacttcggacggcccgccccttacgacggacgttcccctaggtaaccgtccgttttccggggcttaccgaacggttcggtacggggacctacgacggcctacgtctcgtacttacgtacccgggccctagggacccagtccgatcgggagggtactacgttttacgtgtacgagggtcgtggacaggaccacgtactcgatcgtcggacggagcgacggagtaccgaccggtcgtacggccgacgtaccgacggccgtacccgcccggtacgtccgtacgtcccgtttccggtaccccgtcccctcccgttacccgtagtaccgg

SEQ ID NO: 228480 - DNA, 554 bp, Homo sapiens
  misc_feature: GYAE6OF02H4KM8.4.49.E05.1.454.CMB.1.raw
  modified_base (316)..(316): a, c, t, g, unknown or other
  misc_feature (316)..(316): n is a, c, g, or t
  modified_base (330)..(330): a, c, t, g, unknown or other
  misc_feature (330)..(330): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (484)..(484): a, c, t, g, unknown or other
  misc_feature (484)..(484): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtcccgtctccccgaggaccggacacgccgtcatgacctgctcgtaggaaacacgttggggtccagatatgtttcctggtatctccagacggccaggccactccccatttacgcatgtatcaaacttcgagcnccctcaggcgtccngacgtcgtttcggctccgaagtctaggggacctacgacgccactctcgacttacgttaccgggcccacggccatcgatgagggtatactttangtcaggcgtggacngcactactccatcgttggcgaggacacggatcgacgtcgtgggtacncgaccgaggtctccgccccgtacggtccacgttccgtccggttccccacccgttcctccctacgtaccgg

SEQ ID NO: 228481 - DNA, 528 bp, Homo sapiens
  misc_feature: GYAE6OF02F5697.4.49.E05.1.454.CMB.1.raw
  modified_base (416)..(416): a, c, t, g, unknown or other
  misc_feature (416)..(416): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttagtcatgtatcaaacttcgaggcgcccctcaggacgtccctgaacgtcttttcgggctccaagtctggggacacgagccactctgactagttaccgggcccaggccatcgatggagggagacttttacngtcaggcgtgggacagcacactccatctcggcgaggacacggatgaccgtcgtgggtcacgcccaaggcctcgccccgtgtccacgtctcgttcccaccctcctcctactcg

SEQ ID NO: 228482 - DNA, 535 bp, Homo sapiens
  misc_feature: GYAE6OF02H1LZZ.4.49.E05.1.454.CMB.1.raw
  modified_base (413)..(413): a, c, t, g, unknown or other
  misc_feature (413)..(413): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctcagaggccaggccactcccccattttagtcatgtatcaaacttcgaggccgcccctcacggagtcctgaacgtctttcgggctccaagtctggggacacagccactctgactagtaccggggcccaggccatcgatgagggagtacttttacngtcaggcgtggacagcacactccatcgttcggcgaggacgacggatcgaccgtctgggtcacggcccaggcctccggcccctcggtcctacgtccgtcgttccccgccctcctcctactacg

SEQ ID NO: 228483 - DNA, 530 bp, Homo sapiens
  misc_feature: GYAE6OF02FN0KR.4.49.E05.1.454.CMB.1.raw
  modified_base (317)..(317): a, c, t, g, unknown or other
  misc_feature (317)..(317): n is a, c, g, or t
  modified_base (414)..(414): a, c, t, g, unknown or other
  misc_feature (414)..(414): n is a, c, g, or t
  modified_base (454)..(454): a, c, t, g, unknown or other
  misc_feature (454)..(454): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgttcctggtatctccagaggccaggccactccccccattttagtcatgtatcaaacttcgaggcgcccctnaggagtccctgaacgcttttcgggctccaagtctggggacacagccactctgactagttaccgggcccaggccatcgatggagggtagacttttacngtcaggcgttggacagcacactccatctcggcggaggacncggatgaccgtcgtgggtcagcccgaaggcctcgccccctggtccactcctcgttccccaccctcctcctactacg

SEQ ID NO: 228484 - DNA, 580 bp, Homo sapiens
  misc_feature: GYAE6OF02FY8KG.4.49.E05.1.454.CMB.1.raw
  modified_base (316)..(316): a, c, t, g, unknown or other
  misc_feature (316)..(316): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacgttggggtccagatatgtttcctggtatctcagaggccaggccactcccccattttagtcatgtatcaaacttcgaggccgccccncaggacgtccctgaacgtcgttttcgggcttccgaagtcgtcgggacacgacgccactctcgtactacgttacccggggcccagggcccagtcgagtggaggggacgttacttttacgtgtacgagggtcggttgggacagcaactacttccattccgttcggcggtacgggacacggatcgaccgtccgtgggtcacgcccgaaggcctccgccccgtcgtccacgttccgtccgttccccgcccttcccgtacctacgtacg

SEQ ID NO: 228485 - DNA, 662 bp, Homo sapiens
  misc_feature: GYAE6OF02HOKYK.4.49.E05.1.454.CMB.1.raw
  modified_base (437)..(437): a, c, t, g, unknown or other
  misc_feature (437)..(437): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacgttggggtccagatatgtttcctggtatctcagaggccaggccactcccccattttagcatgtactcaaacttcgaggccgcccctcgacggacgtccctggaaccgtcgttttcgggcctccgaaagtcgtggggacacgacgccactctgacttacgtaccggggcccaggcccagtcgagtggagggtactacgttttaacgnggtaccgagggtccggtacgggacaggtaccaaccgtaaccttcctaacgttccgtttacggggaccggaacggggtaccgaacgggtactaccgggtacccgtcccggtaggggtccgacggtaccccggtaacgggtcctcccggtccccccggtcggtaccctaaccggttcccgttacccggttcccccgtcccccttaccgttacccctacggttaccgg

SEQ ID NO: 228486 - DNA, 543 bp, Homo sapiens
  misc_feature: GYAE6OF02IJBEZ.4.49.E05.1.454.CMB.1.raw
  modified_base (408)..(408): a, c, t, g, unknown or other
  misc_feature (408)..(408): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacttgggtcagatatgtttcctggtatctccagaggccaggccactcccccattttacgtcatgtatcaaacttcgagcgccctcagacgtcctgacgtctttcggctccgaagtctggggactacgagccactctgactacgttaccggggcccaggccatcgatgaggatactttacngtcgaggtcgtgggacagcacactcatcgttcggcggaggacacggactcggaccgtccgtgggtccacgcccgaaggcctaccgcccccgtcggtccacttccgtcgttccccacccgttccctcctaccgtcg

SEQ ID NO: 228487 - DNA, 630 bp, Homo sapiens
  misc_feature: GYAE6OF02JJP8P.4.49.E05.1.454.CMB.1.raw
  modified_base (443)..(443): a, c, t, g, unknown or other
  misc_feature (443)..(443): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatcgacctgctctcggaaacacttggggtccagattagtgtttcctggtatctccagacggccaggccactccccatttacgtcatgtactcaaacttcgacgccgccctcgacgtacgtcctgaaccgtcgttttaccgggcctccgaacgtccgtacggggacacgacgcctactctgactacgttacccggggccaggccagtcgaagttcggacggtactactttacgngtaccgagggtcgtgggtacacgctactacgtaccacgtcgttaccgggacggtaacgggaccgaacgggtacgtcggtaacccggtccggtacgggtacctacggcccgaacggtccgtaccgtcccccgtacggtccaaccgttcgttaccgttacccctacccggtcccttacctaccgtacgg

SEQ ID NO: 228488 - DNA, 549 bp, Homo sapiens
  misc_feature: GYAE6OF02I379A.4.49.E05.1.454.CMB.1.raw
  modified_base (496)..(496): a, c, t, g, unknown or other
  misc_feature (496)..(496): n is a, c, g, or t
  modified_base (523)..(523): a, c, t, g, unknown or other
  misc_feature (523)..(523): n is a, c, g, or t
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtcccgtctccccaggacggacagccgtcatgacctgctctggaaacaacgttggggtccagatatgttcctggtatctcagagccaggccacctcccccattttacgtcatgtatacaaacttcgaggccgcccctcacggacgtccctgacgtctttcgggctccgaagtcgtgggacacacgccactcacgtactacgtaccgggcccaggccactcgagtcgagggtagtacgttttacgtcgtcgaggtcggtgggacacgacaactacctccacttcgtcggcggagggacgacggatcgaccgtcgngtcacgccgacgctccgcccgtcgccnctctcgttcccnccctcctccnctcg

SEQ ID NO: 228489 - DNA, 588 bp, Homo sapiens
  misc_feature: GYAE6OF02IUZNE.4.49.E05.1.454.CMB.1.raw
  modified_base (442)..(442): a, c, t, g, unknown or other
  misc_feature (442)..(442): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccacctcccccatttttacgtcatgtatcaaacttcgaggccgcccctcacggacgtcctgaacgtcttttcgggcctcaagtcgtggggacacagccactctgactacgttacccggggcccaggccatcggatggagggatacgttttacgtgtcgaggcgtgggacngacacacttccatcgttcggcggagggacacgggtatcgaccgtcgtcgggtcacggcccgaacgggtcctccggcccccgttcgggtccctaccgttcccgttaccggttcccccgtccccgttcccgttaccccgtacgtccgg

SEQ ID NO: 228490 - DNA, 627 bp, Homo sapiens
  misc_feature: GYAE6OF02IHOEO.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtgtccgtctccccaggacggacacgccgtcatgacctgctctggaaacaacgttcggggaccagatatgtttcctggtatctccagaggccaggccactcccccattttacgcatgtatcaaacttcggacggccgccctcgacggacgtccctagaaccgtcgtttcggctcccgaagtcgtgggacacgagccactctcgacgtacgttaccggggcccaggcccaagtcgggtgaggggtactacgttttacgcggttcagggtcgtagggacagacgactaacttccagttccgttcgggacgggacggtaccgaacggtgtcgtacccggtcgtcgggtaccgacggaccgaacggtccgtaccggtccccccgtcggtccgtacccgtttcgttcccggttccccgtaccccgttcccgttacccttaccgacggttcccg

SEQ ID NO: 228491 - DNA, 545 bp, Homo sapiens
  misc_feature: GYAE6OF02HRLDY.4.49.E05.1.454.CMB.1.raw
  modified_base (322)..(322): a, c, t, g, unknown or other
  misc_feature (322)..(322): n is a, c, g, or t
  modified_base (417)..(417): a, c, t, g, unknown or other
  misc_feature (417)..(417): n is a, c, g, or t
  modified_base (456)..(456): a, c, t, g, unknown or other
  misc_feature (456)..(456): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacgttggggtccagatatgtttcctggtatctccagaggccaggccactccccctaattttacgtcatgtatcaaacttcgaggccgccctanacggatccctgaacgcttttcgggctccaagtctgggacacagccactctgactacttccggggaccaggccatcgatggagggatactttacgngtcgaggcgtgggacagacacaacttccatcgttacggnggacgggacacgggactcgaccgtcgtgggccacggcccaaggctccgcccctggtccactcgtcgtccccaccctcctaccacgtacg

SEQ ID NO: 228492 - DNA, 603 bp, Homo sapiens
  misc_feature: GYAE6OF02GZYSP.4.49.E05.1.454.CMB.1.raw
  modified_base (423)..(423): a, c, t, g, unknown or other
  misc_feature (423)..(423): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacgttggggtccagatatgtttcctggtatctccagaggccaggccacctccccctatttttacgcatgtatacaaacttcggaggccgcccctcgaggcgtccctgaacgtcgtttcggctccgaagtcgtggggacacagccactctgactagtacccggggccaggccatcgatggagggtatacttttcncgtcgagggtcgtgggacagacaacacgtgacgtacggttcgtcgggacgggacgggtacgacggggtcgtacccggtccgtggggtaccacggacccgaacgggcctaccggtcccccgttcggtccctaccgttccgttccggttcccccgtccccgtcccgtacccgaccgtccggg

SEQ ID NO: 228493 - DNA, 523 bp, Homo sapiens
  misc_feature: GYAE6OF02IF939.4.49.E05.1.454.CMB.1.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (496)..(496): a, c, t, g, unknown or other
  misc_feature (496)..(496): n is a, c, g, or t
tcagagcactgtagcacgaccggtgctcgatttagagcgactagcaacacacaaaggggctgggcctcaggaagcagcagtcggaggtgcctcagccgatggcatggatccctctcttcctcggcgtccttgcttactgcacaggattcggggcctcctatcaactgactcagccaccctcagtgtccgtctccccaggacggacagccgtcatgacctgctctggaaacacgttggggtccagatatgtttcctggtatctccagaggccaggccactcccccattttacgcatgtatcaaacttcgagcgccctnaggatcccngacgtctttcggctccagtcnggggacacgacgccactctagactacgtaccggggcccaggccacgtcgatggagggntacttttacgngtcaggcgtggacagcacactccatctcgggcgaggacncgatgacngtccgtggtacacgccgacgctcgcccctgccnctcctcgtccccaccctcctactaccg

SEQ ID NO: 228494 - DNA, 537 bp, Homo sapiens
  misc_feature: GYAE6OF02FNTMT.4.49.E05.1.454.CMB.1.raw
  modified_base (418)..(418): a, c, t, g, unknown or other
  misc_feature (418)..(418): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacacgttggggtccagatatgttcctggtatctccagaggccaggccactcccccatttacgtcatgtatcaaacttcgacggcgcccctcaggacgtccctgaacgcttttcgggctccaagtctggggacacagccactctgactagttaccggggcccaggcccagtcgatggagggagtacttttacngtcgaggcgtgggacagcacacttccatctcggcgagggacacggatgaccgtcgtggtcagcccgaaggcctcgcccccgtggtccacgttctcgttccccaccctcctcctactacg

SEQ ID NO: 228495 - DNA, 537 bp, Homo sapiens
  misc_feature: GYAE6OF02H36KZ.4.49.E05.1.454.CMB.1.raw
  modified_base (434)..(434): a, c, t, g, unknown or other
  misc_feature (434)..(434): n is a, c, g, or t
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatcgacctgctctggaacaacttggggtccagatatgtttcctggtatctccagaggccaggccactcccccattttacgcatgtatcaaacttcgaggccgcccctcaggacgtccctgaacgtctttcgggctccaagtctggggacacagccactctgacctagtttcccgggccaggccatcgatgagggagtactttactgtccgaggtcgtagggacngccacactccatcttcgggcggaggacacggntcggaccgtcgngggtcagcccaggctaccgcccgtgtccactctcgttcccacccgtcctacctactacg

SEQ ID NO: 228496 - DNA, 560 bp, Homo sapiens
  misc_feature: GYAE6OF02FYOM8.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccatttagtcatgtatcaacttcgagcgcccctcaggcgtcctgaacgtcttttcgggctccgaagtcgtggggacacagccactctgactagttacccgggcccaggcccagtccgatcggagggacgtacttttacgtcgtcgagggcgtgggacagcacacctccatccgttcggcgggaggacgacggatcgaccgtccgtgggtcacggcccgaaggcctccggcccccgtcggtccacgtcctccgttccccacccgtccctacccgtctaccg

SEQ ID NO: 228497 - DNA, 583 bp, Homo sapiens
  misc_feature: GYAE6OF02JIAA5.4.49.E05.1.454.CMB.1.raw
  modified_base (322)..(322): a, c, t, g, unknown or other
  misc_feature (322)..(322): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggaccggacagccgtcatgacctgctctaggaaacaacgttggggccagatatgttctggtatctccagacgccaggccactccccattttacgcatgtatcaacttcgagcgccctcgagcgtccngaacgtctttcggctcaagtctcgggacacgagcactctcgactacgttacccggggccacggccagtccgatcggaggacgtactttcgcgtcaggtcgtgggacagcactactccgatcgttcggacggacggacgtacgacgtaggacccgtaccgtgggtaccacggcccgtaacggtcctaccggtacccccgtcggtcccaccgttccgttccggttacccccctaacccggttcccctacccgtaccgtaccgg

SEQ ID NO: 228498 - DNA, 887 bp, Homo sapiens
  misc_feature: GYAE6OF02G0YEK.4.49.E05.1.454.CMB.1.raw
  modified_base (484)..(484): a, c, t, g, unknown or other
  misc_feature (484)..(484): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagcccaccctcagtcgtcccgtcctccccgaggacggacacgccgtcatgacctgctcgtaggaaacacgttgggccagatattgtttcctggtatctccagacggccaggccacctcccctattttacgctatgtactactaacttcgacgccgcccctcgacggtacgtcccgtaggtaccgttcgtttcgggccttaccgaacggtccggtacggggaaccacgacgccctactcgtacgtacttaccggttacccggggacccgacgggtcccaacgtcgaggtacgggacgggtagttaccgttttacgnggtaccgtaggggtccggttagggaccaacgggacctaaaccgtaaccgtttacccgacgtttcccgggttaaccggggccgggggtaacggggtaacccgtaaccgggtaacgggttaccccgggtaaccccgggtttacccggggttaccggggggtaaccctaaccccgggggttaacccccggggtaaccgggggttcccccccggtttaaccccccggggtttaccccccccccgggggttacccggggttttaaccccccggtttaaccccggttttaccccccgggggttttttaacccccccggtttttacccccccccccgttaaacccccccccgggtttttacccccgttttaaccccccccggggtttaacccgtttaacccccggggggg

SEQ ID NO: 228499 - DNA, 590 bp, Homo sapiens
  misc_feature: GYAE6OF02FZQTD.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtgtccgtctccccaggacgacagccgtcatgacctgctctggaaacaacttggggtccagatatgtttcctggtatctcagaggccaggccactcccccattttgcatgtatcaacttcgagcgccctcacggcgtcctgaacgtcttttcggggctccaagtcgtcggggacacgacgccactctgacctagttacccgggccaggccagtcgagtggagggacgtacttttacgtgtacaggtcgtcgggacacgcaacgtacttccgattcgtacggcggtacgggacgtacggactacggacccgttcgtcgggtacacggcccgtaaggtcctccggcccccggttacggtccctaccgttccgttaccggttccccgccccttcccgttacccgtccttacggg

SEQ ID NO: 228500 - DNA, 576 bp, Homo sapiens
  misc_feature: GYAE6OF02GF7I0.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactccccctattttacgtcatgtatcaaacttcgacggccgcccctcgacggacgtccctgaaccgtcgttttcgggctccaagtcgtcggggacacgacgccactctagactacgtacccggggcccacggccagtccgagtggacgggtagtacttttacgtgtcgaggcggtaggacagcaacgactgcagtcgttcgggcggagggaccgaggggtcgaccggtcgtgggtccagcccgaggcctaccggcccccgtggtccacgttcgtccgttccccacccttcctccctacgtcg

SEQ ID NO: 228501 - DNA, 687 bp, Homo sapiens
  misc_feature: GYAE6OF02GSDQO.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctaggaacaacgttggggccagatatgttcctggtatctacagcggccacggccacctccccctatttttacgtactattgtactacctaaacttcggacggccgccccttacgacggtaacgtcccgtaggtaaccgtccgttttccgggaccttacccgtaaaggttccggttacggggaccaccgacgtcccacttccgtcgtaaccgttacggttacccggggacccacggggccctagtcgagtgggacgggtattacgttttacgtgtcgaacgggtcggtagggacacgtcaaccgtacttccaagtccgttacgggacggtaacgggcgtaccgggactcggaccgttcggtacgggactacggacccgtaagggccctaccggtcccccgttacgggtccctaccgttccccgttccggttacccccctaccccgttcccgttacccgaccgtaccgg

SEQ ID NO: 228502 - DNA, 755 bp, Homo sapiens
  misc_feature: GYAE6OF02GAPR5.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtcctccccaggaccggacagccgtcatcgacctgctcgtacggaaactaacgttcggggtaccagatatgtttcctggtatcctcagacggccaggcccacctccccctattttacgtctattcgtactactaaacgttcggacggccgcccctgacggtactcccgtagaaccgtccgtttcgggcctaccgtaacgtcgtcggggaccacgacgaccacgtctacgtacgtacgttacccggggaccctacggacctagtcgagtggaacgggtacgttacttttacgtagtacggtacgggtcggttacggggactacgggacctaaccgttaacccttaccgtacgttaccgttaccggggtacgggaacggggtaccgtaaccggggtacgttacccggtaacccggttaccggttcggggtacccgtaccgggtaccccgtaacgggtccccggttaccccggtaccccccggttcccggggtaccttacccggttccccggttacccggtttcccccccggtacccctttacccggtttaccccgtaaccgttacccggg

SEQ ID NO: 228503 - DNA, 787 bp, Homo sapiens
  misc_feature: GYAE6OF02I1KIE.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagcccaccctcagtcgtccgtcctccccaggaccggacagccgtcatcgacctgctctacggaaacacgttggggtaccagatatgttcctggtactctcagacgccacggccacctcccctattttacgctatgtactactaaacttcggacggccgtcccctcgacgggtacgttccccgtaggtaaccgtccgttttccggggaccttaccgaacggttccggtacggggacctaccgacgtacccgtaccgttcgtacgtaaccgttaaccggtttaccccgggggacccgtacgggtaccctaacgttaccggtaacgtacggggtaacggggtaacgtttaaccgtttttacggtcggttaccggtacggggtaccgggttacggggaaccgaacgggtacctaaaccgtaaccgtttaccgtaacgttccggttaccggggacggggtaacgggaccgtaaccggggtacgtaccggtacccggtaccgggttcgggtaccgacccggacccggtaacggtccggtccccggtacccccggttacggtcccgtacccgttccgttaccccgttccccctacccccgtttcccttaccccgtaccgtaccgg

SEQ ID NO: 228504 - DNA, 626 bp, Homo sapiens
  misc_feature: GYAE6OF02G8DER.4.49.E05.1.454.CMB.1.raw
  modified_base (470)..(470): a, c, t, g, unknown or other
  misc_feature (470)..(470): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtgtccgtctccccaggacggacagccgtcatgacctgctctggaaactaacgttgggtccagatatgtttcctggtatctccagaggccaggcccacctccccgattttacgtcatgtaactctaaaccttcgacggccgcccccttgacggacgtccctaggaaccgtcgttttccgggccttaccgaagtccgtaggggaccacgacgccactctacgtactacgttaccggggcccaggcccagtcgagtaggagggaatactttacgtgtcgacggtcgtgggacngccgactacctcattccgtcggacggagggacacgggtatcggacccgttcggtcggaccgtacgacccggtaacggccgttacccggccccgttcggtaccctaccgttccgttaccggttcccccgtacccctcccgttacccacgttacccgg

SEQ ID NO: 228505 - DNA, 658 bp, Homo sapiens
  misc_feature: GYAE6OF02H60WR.4.49.E05.1.454.CMB.1.raw
  modified_base (356)..(356): a, c, t, g, unknown or other
  misc_feature (356)..(356): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcacgccaccctcagtgtccgtctcccaggacggacacgccgtcatcgacctgctctaggaaacacgttcggggtccagatatgttcctggtactctcagcggcacggccacctcccctatttacgctatgtatacaaacttcgacgccgccctcgaggactcctgacgtcgtttcggctcgtagtcgngggacacgacgccactctacgacctacgtaccgggccacggccagtcggagtggacgggtacttacgttttacacggttcgacgggtaccggtgggtaacgacggaccctaacgtaacctttccaacgtttcccgtaccggggccgggtaacggggaccgtaacgggtacgttaccggtacccggtccggttacgggtaccacgggaccccgtaagggtccctacccggcccccgtcgggttacccacccgtttcgtaccccggttcccccgtcccctttaccgtcccgtacccccgtacgg

SEQ ID NO: 228506 - DNA, 762 bp, Homo sapiens
  misc_feature: GYAE6OF02JF8LB.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctaggaaacacgttcggggtaccagatagtcgtttcctaggtactcctccgagacggaccacggtccacctcccccctatttttacggtcctagtcgttacttaccgtaaacgttcgaacggcccgtccccctacgacgggtaacgtcccctaggtaaccgtccgttttaccggccttacccgtaaggttccgtgggggaaccctaccgaacgcccgtacttaccgtacgtaccttaaccggttaccccggggtacccgaacgggtcccgaacgtcggtaacggtaggggaaacgggtacggttaacttttaaccgttcggtaccgtacgggtccgggttacgggacgaacggtaccctaacgtaaaccgtcctaacgttccggtaccgggtaccggggacgggtacgacggtacgtacggtaccggtaccggtcgggtactacggacccggtaacggtcccgtcccggtaccccggttccggtaaccgtacccgttcgttacccggttccccctaccccgtttccctaccgtaccgtccgg

SEQ ID NO: 228507 - DNA, 659 bp, Homo sapiens
  misc_feature: GYAE6OF02I8N2E.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatcgacctgctctcggaaacaacttggggtccagactatgtttcctggtatctccagacggcctaggccacctccccattttacgcatgtatacaaacttcgaggtccgcccctcgacggtacgtcccgtagaaccgtcgttttccgggctaccgtaacgtcgtcggggtaaccacgtcgacctacgtcgtacgtaccgtacggttacccgggaccgtacggtaccacgttccgaagtacgggaacgggtacgttaacgttttcgtacgtcggtacggtcggtacggacgacgtaccgtataaccgtctacgttcgtcggtacggacggacgtaacggcgtacggaccgttcgacggtcgacgtccgaacggtcctacccgccgtaccgtaccgtccgtaccggttcccggtacccccgttcccgttaccgttacccgaccgttaccgg

SEQ ID NO: 228508 - DNA, 879 bp, Homo sapiens
  misc_feature: GYAE6OF02FOQZ7.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagcccaccctcagtcgtccgtcctccccgaggacggacacgcccgtcatcgacctgtccgtctacggaaacctaacgtttcggggtaccagtatagttcgttttccgtaggtaactccttccgaggacggtaccgaacggcccctaacccttcccccctaagtttttacgtactacgttacgtaacttacctaaaaccgttcggaacggacccggtccccctacgacgggtaccgttaccccgtacggtaacccggttccgttttaccggggccttacccgtaaacggttcggtacggggtaaccaaccgtacgtacccgtacgttaccgttacgttaacccgttaccggtttaaccccgggggaccccgtaacggggtacccctaacggttacccgggaagtacggggtaacggggttaacgtttaaccgtttttacggtacggttaccggaacgggttccgggtacgggaaccgtacggtaccgtaaacccgttaaccgtttacccgtaacgtttcccggttaccggggaccggggtaacgggtaccgaacggggttaaccgttccgggtacccggtcgggtaccgggtaccgtaccggaccccgtaacgggtccctccccgggacccccgttaccggtacctacccgttcccgttccccggtttaccccccgtacccccgtttacccgtaccccgttacgtacccgg

SEQ ID NO: 228509 - DNA, 749 bp, Homo sapiens
  misc_feature: GYAE6OF02G81KZ.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtcgtccgtcctccccgaggacggacagccgtcatcgacctgctctaggaaactacgttcggggtccagatatgtttcctggtatctccagacggccacggccacctcccctattttagctatgtatactaacttcggacgtccgccctgacggacgtccctagtaccgtcgttttcgggacctccgtaagtccgtggggaccacgacgccctactcgtacgaccgttacggttacccggggacccctacggaccctagttaccggaacgttgggaacggggttacttaaccgttttttaccgaggttccgaacgggtccgggttaggggaacacgggtaccaacgttaaccctttccgtacgtttccggttacggggaccggggtaacggggaccgtacggggtacgttccggggtaccccgttcggttaccggggtaccctaccgggacccggtaaccgggtcccggttccccgtacccccggttccgggtaccctacccggtttcccgtttaccccgggttacccccctacccccggttaccccgttacccgtacccggttacccgg

SEQ ID NO: 228510 - DNA, 584 bp, Homo sapiens
  misc_feature: GYAE6OF02FX1FO.4.49.E05.1.454.CMB.1.raw
  modified_base (473)..(473): a, c, t, g, unknown or other
  misc_feature (473)..(473): n is a, c, g, or t
  modified_base (517)..(517): a, c, t, g, unknown or other
  misc_feature (517)..(517): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtcccgtctccccaggacggacagccgtcatgacctgctctggaaacaacgttgggtccagatatgtttcctggtatctccagaggccaggccactcccccattttagtcatgtatcaaacttcggaaggccgcccctcaggacgtccctgaacgtcttttcgggctaccaagtctggggacacacgccactctgacctagttacccgggcccaggacccatcgatggagggagtacgtttactgtcaggtcgttgggactaggcactaaccttcacttcgtcgggacggnggaaccgacggaatcgtaccgcgtgggtcacgcccgaaggtccnccggtaccccccgtgttaccaccgttcgtacccggttacccctaccccgtccctcccttacgtccgg

SEQ ID NO: 228511 - DNA, 855 bp, Homo sapiens
  misc_feature: GYAE6OF02H109H.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagcccaccctcagtgtcccgtctccccaggacggacagccgtcatgacctgctctaggaaacacgttggggtccagattattgtttccgtggttatcctccgagacggccgaggccaccttccccctatttttacgctatcgtactactaaccttcggacggtccgtcccctacgaccgggtacgttacccgtcggtaaccgttcgttttccggggtcctacccgtaacggttcgtacgggggacctaacgacggtcccgtaaccttccgtacgtaaccgttaccgggtttaaccccgggggccccgtaacgggtcccgtaacgtaccgggtaacgttacggggaacggggtacgtttaaccgtttttaaccggtggttacccggacgggttccgggttacggggaacctacgggaccctaaacgtaacccgttccgttaaacgttcccggtttaaccgggaccggggtaaccggggaacctaaccggggggtaacttccggggtaaaccccggttccggtaccggggttaccgaaccgggtaccccggaaaccggggttccccgtaccccggtccccccgggttaacccggggtaccccgttaaccgtttacccccggtttcccggtttaaaccccccccgtaccccgttttacccccgttaccccggttacccgttaacccggg

SEQ ID NO: 228512 - DNA, 802 bp, Homo sapiens
  misc_feature: GYAE6OF02FE0JG.4.49.E05.1.454.CMB.1.raw
tcagagcactgtagcacgaccggtgctcgatttagagcgactagcaacacacaaagggctgggcctcaggaagcagcatcggaggtgcctcagccatggcatggatccctctcttcctcggcgtccttgcttactgcacaggattcgggcctcctatcaactgactcagccaccctcagtcgtcccgtctcccaggacgacacgccgtcatcgaccttgcctctagggaaacctaacgtttggggtacccagtatagttacgtttcctggtacttcctaccgaggacggcccagggacccctacctcccccctattttacgtactagttacgtaacttaccaaaccttcggacggtccgtaccccctacgaacgggtaccgttccccgtacggtaaccgtccgttttttaccggggaccttaccggtaacggttcgtacgggggacctaacgacggcccaactccgttacgaaccttacggttaccccggggaccctacgggaccctagtccgagtacggacggggtaacttacgttttaacgtcggtacgtaagggtccggtagggtaacccaggaccctaaccgttaccgtttacccgaacgtttccggttaccggggaccggggtaacggggtaacccaacggggtactacccgggacccggtttcccggttagggaccctacggaccccggtaacgggtcccttaccccgggccccccgttaccggtacctaccccgttaccgtttaccccggttaccccctaccccccgtttacccgttacccgtacggttacccgg

SEQ ID NO: 228513 - DNA, 725 bp, Homo sapiens
  misc_feature: GYAE6OF02JHN3V.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccacctcagtcgtcccgtctccccaggacggacagccgtcatggacctgcctctaggaaactaacgttggggtaccagtatacgttcgtttcctggtactccgtaccaggacggccaggccctacctccccctatttttacgtctaagttgtactacctaaacgttccgaaggcccgtcccctcgaacggtcgtcccgtaggtaaccgtccggttttccgggcctacccgtaacggttcgtacggggtaaccacgaacgccgtacttcgtacgtacctacggttaccccggggaccctacggcctaacgtcgaggtcggaacgggtacttacgtttacgtcggtacgagggtacggtggacaggtccaaccgtactccgtacgtcggttaccgggacggtacgggaccgtacgggacgtaccggtacccggttccgttcggggtacaccgggacccgtaacgggtcccggttacccggcccccggttacgggtcccttaaccgtcccgtttacccggtccccccggtccctttcccttaccccgtaagtcccgg

SEQ ID NO: 228514 - DNA, 697 bp, Homo sapiens
  misc_feature: GYAE6OF02H4RSB.4.49.E05.1.454.CMB.1.raw
  modified_base (178)..(178): a, c, t, g, unknown or other
  misc_feature (178)..(178): n is a, c, g, or t
  modified_base (555)..(555): a, c, t, g, unknown or other
  misc_feature (555)..(555): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcgggcctctatcaactgactcagcccaccctnagtcgtcccgtctccccaggaccggacagccgtacatcgacctgcctctacggaaactacgttcgggaccagatagttacgtttcctggttactccgtcctaagcggccaggccctacctcccctagttttacgctattgtaactctaaaaccgtttcggaaggtcccgtccccgttagaacgggtaccgttccctacggtaaccggttcgttttaccggggcttaaccgaaggttccggttacggggtacaacccggtcgtacccctagttacccgtagtaacccgttacggttaacccggggaccccctagggtacccaacgttccggagttaggacgggtagttaccttttacgtcgtcgacggtcgtcggganacgtactacgtactaccgagttccgttacgggacgtaggcgtaacgacgttacgacccgttacgtggtaccaccgaccggacgcctaccggccccgtaagtccaccgtcttcggtccccgtacccgttcctaccctgtaccg

SEQ ID NO: 228515 - DNA, 734 bp, Homo sapiens
  misc_feature: GYAE6OF02IYPO6.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtcgtccgtcctccccgaggaccggacacgccgtcatcgacctgctcgtacggaaactacgttcgggaccagtatagttcgttcgtaggttactcctaccgagacggaccgacggccctaccctccccttattttacgtactattacgtactaacctaacgttcggacggcccgtccccgtacgacggtacgtccctaggtaccgttccgtttccggcctaccgtacgtccggtacgggaaccacgacggaccctacgttccgtacgtaccgttaccggtacccgggaccgaacgggcctaacggtcgaagtacgggaacgggtactttaccgtttacgcggttaccgagggttccgtaggggtaaccacggtactaaacccgttaaccttccgaacgttccggttaccgggacggggtaacggaaccggtacggtacgtacccggtacccggttgtaccgggtacacccggtaccgaacggtccgtccccgtacccggttcgtaccgtacccttcgtacccgttccccgaccccgttaccctaccgtactcgg

SEQ ID NO: 228516 - DNA, 839 bp, Homo sapiens
  misc_feature: GYAE6OF02F3YSS.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggatcggggcctcgtatcaactgactcagccaccctcagtcgtcccgtcctcccgaggacggacacgccgtcagtcgacctgcctctaggaaacctacgttcggggtccaagtacttagttcgtttccgtggttacttcctcctaggacggaccgacgggtccctaaccgttaccccctacgttttacgtacctagttacggtaactaacctaaaccgttcggacggtccccgtcccctacgaacggtaccgtacctggtaaccggttccgttttccggggaccttaccgtaacggtccggtacggggtaaccaccgaacggtcctaaccgtctaccggtaaccttaccggttaccccggggacccacgggacccctaacgtccgggtaacggtacgggtaacgggttacgttaccgtttttacggtcggttaccggcgggtaccggttaggggaacctacgggtaccctaacgtaaccctttaccgtacgttccggttacggggacgggtaaccggggaacgtacggggtacgtacccggttacccgttaccggggtacccgggtaccgaccggtaccccggtaacgggtacccgtaccccggttccccccgggttacgggttcccccgttaaccgttccggttccccggttacccccgttacccctcccccggtttacccgtacccgttcccgggg

SEQ ID NO: 228517 - DNA, 689 bp, Homo sapiens
  misc_feature: GYAE6OF02GJ0NP.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggagttcggggcctcctatcaactgactcagccacctcagtcgtccgtcctcccaggacggacacgccgtcatcgacctgctctaggaaacctacgttggggtccagatagtcgtttcctggtatctcagacgccaggcctacctcccctattttacgcgtatgtactactaaacgttcgacggccctccctacgacggacgttccgtacggtaacgttccgttttccggccgttacccgaacggttcggtacggggacacgacgccctactcgtacgtaaccgtaacggttacccggggccacggtaccacgtacgagtcggacgggtacttacgttttacgcgttacgcgggtacggtaggacgtcgactaaccgtaacttccgacgtttcggtacgggccgggtacggaccgagggtacgtcgaccggttccgtacggggtaccaccgtaccggtaacggtccggtcccgtaccccgtaccgggtccttaccgttcccgttcccggttccccgtcccccgttacccgttaccgtacgttacccgg

SEQ ID NO: 228518 - DNA, 654 bp, Homo sapiens
  misc_feature: GYAE6OF02IOT4X.4.49.E05.1.454.CMB.1.raw
  modified_base (181)..(181): a, c, t, g, unknown or other
  misc_feature (181)..(181): n is a, c, g, or t
  modified_base (491)..(491): a, c, t, g, unknown or other
  misc_feature (491)..(491): n is a, c, g, or t
  modified_base (636)..(636): a, c, t, g, unknown or other
  misc_feature (636)..(636): n is a, c, g, or t
  modified_base (648)..(648): a, c, t, g, unknown or other
  misc_feature (648)..(648): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttcgcttactgcacaggacttcggggcctcctatcaactgactcagccaccctnagtcgtccgtcctccccgaggacggacacgccgtcatcgacctgctacgtacggaaacctacgttcggggtaccagatattcgtttcctggtactctccaggacggccgacggccaccttcccctattttacgtctatcgtactactaacgttcgacggccgtccctgaggtactcccgtagtaaccgttcgtttcgggctaccgtacgtccgtagggaccacgacgcctactcgtacgacgttacggtacccgggccgacggcctagtacgtagtacggaagggtacgttacctttacgtaggtacggnggtcggtaggaccgacgactacctacgtcctattccggttacggaccgggtaaggaccggtacggtactccggtaccggtcgtacgggtaccgaccgaccgacggtcctacccggcccgtcgtaccgtccttacgtcccgtcccnccctccgtaccncgtacg

SEQ ID NO: 228519 - DNA, 637 bp, Homo sapiens
  misc_feature: GYAE6OF02FGUN7.4.49.E05.1.454.CMB.1.raw
  modified_base (225)..(225): a, c, t, g, unknown or other
  misc_feature (225)..(225): n is a, c, g, or t
  modified_base (468)..(468): a, c, t, g, unknown or other
  misc_feature (468)..(468): n is a, c, g, or t
  modified_base (547)..(547): a, c, t, g, unknown or other
  misc_feature (547)..(547): n is a, c, g, or t
  modified_base (627)..(627): a, c, t, g, unknown or other
  misc_feature (627)..(627): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacagattcgggcctctatcaactgactcagcccaccctcagtcgtccgtcctccccgaggacggacagccgtcatcgacctgctcgnggaaacaacgttggggtccagatatgttcctggtatctccagcggccgaggcccaccgtccccctattttacgtctatcgtatacctaacgttcgacggccgacccctgacggacgtccctagtaccgtcgttttaccgggctaccgagtcggtagggacacacgccactctgactacggtaccgggccacggccagcgtatagggacggtactactttacgcgtacgagggtcggtaggacngaccaacgtaccttcgacgttaccggttagggccgggaaggaccgtacggtacgtcggtacccgtcggtcgggtacccncgacccggtacggtcccgtccgtccccccggttggtaccctccgttcccgttcccgttaccccgtacccttccccgtacnccgttaccgg

SEQ ID NO: 228520 - DNA, 789 bp, Homo sapiens
  misc_feature: GYAE6OF02FGB9I.4.49.E05.1.454.CMB.1.raw
tcagagcactgtagcacgaccggtgctcgatttagagcgactagcaacacacaaaggggctgggcctcaggaagcagcatcggagtgcctcagccatggcatggatccctctcttccctcggccgtccttgcttactgcacaggattcggggcctcctatcaactgactcagccaccctcagtcgtccgtctccccaggacggacacgccgtcatgacctgctctggaacaacgttggggtccagatattgttcctggtatctccagtacgccaggccacgtccccctatttacgcctatgtactactaaaccgttcgaacggtccgaccccctcgacgggtaccgttccccgtaggtaaaccggttccgtttttaccggggccttaccgaacgtccgtacggggaccacgacgcctacgtctacgtaccttacggttacccggggccctaggccctagtcgacgtacggagggtacgttaaccttttacgcggtacgacgggtccgggttacgggaaccgacggtacctaaccgtaaccgtttcccgtaaacgtttccgtttaccggggaccgggtaaaccgggggtacctaaccggggtaccgtaccgggtaaaccccggttcccggttaaccggggtacccgtacccggtacccgtaaaccggggtccccttaccccgggtacccccccggtttaccgggttacccttaacccggtttccccgttaccccggtttacccccccgttacccccgttacccccgttaccccgttaccgttaaccccgg

SEQ ID NO: 228521 - DNA, 720 bp, Homo sapiens
  misc_feature: GYAE6OF02F5AI4.4.49.E05.1.454.CMB.1.raw
  modified_base (339)..(339): a, c, t, g, unknown or other
  misc_feature (339)..(339): n is a, c, g, or t
tcagagcactgtagcacgaccggtgctcgatttagagcgactagcaacacacaaagggctgggcctcaggaagcagcatcggaggtgcctcagccatggcatggatccctctcttcctcggcgtccttgcttactgcacaggattcggggcctcctatcaactgactcagccaccctcagtgtccgtctcccgaggacggacagccgtcatcgacctgctctaggaactacgttggggtccagatagttgtttccgtaggttactctccgagacggccacggcccaccgtccccctagtttttacgtctagtgtactactaaaccgttcggacggtccnccccgtagacggtacgtcccgtagaaccgttcgtttcgggcttaccgagttcgtaggggacctacgacggaccacgtctcgtaacgttaccggttacccggggaccctacggccctagtccggtagtacgggaacgggtacgtttaaccgttttacgtcggtccggtacgggtcgggtagggaccgagtccaacgtaacctttccgacgttaccgttccgggacgggtacgggaacgtacgggtacgtccggtaaccgttccgggtacgggtaccgaccgtacccggtaacgggtcccgtacccggtcccccggttacggtccctaaccgttcccgttaccgttacccccgtaccctttcccggtacctaccggtacccgg

SEQ ID NO: 228522 - DNA, 561 bp, Homo sapiens
  misc_feature: GYAE6OF02GUUF7.4.49.E05.1.454.CMB.1.raw
  modified_base (330)..(330): a, c, t, g, unknown or other
  misc_feature (330)..(330): n is a, c, g, or t
  modified_base (452)..(452): a, c, t, g, unknown or other
  misc_feature (452)..(452): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (504)..(504): a, c, t, g, unknown or other
  misc_feature (504)..(504): n is a, c, g, or t
  modified_base (545)..(545): a, c, t, g, unknown or other
  misc_feature (545)..(545): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcagccaccctcagtgtccgtctcccaggacggacagccgtcatgacctgctctaggaaactaacgttcggggtccagattagttgtttcctggtatctccagaggccacggccacctcccccattttagtcatgtatactaaacgttcgacggccgcccctnacggacgtccctgaacgtcgtttcgggctccgtacgtcgtcggggacacgacgaccacgtctcgacttacgtacccggggccacggccacgtcgatcggagggtactactttacgtgtacgnggcggtggacaggcactactcatcgtcggnggacgcacggntcgaccgtcgnggacacgccgagcctccgcccgtcgtccactcgtcgtcccnccctcctaccgcgtcg

SEQ ID NO: 228523 - DNA, 748 bp, Homo sapiens
  misc_feature: GYAE6OF02G19X2.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattcggggcctcctatcaactgactcacgccaccctcaggtcgtccgtcctccccaggacggacacgccgtcactcgacctgtcctctaggaaacctacgttcggggtccaaggtatattgtttccgtggtactcctacgagaacggccgaggaccccgacctcccctattttacgtctatacgtactacctaacgtcggacggtccgtacccgtacgacggtacgtccctcggtaaccgttcgtttccggacctaccgtaacgtacggtcggggaacctacgcgtacctacgtcgtacgtaaccggtaccgtttaccccggggacccgacggacccgtacgtacggtacgtacgggaacgggtacgtttaacctttacggtacggttaccggacgggtacgggttacgggaacacgacctaacgtacccgtacgtaaccgttcggtaccgggtaccgggagggtaacccgtaacggtacgtccggtacccggttaccgtcgggtaccgacccgtaccggtaccggtcccgttcccgccccgtccggtaccgtaccgttccgttacccgttcccccgtacccttccccgtaccgtcggtacccgg

SEQ ID NO: 228524 - DNA, 797 bp, Homo sapiens
  misc_feature: GYAE6OF02HQTTD.4.49.E05.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggccgtccttgcttactgcacaggatccgggcctcctatcaactgactccaaccaccctcactgtcctctctccaggacgacngccgtnactccacctgctctcgacaacgtcgttggggacgatatattgtttccgtaggtatcgtaccaggtacgaccacggtccctacctcccctatttacccgttaacgtcctaacgttaggttaacctaacctaaaacgtaccggtaacggaccccgtacccccgtacgggtaacccgggggttccctacgggtacgtccgtttccgttttaccggtcgggtaccccttaccggtaacgtttcccgggtaaacggggtaccaaaccggtaccggttaccctaacgttccggtaacgtcccgttaccgggttacccgggccccggggtaacccggtaacccggtccgtaaccggtacggtaacggttacggggaacgggttaacgttacgttaacgttaccggttcgacgtacgggtcggtacgggaacgttacgacgtaacgtaacgtcgtaacggtacgttaccggttaccggggacggtaccggggaaccgttgggtaccggtacccgggttacggtcgggtaccgaccggaccccgtacgggtcccgttacccgcccggtacgttacctaccgtccgttcccgtccccg

SEQ ID NO: 228525 - DNA, 557 bp, Homo sapiens
  misc_feature: GYAE6OF02H3JG1.4.49.E05.1.454.CMB.1.raw
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
tcagagcactgtagcacgaccggtgctcgatttagagcgactagcaacacacaaaggggctgggcctcaggaagcagcatcggaggtgcctcagccatggcatggatcccctctcttcctcggcgtccttgcttactgcacaggattcggggcctcctatcaactgactcagccaccctcagtgtccgtctccccaggaccggacagccgtcatgacctgctctggaaacacttggggtccagatatgtttcctggtatctccagaggccaggcccactcccccaattttagtctatgtatacaaacgttcgacggccgcccctcacggacgtccctgaaccgtcttttcgggctcccgaagtcgtggggacacgagccactctgactacgttacccggggcccaggccagtcgatgagggagtacttttacngtcaggcgtgggacagcacactcactcgttcggcggagggacacggntcggaccgtcgtcgggtcacggcccaaggtctccgccccgtgtccacgtcgtccgttcccgccctccctcctactcg

SEQ ID NO: 228526 - DNA, 756 bp, Homo sapiens
  misc_feature: GYAE6OF02H67CZ.4.49.E05.1.454.CMB.1.raw
  modified_base (184)..(184): a, c, t, g, unknown or other
  misc_feature (184)..(184): n is a, c, g, or t
  modified_base (534)..(534): a, c, t, g, unknown or other
  misc_feature (534)..(534): n is a, c, g, or t
  modified_base (718)..(718): a, c, t, g, unknown or other
  misc_feature (718)..(718): n is a, c, g, or t
tcagagcactgtagcacgaccggtgctcgatttagagcgactagcaacacacaaaggggctgggcctcaggaagcagcatcggaggtgcctcagccatggcatggactccctctcttccgtcggtccgtccttgcttactgcacgaggcgttcgggcctctagtcaactgactcacgccacctnagtcgtccgtcctcccgagaccgacacgtccgtacagttacgccgtgtacgttacgtaacgggaaaccgtaacggttccggggtaccaaggtaattacgtttcggttttaccgttaggttacttaccgtccgtaaggaccggtaccgacgaccccgtaacctcccccgttaagtttttacgacctaattcgttacgttaaccaacgtttcggaacggccgtacccgtcggtaaacggacgttcccgtaggtaaccgttccggttttaccgggacctaccgtaagttcggacgggaactacgacgtacctacgtcgagttacccgttacggtcccgggaccctcggaaccngtaccgaggttagggacggtaacgtttacctttaggtcgtaggtacgggttccggaggtaccaggaaccttaacgtaacgtcctaacgtttcccgaggggtacgacgggtaacgtaccggtacgtaccggtacgtccgtacggggtaccacggcccgtaacggtccgtccgacccgtcggtacnccgttacgtcccgtaccccgttcctccttacctgtacc

SEQ ID NO: 228527 - DNA, 765 bp, Homo sapiens
  misc_feature: GYAE6OF02ISEZK.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacgaggagttcggggcctctatcaactgactcacgccacctcagtcgtccgtccgtcccgaggacgacacgcgcagtcgacctcgctcgagaaactacgttcgggccagattattcggttctagtctcacgtgacgcgacgccctaccgtacccttagtttacgctacgtacgtactaccgtaaacgttcggacggcctccccgtagacggtactccgtacgtacgttcgtttcggcctaccgacgtcggtacggaacacgacgtccgtactacggtacgttaccggttaaccggttaccccggggaccttaccggaactccggtacgtacggttaacggggaaaggttaccgttacgtttcgtacgggtaccggtaagggtcggtaacgggtacacgtaccgaaccttacgtccgttacggtacgtaccgggacggacgggtaccgtacggttaccggaccgtaccggttaccgggtacgtaacccgggtccgtaacccgggtaacggtccccgggtttaccccggtaccccggttacccgggttaacccgtcccggtttaacccggttcccccgggtaacccccgttacccccgggttccctttacccgaaaccgggtttcccgg

SEQ ID NO: 228528 - DNA, 716 bp, Homo sapiens
  misc_feature: GYAE6OF02IA067.4.49.E05.1.454.CMB.1.raw
  modified_base (266)..(266): a, c, t, g, unknown or other
  misc_feature (266)..(266): n is a, c, g, or t
tcagagcactgtagcacgaccggtgctcgatttagagcgactagcaacacacaaaggggctgggcctcaggaagcagcatcggaggtgcctcagccatggcatggactcctctcgttcctcggcgtctgcttactgcacaggtcttcgggctcctatacaactgactcacgccaccctagtcgtcgtccgttccacccgaggacggactacgccgtacagtcgactgctcgagaaactgttcgggccagatgtcgttcgtagtctntaccgagacgccgacggaccctccctacccgttagtttaacgctacgtacgttacgtacttaaaccgttcggacgcccgtaccccgtagaacggtaccgttccgacgtaaccggttccgttttaacggccttaccgaaggtttccggaggggaacccttcacggtaccacgttacgtacggttaaccgtttaccggaacccgggttaccgacggacgtaccgtaacggtaacgtagggtacggtacgttaacgtttacgtccgtagtacggtacgttacgggactacgacctaacgtactaccgtcgtcggttacgacgggtaccggacgtacggtacgtaccggtcgtaccggtacggtccgacccgttaccgacggtaccggtaccccgtccggtccgtaccgtaccgtccgttacccggtccgtaccccgtcgttacctacctacgg

SEQ ID NO: 228529 - DNA, 772 bp, Homo sapiens
  misc_feature: GYAE6OF02HKWD4.4.49.E05.1.454.CMB.1.raw
  modified_base (181)..(181): a, c, t, g, unknown or other
  misc_feature (181)..(181): n is a, c, g, or t
  modified_base (348)..(348): a, c, t, g, unknown or other
  misc_feature (348)..(348): n is a, c, g, or t
tcagagcactgtagcacgaccggtgctcgatttagagcgactagcaacacacaaaggggctgggcctcaggaagcagcatcggaggtgcctcagccatggcatggatccctctcttcctcggctccttgcttactgcacaggtagttccggggcctctatcaatcgactcacgccaccctnagtcgtccgtcctaccccgaggaccgacacgccgtctatcgacctcgacctaaggaaactacggttcgggtaccagtattacgtcgtttcgtaggtatcctacgaaggacggtccacgcctacctccccgtatttacgactatagtactactaacgttcgacgtccnccctagacggtactaccgtgtacgtcgtttcggactcgtaacgtcgtacgggaccacgtacgacctactacgtacgtaaccgtacgggtaaccccggggaccgaacggtaccgtacgtccggaacgtacggggaacgggtaccgttaacgtttactacgggtaccgacggggtccggttaaggggacctacgggtaccgtaaacgtaccctttacgacggttccgttacgggggaaccgggtagggaacccgtacgggtaacgttcggtaaacccgggttccgtaggggtaacccgtaaccggaccgggaacccgggtttcccgtacccccgggtaccccgggttacggtcccgtaaccggtttaccgttccccgttacccccgggtaccttaccccgtttacggacccgtacggtttacccgg

SEQ ID NO: 228530 - DNA, 716 bp, Homo sapiens
  misc_feature: GYAE6OF02JEDIG.4.49.E05.1.454.CMB.1.raw
tcagagcactgtagcacgaccggtgctcgatttagagcgactagcaacacacaaaggggctgggcctcaggaagcagcatcggaggtgcctcagccatggcatggatccctctcttcctcggcgtccttgcttactgcacaggattccggggcctcctatcaactgactcagccaccctcagtcgtccgtctccccgaggaccggacagccgtcatcgacctgctacgtacggaaactacgttcggggtccagtattacgttcgtttcctaggtactcgtcctagtacggccacggtcccaccgtaccccctatttttacgtactacgtgtactacctaaacgttccggacggcctccccgtacgacggtacgttacccgtacggaaccgttcgtttacgggcctacgtaaacggtccgtcgggtaacacgacgccgtactcctagtaccgtacgttacccgggccaccgggtcaacgtacgtacgtacggaacggggtacgttacctttacgtccggtagaacgggtcgttaggggtaccaggtaccaccgttaaacctccgtacttacggttccggacgggtaacgggacctcgggaacgtccggtacccgtaccgggtacggtaccgaccggtacccaacgggtcctacccggccccgttcggaccctaccgttcctccggttcccctacccgtccgttacccgtagtaccgg

SEQ ID NO: 228531 - DNA, 867 bp, Homo sapiens
  misc_feature: GYAE6OF02HGD1J.4.49.E05.1.454.CMB.1.raw
  modified_base (181)..(181): a, c, t, g, unknown or other
  misc_feature (181)..(181): n is a, c, g, or t
tcagagcactgtagcacgaccggtgctcgatttagagcgactagcaacacacaaagggggctgggcctcaggaagcagcatcggaggtgcctcagccatggcatggatccctctcttcctcggcgtccttgcttactgcacaggattcgggcctcctatcaactgactcacgtccaccctnaggtcgtccgtcctcccgaggaccgacagtccgtcatcgacctgctcgaggaactacggttgggtccagtattagttgttcgtggtatccacgaggtacgccgacggcccaccttcccctattttacgtctatagtactacgtaacgttcggacgtcccgccctacgaacggccgttaccgacgtaaccggttccgtttaccgggccttacccggtacggttccggtacggggtaaccacccgtacggtaccctaccgttaccgtacgtaaccggttaaccccggttaccccggggacccgtaccgggtacccgaacggtttacggtaaacggtacgggaacggggttacccgtttaacgtttttaaccggtacgggttacccggtacggggttacggggtaaccgggtaccgacgggtaacccgtaacctaaacccgtttccgttaaccggtttcccgggttacccgggggaccgggtaccggggaaaccggttacggggtaaccgttaccccgggttacccggtacccggggttaccggtaaccggtaccccggtaacccgggttacccggtcccggttacccccggttcccccgggttacccggttacccgttaacccggttccccgtttaccccggttacccccgttacccccgttaccccgttaccccgtacggtccccgg

SEQ ID NO: 228532 - DNA, 494 bp, Homo sapiens
  misc_feature: GYAE6OF01C9GWO.4.37.D04.1.454.CMB.1.raw
  modified_base (307)..(307): a, c, t, g, unknown or other
  misc_feature (307)..(307): n is a, c, g, or t
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
  modified_base (489)..(494): a, c, t, g, unknown or other
  misc_feature (489)..(494): n is a, c, g, or t
tcagagcactgtagcacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaatcaataatttangatgctgaggacgaggctgatttattactgcagctcatatacaagcagcagcacgtgggtcttcggaactgggaccaaggtcaccgtcgcccacgtcacgcccaaggcccaacccnctcgtcactctcgttcccaccctcctcctacngtcgcctcngacgcgggctggcaaggcncatagnnnnnn

SEQ ID NO: 228533 - DNA, 493 bp, Homo sapiens
  misc_feature: GYAE6OF01AB3Q8.4.37.D04.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
  modified_base (488)..(493): a, c, t, g, unknown or other
  misc_feature (488)..(493): n is a, c, g, or t
tcagagcactgtagcacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggcaaagccccaaatcataatttngatgctgaggcgaggctgattatactgcagctcatatacaagcagcagcactgggtcttcggaactgggaccaaggtcaccgtcgtccacgtcacgcccaaggcccaaacccgactgtcactcctcgttcccgcctcctcctacagtcgctctggagccgggtctgggcaagggccgacagtacgnnnnnn

SEQ ID NO: 228534 - DNA, 496 bp, Homo sapiens
  misc_feature: GYAE6OF01EQG73.4.37.D04.1.454.CMB.1.raw
  modified_base (305)..(305): a, c, t, g, unknown or other
  misc_feature (305)..(305): n is a, c, g, or t
  modified_base (485)..(485): a, c, t, g, unknown or other
  misc_feature (485)..(485): n is a, c, g, or t
  modified_base (491)..(496): a, c, t, g, unknown or other
  misc_feature (491)..(496): n is a, c, g, or t
tcagagcactgtagcacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcaccaggcaaagcccccaaatcaataatttangatgctgaggacgaggctgattatactgcagctcaatatacaagcagcagcactggggtcttcggaactgggaaccaaggtcaccgtcgtcccagtcacgcccaaggcccaaccccatgtcactctcgttccccacccttcctcctacacgtgcctctgacgcgggctgggccaagggcncatagnnnnnn

SEQ ID NO: 228535 - DNA, 505 bp, Homo sapiens
  misc_feature: GYAE6OF01A7EH6.4.37.D04.1.454.CMB.1.raw
  modified_base (426)..(426): a, c, t, g, unknown or other
  misc_feature (426)..(426): n is a, c, g, or t
  modified_base (456)..(456): a, c, t, g, unknown or other
  misc_feature (456)..(456): n is a, c, g, or t
  modified_base (500)..(501): a, c, t, g, unknown or other
  misc_feature (500)..(501): n is a, c, g, or t
  modified_base (503)..(505): a, c, t, g, unknown or other
  misc_feature (503)..(505): n is a, c, g, or t
tcagagcactgtagcacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaaacgcccccaaactcaataatttatgatgctgaggacgaggctgattattactgcagctcatatacaagcagcagcacgtggggtctcggaactgggaccaaggtcaccgtcgtcccacgtcacgcccaagcccaaccccntcgcactctccgtcccaccctcctcctacncgtcgcctcgtgacggcgggctgggacaacgggcgacagtagcnncnnn

SEQ ID NO: 228536 - DNA, 504 bp, Homo sapiens
  misc_feature: GYAE6OF01EE5V1.4.37.D04.1.454.CMB.1.raw
  modified_base (310)..(310): a, c, t, g, unknown or other
  misc_feature (310)..(310): n is a, c, g, or t
  modified_base (428)..(428): a, c, t, g, unknown or other
  misc_feature (428)..(428): n is a, c, g, or t
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
  modified_base (499)..(504): a, c, t, g, unknown or other
  misc_feature (499)..(504): n is a, c, g, or t
tcagagcactgtagcacgaccggtgctcgatttagtagcatactgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggacaaacgcccccaaaatcataatttangatgctgaggacgaggctgattatactgcagctcaatatacaagcagcagcagtggggtcttcgggaactgggaaccaaggtcaccgtcgtcccagtcacgcccaaggcccaaccccntgtcactctcgttccccacctcctcctacacgtcncctctgacggcgggctgggacaagggccganagtgnnnnnn

SEQ ID NO: 228537 - DNA, 662 bp, Homo sapiens
  misc_feature: GYAE6OF01B9HQU.4.37.D04.1.454.CMB.1.raw
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (653)..(653): a, c, t, g, unknown or other
  misc_feature (653)..(653): n is a, c, g, or t
tcagagcactgtagcacgaccggtgctcgatttagtagcatactgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcatcgccatctctgcactggaaccagcagtgacgttggtagttataactatgtctctggtatacaacngcaccaggacaaacgccccaaatcaattaatttangtatgctaggaggacgaggctagtaatttatactgacagtactacaattaataacgaagtcaacgcagctaacgttcggtagggggttactcgggacgggtacgggaaccgtaagtccgtaccggaccgttaccgtaagggtaccgaaccggtaccccgaagggtccccgttccggtcccccccgttacgggttccctaacccggtttcccgtttaccccggttttaccccccggcccctttacccgtttacccgtaccggtaacggttcccgtccgttccggtacggaaccggggtcccgggtacgttccggggaaccgaacgggtcccgtaccgtaagtacggnactgctacg

SEQ ID NO: 228538 - DNA, 498 bp, Homo sapiens
  misc_feature: GYAE6OF01AW0KO.4.37.D04.1.454.CMB.1.raw
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (493)..(498): a, c, t, g, unknown or other
  misc_feature (493)..(498): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaatcaataatttatgatgctgaggacgaggctgtattattactgcagctcatataacaagcagcagcagtgggtcttcggaatgggaccaaggtcaccgtcgtcccacgtcacgcccaaggcccaaacccntcgcacctctcgttccccacccttcctcctacngtcnctctgacgcgggctgggacaggcacatagnnnnnn

SEQ ID NO: 228539 - DNA, 655 bp, Homo sapiens
  misc_feature: GYAE6OF01DDQ5V.4.37.D04.1.454.CMB.1.raw
  modified_base (314)..(314): a, c, t, g, unknown or other
  misc_feature (314)..(314): n is a, c, g, or t
  modified_base (649)..(650): a, c, t, g, unknown or other
  misc_feature (649)..(650): n is a, c, g, or t
  modified_base (652)..(652): a, c, t, g, unknown or other
  misc_feature (652)..(652): n is a, c, g, or t
  modified_base (654)..(655): a, c, t, g, unknown or other
  misc_feature (654)..(655): n is a, c, g, or t
tcagagcactgtagcacgaccggtgctcgatttagtagcatactgttggggtttggggggggtctcaggaggcagcgctctcgggacttctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtaggttaataactatgtctcctggtatcaacagcacccaggcaaaacgacccccaaatcaataatttangatgctgaggacgagctgatttattactgctagctacaataatacaagcagacagactacgtaggggttccttaccgggaacgttgggaacccgtaacggtccgaacccggttcccgtacccccgtacggttaccaaccggacccccgaaaccgggacccccctaaacccccgtaccttaccggttaccctaaaccctttcccgttacccgttttacccccccaaccccctttccccttaccccttaacctacggttccggtaccttccgtaggaccgggcccggggaccgttcggggaacccgaaacggggacccgtaccgtaacgtacggacnncngnn

SEQ ID NO: 228540 - DNA, 523 bp, Homo sapiens
  misc_feature: GYAE6OF01CSAG3.4.37.D04.1.454.CMB.1.raw
  modified_base (231)..(231): a, c, t, g, unknown or other
  misc_feature (231)..(231): n is a, c, g, or t
  modified_base (433)..(433): a, c, t, g, unknown or other
  misc_feature (433)..(433): n is a, c, g, or t
  modified_base (519)..(523): a, c, t, g, unknown or other
  misc_feature (519)..(523): n is a, c, g, or t
tcagagcactgtagcacgaccggtgctcgatttagtagcatactgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtcctctggacagtcgatcatcgccatctcctgcactggaaccngcagtgacgttggtagttataactatgtctcctggtatcaacagcaccaggcaaacgccccaaatcaataattatagatgctgaggacgaggctgtattattactgcagctactatatacaagcagcagcacgtgggtcttacggaacgtgggaaccaaggtccaccgtccgtaccacgtcacgacccgaaggcccaacccntcgtccactcctccgttaccccacccttcctacctacacgtcgtctcgtgacggccgggtctcggacgaacggccgacagtacgcnnnnn

SEQ ID NO: 228541 - DNA, 629 bp, Homo sapiens
  misc_feature: GYAE6OF01CKL7L.4.37.D04.1.454.CMB.1.raw
  modified_base (236)..(236): a, c, t, g, unknown or other
  misc_feature (236)..(236): n is a, c, g, or t
  modified_base (624)..(625): a, c, t, g, unknown or other
  misc_feature (624)..(625): n is a, c, g, or t
  modified_base (627)..(629): a, c, t, g, unknown or other
  misc_feature (627)..(629): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacgagggtcctgggcccagtcctgccctgactcagcctgcctccgtgtctgggtctcctggacagtcgatcatcgccatcctcctgcacgtggaaccngcaggtgtacggttggtagttataactatgtctcctggtatcaacagccacccaggaccaaaaccgacccccaaaatcaattaatttatagatgtcgtaggaacgggacgaggctaggtatttaagttactgacagctactaataactaacaagcagcagcgtacggttcggggtaccttacgggaacggtacggggaacccgtaaaggtccctacccggttcccgtaccccgtaacgtaccgaacccggaccccgaaccgggacccccaaaccccgtcgttaccgttaccacccttccgttcccgttcccccgtccccttccctacccctacgtacggtcctctccgtggacggccgggtctcgggaccacgggcgacgtagtagcnncnnn

SEQ ID NO: 228542 - DNA, 632 bp, Homo sapiens
  misc_feature: GYAE6OF01C023P.4.37.D04.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (628)..(628): a, c, t, g, unknown or other
  misc_feature (628)..(628): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgcatctcctgcactggaaccngcagtgacgttggtgttatactatgtctctggtatacaacagcaccaggacaaacgccccaaaatcaattaacttangatgctaggaggacgaggctgtaattattacngacagtctacaatataacagcagcagctacgttgggtccttacggaacgtgggaacctaaggtcctaccggttcccgtacccgacgtccgaacgaccccgaacggtaccccaaaccccgtgtcgttacccaacccgtttccgttaccccggtttcccccgccccctttaccgtaccccgttaaccgtcggttaccgcccgtttacccggtgggtaacccgggccggggtaccgttccggggaaccggtaaacgggtcccgtaacgtaacgttaacgggaccagctcgngtcg

SEQ ID NO: 228543 - DNA, 492 bp, Homo sapiens
  misc_feature: GYAE6OF01A8B0W.4.37.D04.1.454.CMB.1.raw
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (420)..(420): a, c, t, g, unknown or other
  misc_feature (420)..(420): n is a, c, g, or t
  modified_base (486)..(486): a, c, t, g, unknown or other
  misc_feature (486)..(486): n is a, c, g, or t
  modified_base (488)..(491): a, c, t, g, unknown or other
  misc_feature (488)..(491): n is a, c, g, or t
tcagagcactgtagcacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctctggtatcaacngcacccaggcaaagccccaaatcataatttangatgctgaggacgaggctgattattactgcagctcatatacaagcagcagcacgtgggtcttacggactgggaccaaggtcgaccgtcgtcccacgtcacgcccaaggcccaacccnctcgcactctcgtcccgccctcctcctacacgtcgctctgaggccggctggacaggcgcagtacgnannnnc

SEQ ID NO: 228544 - DNA, 593 bp, Homo sapiens
  misc_feature: GYAE6OF01C6Z8K.4.37.D04.1.454.CMB.1.raw
  modified_base (232)..(232): a, c, t, g, unknown or other
  misc_feature (232)..(232): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (586)..(587): a, c, t, g, unknown or other
  misc_feature (586)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatccgccatcctcctgcactggaaccngcagtgacgttggtagttataactatgtctcctggtatcaacagcacccaggacaaacgacccccaaaactcaataatttatgatgctgaggacgaggctagattatactgacngctnatatacaagcagacagctaacgtgggttacttcggaacgtgggaaccaaggtccaccggtactcccacgtaccgacgtaccccgaacggtacccaaacccgacctcgtcaaccgttaccttaccggttaccccccacccgttcccttacccttaacgtacggttaccgccttacgtccggtaaggcccggggtaccgtgggaccggaaacggtcccgtaacgtaaccgttaaggcnncngngn

SEQ ID NO: 228545 - DNA, 824 bp, Homo sapiens
  misc_feature: GYAE6OF01BWSJA.4.37.D04.1.454.CMB.1.raw
  modified_base (181)..(181): a, c, t, g, unknown or other
  misc_feature (181)..(181): n is a, c, g, or t
  modified_base (226)..(226): a, c, t, g, unknown or other
  misc_feature (226)..(226): n is a, c, g, or t
tcagagcactgtagcacgaccggtgctcgatttagtagcatactgttgggtttggggggggtctcaggaggcagagctctgggaatctcaccatggcctggacccctctcctgcctccccctcctcactttctgcacagtctctgacggcctcctatgagctgacacagcccaccctggtntcagtcgtccccaggacaaacggccaggactcacctatcgtgganatgctattcgaccataccaggcaagaacgtcaacgaccgacggcccctgttcgtggtcattctggtggaacaccaaccgaaaccgtaccccgtaccgggacctcccgtaggacgtacgtacttccgtacgtcgggtacccttaccgaacggtcctaccggaacggggaacctaaacggtccgggtacccctaacccgtttacggtaacccgttaacgtaccggtacggggttaccgggggaccccggtaagggggtacggggtaacgggtaacgttaacggaaacccgttacgggttaacctttaaacgtttaacgttttaccggtttaaactaaccgtaaaaccgtacggaaacctacggtaacgtaacggttacgtaaaccgtttaaacttacgggtaacgggttttgggggtacggttaccgggggacgggttaagggtaacgttaacgaaaccggtccgttaaccggtacccgttaccggttaacggaccaccgggtaacccggaacggtccctacccggtcccccgttaccgggtaccctacccgtttcccgttaccccgttaccccctacccccgttccctacccgtaacgg

SEQ ID NO: 228546 - DNA, 720 bp, Homo sapiens
  misc_feature: GYAE6OF01CKA8T.4.37.D04.1.454.CMB.1.raw
  modified_base (711)..(711): a, c, t, g, unknown or other
  misc_feature (711)..(711): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
  modified_base (719)..(720): a, c, t, g, unknown or other
  misc_feature (719)..(720): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcgagggcacgagggtcctgggcccagtctgccctgactcagcctgcccgtcgtgtcgtgggtctccgtggacagtcgatcatccgccatcctcctgactacgtacggaaccagccaggtagtacggtttggtagttaactaactatcgtctcgtagtactacaacgacgccaccgaggaaccaaaccgacccccaaatctaattaatttacagatgacgtaggaggacgaggtctagtaattagtctcgacacgtactactaataactaacgaagtcgaagacgtacgtaccgtacgggtacgggggttaaccgtttacgggaaaccggttacgggaaacccggttaaacgggtaccccgtaacccggttacccgtaccccggtaaccggtacccgaacccggaacccccgtaaaacccggacccccgtaaacccgtacgtaccgttacctaaccgttcccgtacccgtttacccccctacccgttacccttaaccctacgtaccgttccgtccgttacgtaccggcggggtaccggtcccgtagggaacccgtaacgggcccgtaacgtaacgtacgngacncngnn

SEQ ID NO: 228547 - DNA, 636 bp, Homo sapiens
  misc_feature: GYAE6OF01BI5U7.4.37.D04.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
tcagagcactgtagcacgaccggtgctcgatttagtagcatactgttgggtttgggggggtctcaggaggcagcgctctcgggacgtctccacatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttgngttatactatgtctctgtatcaacagcaccgagacaaacgcccccaaatcaattaatttangtatgactgaggacgagctagtattacgtactcgacagtctactaatactacaagtcagcagtcgtacgtgggtacttacggaacgtacggtaaccgaacggttccgacccggttccgtaacccgtacgtccgaacggtaaccccgaacggacccctaaaccccgtgtacgtaccctaccgttaccgttacccgttaccccctaaccccgttcccgttaccgtaacccttacgggtccctaccgttaccggttccggtaaccgggtcccggggtacgttaaccgggaccgggtaacggcccgtacgaaacgttacgcgaacggntcgnggtac

SEQ ID NO: 228548 - DNA, 678 bp, Homo sapiens
  misc_feature: GYAE6OF01BYMK8.4.37.D04.1.454.CMB.1.raw
  modified_base (668)..(668): a, c, t, g, unknown or other
  misc_feature (668)..(668): n is a, c, g, or t
  modified_base (673)..(674): a, c, t, g, unknown or other
  misc_feature (673)..(674): n is a, c, g, or t
  modified_base (676)..(676): a, c, t, g, unknown or other
  misc_feature (676)..(676): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggaccaaacgccccaaactcaattaatttatgatgactaggaggacgaggtctagtaattattactgacaagtctacgtaataactacaacgcagacaagccgtacggttggggttacctttacgggaaaccgttcggggaaacctaaacggggtccctaacccgggttccgttaccccgaccggttaccgaaccggtacccccgaaacggacccccaaacccccgtacgttccgttaaccctaacctttcccgttacccggtttccccccgtacccctttacccgttaccccgttaacgtaccggtccgtccgttaccgtcgggtaaccggccgggggtaccttaggggaccggtaaaccgggcccgtacgtaaacgttccgganaccgnngngc

SEQ ID NO: 228549 - DNA, 740 bp, Homo sapiens
  misc_feature: GYAE6OF01DC8DS.4.37.D04.1.454.CMB.1.raw
  modified_base (233)..(233): a, c, t, g, unknown or other
  misc_feature (233)..(233): n is a, c, g, or t
  modified_base (733)..(733): a, c, t, g, unknown or other
  misc_feature (733)..(733): n is a, c, g, or t
  modified_base (736)..(737): a, c, t, g, unknown or other
  misc_feature (736)..(737): n is a, c, g, or t
  modified_base (739)..(739): a, c, t, g, unknown or other
  misc_feature (739)..(739): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctctcactcagggcacagggtcctgggcccagtctgccctgactcagcctgcctcgtgtcgtgggtctccgtggacagtcgatcatcgccatcctctgcacgtggaaccngcagtgacgtttggagttaatactattgtctccgtaggtatacaacagaccacccgaggaccaaaaccgacccccaaaatctaattaaagtttactagatcgaccgtaggaacgggacggaaggtcttagtaacttttagttaacgtgacacgtctataatacgtaacacggacaacgacaggaccgtacggttacgggggttaccttacgggaaaccgttcgggaaaccgtaaacggttcccgtaaccgttacccggacccgtacgtaccgaaccggtaccccgaaaccgggaacccccctaaaccccgtaccgttaccgttacccgttaaacccgtttcccgtttaccccggttacccccccggttacccctttaccccgttaacccgtttaacccgtacggttacccgttacccgtttaccgggtccggtaacccggggtcccgggttacggtaccggggtacccgggtaaacgggcccgtaacgacggttacgacnganngng

SEQ ID NO: 228550 - DNA, 584 bp, Homo sapiens
  misc_feature: GYAE6OF01AU5QJ.4.37.D04.1.454.CMB.1.raw
  modified_base (233)..(233): a, c, t, g, unknown or other
  misc_feature (233)..(233): n is a, c, g, or t
  modified_base (346)..(346): a, c, t, g, unknown or other
  misc_feature (346)..(346): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcatcgccatctcctgcactggaaccngcagtgacgttggtgtataactatgtctcctggtatcaacagcaccgaggcaaacgccccaaactcaataattatgatgctgaggacgaggctagtattatactgacagctanataataacaagcagacagactacggttgggttcttacgggaacgtcgggaacctaacgggtccaacccggttccgtacccgtacgtccgaccgaccccaacggaccccaaccccactccgtaccaccgttccttacccggttaccccctaccccttcccttacccgactacgtccgcctcgtacggcggtccgggtcgtagggaccgtaacggcccgtatacgtaagcgatcncgngn

SEQ ID NO: 228551 - DNA, 541 bp, Homo sapiens
  misc_feature: GYAE6OF01CMJX9.4.37.D04.1.454.CMB.1.raw
  modified_base (306)..(306): a, c, t, g, unknown or other
  misc_feature (306)..(306): n is a, c, g, or t
  modified_base (489)..(489): a, c, t, g, unknown or other
  misc_feature (489)..(489): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
tcagagcactgtagcacgaccggtgctcgatttagtagcatactggttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgcatctcctgcacgtggaaccagcagtgacgttggtgttataactatgtctctggtatcaacagcaccaggcaaacgcccccaaatcaataattangatgcgtgaggacgaggctagatttatacgtgcgagctcaatatacaagtcgagcagctacggtggggttacttacggaacgtgggaaccaaggtccacggtccgtcccacgtcacgacccgaacgaccccaaacccactcgtacctacgtacgttccgttacccccaccttcctacccgtanacgtcgctcgtagacggtcggtctcgggacacggcgactagtgcnacngntg

SEQ ID NO: 228552 - DNA, 558 bp, Homo sapiens
  misc_feature: GYAE6OF01EVNZS.4.37.D04.1.454.CMB.1.raw
  modified_base (352)..(352): a, c, t, g, unknown or other
  misc_feature (352)..(352): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagccaccaggcaaaacgcccccaaaatcaataatttatgatgctggaggacgaggctgattattactgcagctacaatanacaagcagcagcacgtgggtcttacggaacgtgggacaaggtacaccgtcgtacccacgtcacgacccgaacggcccaaccccactcgtcctaccttcctccgttcccccgtccccttccctccctacgtacgtacgtccttccgtacggacgggtccgggcgttagggaccgaaacgggccgaccgaagttacggcgantgntcg

SEQ ID NO: 228553 - DNA, 679 bp, Homo sapiens
  misc_feature: GYAE6OF01DU5KU.4.37.D04.1.454.CMB.1.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (335)..(335): a, c, t, g, unknown or other
  misc_feature (335)..(335): n is a, c, g, or t
  modified_base (643)..(643): a, c, t, g, unknown or other
  misc_feature (643)..(643): n is a, c, g, or t
  modified_base (665)..(665): a, c, t, g, unknown or other
  misc_feature (665)..(665): n is a, c, g, or t
  modified_base (673)..(674): a, c, t, g, unknown or other
  misc_feature (673)..(674): n is a, c, g, or t
  modified_base (676)..(678): a, c, t, g, unknown or other
  misc_feature (676)..(678): n is a, c, g, or t
tcagagcactgtagcacgaccggtgctcgatttagtagcatactgttggggtttggggggggtctcaggaggcagcgctctcgggacgtctccaccatggcctgggctctgctattccctcaccctcctcactcgagggcacgagggtcctgggcccagtctgccctgactcagcctgcctccgtgtcgtgggtctccgtggacagtcgatcactcgcctatcctcctgctacgtggaaccngcagtgtacgttggtagttataactntcgtctccgtggtatcaacagccgacccggaccaaaccgtacccccaaaagtctaaattaactttanaggattcggactagggaaggtacggaggtacttagtaactttattacgtcgacgagtccttacaaattaactaacgaagcgagaccgaggtaccgtaacgggttcggggttacgttaaccggggaaccgttaacggggaaccctaacggggttccctaacccggttaccgtacccgaccggtaccaaccggaaccccgaaccgaccccaaccccgtcgtaccgttccaccgttaccttccccgttaccccctacccttcccgttacctacgtaccgtcgtaccgtacgtcgggacggtcccggggtanccgggagacgggccctaagtancgtacgcnncnnng

SEQ ID NO: 228554 - DNA, 706 bp, Homo sapiens
  misc_feature: GYAE6OF01ESJZG.4.37.D04.1.454.CMB.1.raw
  modified_base (308)..(308): a, c, t, g, unknown or other
  misc_feature (308)..(308): n is a, c, g, or t
  modified_base (700)..(700): a, c, t, g, unknown or other
  misc_feature (700)..(700): n is a, c, g, or t
  modified_base (702)..(704): a, c, t, g, unknown or other
  misc_feature (702)..(704): n is a, c, g, or t
  modified_base (706)..(706): a, c, t, g, unknown or other
  misc_feature (706)..(706): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttatactatgtctctggtatcaacagcaccgaggcaaacgccccaaaactcaattaatttanagtatgctagagggacgagggtctagtatttacgtactgcagtctactaataataacgaaacgtcgaacgcaacggaccgttaacggttcggggttacccgtttaaaccggggtaaccgttaccggggggtaaacccgtaaaacgggttccccgtaaacccccgggtttccggttaacccccgaaccgggtcccgtaacccgggaaccccccgaaaccggggacccccctaaaacccccgtaccttacgtaacccgtaaccgttccccgttaacccgtttccccccggtaccccccgttaccctttacccgtaaccgtacggttccgtaccgttcccgttaccgggaacgtcccgggtctacgggaacggtaacggccggaccctagtacgnannngn

SEQ ID NO: 228555 - DNA, 648 bp, Homo sapiens
  misc_feature: GYAE6OF01B2TKR.4.37.D04.1.454.CMB.1.raw
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (366)..(366): a, c, t, g, unknown or other
  misc_feature (366)..(366): n is a, c, g, or t
  modified_base (642)..(642): a, c, t, g, unknown or other
  misc_feature (642)..(642): n is a, c, g, or t
  modified_base (645)..(645): a, c, t, g, unknown or other
  misc_feature (645)..(645): n is a, c, g, or t
  modified_base (648)..(648): a, c, t, g, unknown or other
  misc_feature (648)..(648): n is a, c, g, or t
tcagagcactgtagcacgaccggtgctcgatttagtagcatactggttgggtttggggggggtctcaggaggcagcgctctcgggacgtctccaccatggcctgggctctgctattcctcaccctcctcactcagggcacagggtcctgggcccagtctcgccctgactcagcctgcctccgtgtctgggtctccgtggacagtcgatcatccgcatcctctgcacgtcggaaccngcagtgtacgttggtgttatactatgtctctggtataccaacngccaccgaggaccaaacgaccccaaatcctaattaactttanggtaatgtacgtggaacgggacgaggtctagtaattacgttaacngactagctacatactaacgaagctagacacgcgtacggttcgggttactacgggaacggttacggaacccgtaacggtacccgtacccggttaccgtacccgaccggtaccaccggaccccgtaaccggaccccaaccccgtagtccgtacccgtacgttcccgttaccccgttaccccctaccccgttccccgttacctaccgtacgtccgtacttccgtacggaccgggtccgggtcgtacgggacctaacggggccgaacgtacgtacgctancgntgn

SEQ ID NO: 228556 - DNA, 924 bp, Homo sapiens
  misc_feature: GYAE6OF01DW0ZA.4.37.D04.1.454.CMB.1.raw
  modified_base (914)..(914): a, c, t, g, unknown or other
  misc_feature (914)..(914): n is a, c, g, or t
  modified_base (920)..(920): a, c, t, g, unknown or other
  misc_feature (920)..(920): n is a, c, g, or t
tcagagcactgtagcacgaccggtgctcgatttagtagcatactgttggggtttggggggggtctcaggaggcagcgctcgtcgggacgtctccaccatggcctggctctgctattcctcaccctcctcactcgagggcacgagggtcctcgggcccagtctcgccctgactcacgcctgcctcgtgtcgtgggtcctccgtggacagtcgatcactccgcctactcctccgtgacctacgtcggaaaccagcgaggtggtacggttgggttagttaactaacgtagtcgtccttccgttaggtactaccgaacgacgacccgaacccgaacgggaacccaaaacccgtacccccctaaaattaaccgtaaacttttaaagtttagtacgtaacgtcggtacgtaaggggaacgggtaacggtacggtagttacggttaaactttacgtttaaccgcgtacccgtaacgttaccttaacgtaaaagtttaaccgtaaacggaacgtaccgaacggtaccggaacggttaccccggttaaccgggggttaccggggttttaacccggtaaacgggttaaacccggggtaacggggtaaaccccgttaaacccggggttaccccgtaaccccggttaccccggttacccccgtaaccgggtaaccccgtaaccccgggaaaccccccggaaacccgggtaaccccccttaaaccccgtaccggtttaccgtaaccccgttacccgttttaaccggtttcccccggtttaccccgtttaccccgttaccccccgtttcccttaacccggttaccggttccggttaacccgttcccggttaccggtaaacggggtcccgggggttaccgaccggggttaaccggaaccggtaccggggacccgttacgaagaccggtngttacncgta

SEQ ID NO: 228557 - DNA, 648 bp, Homo sapiens
  misc_feature: GYAE6OF01ERLY4.4.37.D04.1.454.CMB.1.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (647)..(647): a, c, t, g, unknown or other
  misc_feature (647)..(647): n is a, c, g, or t
tcagagcactgtagcacgaccggtgctcgatttagtagcatactgttgggtttggggggggtctcaggaggcagcgctctcgggacgtctccaccatggcctgggctctgctattccctcaccctcctcactcagggcacagggtcctgggcccagtctgccctgactcagcctgcctccgtgtctgggtctcctggacagtcgatcatcgccatctcctgcactggaaccngcagtgacgttggtagttataactatgtctcctgtatcaacngccaccaggaccaaacgcccccaaatctaattaatttntgaatgtactggaggacgaggtctagtaatttacttacgngactagtctactaataactaacaacgcagacacgacgtacggttggggttaccgtttacgggaacgtacgggaaccgtaacggtccgtacccggtccgtccccgaccgtccgaaccgaccccgaaccggaccccaaccccgtactccggttacccaacccgttcccgttacccggttcccccgtaccccctttcccttacccgtaacgtaccggttccgtaccgttccggtacggaccggtccggggtccgtacgggtacccggaacgggccgtaccgaacgtgacgtncgngcng

SEQ ID NO: 228558 - DNA, 599 bp, Homo sapiens
  misc_feature: GYAE6OF01ES8QE.4.37.D04.1.454.CMB.1.raw
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcgagggcacgaggggtcctgggcccagtctgccctgactcagcctgcctccgtgtctgggtctccgtggacngtcgatcatcgccatctctgcancggaaccngcaggtgacgttggtgttataactntgtctctgtatcaacngccaccaggacaacgaccccaaatctaattaatttanagatcgctggaggacgagctagtattattacgtgcagtctacatactaacaagcaggacacgcgtacgttcgggttctaacggaacggtggaacccgaaggtccgtaacccggtccgtacctacgtacccgaacgacccgaaccggaccccaacccgtacgtaccgtaccgtaccttccgtacccggttaccccgtcccctaccgtaccgtactacgtctacttcccgagacccggtcgggccgtagggaccgtaacgggccgtaataacgtcgactgacngtcgn

SEQ ID NO: 228559 - DNA, 498 bp, Homo sapiens
  misc_feature: GYAE6OF01CXCEJ.4.37.D04.1.454.CMB.1.raw
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
  modified_base (493)..(498): a, c, t, g, unknown or other
  misc_feature (493)..(498): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccagcagtgacgttggtgttaataactatgtctcctggtatcaacagcaccaggacaaacgcccccaaatcaattaattangatgctgaggacgaggctagtatttatacngcagtctanaatataacagcagcagcacgtgggtactcggaacgtgggaccaaggtcacgtccgtcccacgtcacgccaacggcccaaccnctgcactctccgtcccacctctctacngtcgctcgngaggcggtctggacaggcgacagtagnnnnnn

SEQ ID NO: 228560 - DNA, 732 bp, Homo sapiens
  misc_feature: GYAE6OF01CUTXR.4.37.D04.1.454.CMB.1.raw
  modified_base (716)..(716): a, c, t, g, unknown or other
  misc_feature (716)..(716): n is a, c, g, or t
  modified_base (724)..(724): a, c, t, g, unknown or other
  misc_feature (724)..(724): n is a, c, g, or t
  modified_base (730)..(731): a, c, t, g, unknown or other
  misc_feature (730)..(731): n is a, c, g, or t
tcagagcactgtagcacgaccggtgctcgatttagtagcatactggtttggggtttggggggggtctcaggaggcagcgctctcgggacgtctccaccatggcctgggctctgctattcctcaccctctcactcgagggcacgaggtccgtggcccagtctcgcctgactcacgctgcctcgtcgtcgtggtctccgtggactagtcgatcacgtcgcctatcctcgtcgacacgtacggaaccagcgaggtcgtacgttggtagttactaactagtacgtctacgtaggtaactaccaacgacgacccaaccgacgaaccctaaacccggaaccccctaaactactaaatttaaactttagagtacgtacggtacgtaggacgggtaaccggaggtacttaggttaactttaacgtacgtacgtacgacgtactaactaaagttaacgtaacaacgtaccgaagaaccgagtaccggttaacgggtttccgggttaccggttaccgggtaacggtaccggaaaccgtaccgtcccggtaccgtacccgtaccggacctaccgaccgaaccccgtaacgacccctaaccccgtagaccttcgaacccgttccgtaccccgttcccccgtacccctccgttaacccgtacctcggtacccggttcttcggacccgggtacgggtcccggaacggtccggacccgaggggtaccacgnggtacgangactgnng

SEQ ID NO: 228561 - DNA, 641 bp, Homo sapiens
  misc_feature: GYAE6OF01EKVNH.4.37.D04.1.454.CMB.1.raw
tcagagcactgtagcacgaccggtgctcgattttagtagcatactgttggggtttggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcactccgccattcctcctgccacgtacggaccagcagtcggtacgttggttaggttataactatcgtcctccgtcgtaccgacgacaaccacccacggaaccaaacccgacccccaaacctactacgttcgtttaattagtatcgtcactcggtacgtccggcttcgtagggggttttctaggttccgcttctctggctccaagttctaggcaacgaccggcctaccctgacccattctcgtgggcctcccgaggccgtggacgggacgacggctgtactttaacttactggacctacgtcttacattaacgtaacaagctaagccaagctacgtcggtagggggttacgttcgggaccggggtaacgggaacccgaacggtccgtacggtacccggttaccgtaacgggtccgaaccggcccggtaaaccggg

SEQ ID NO: 228562 - DNA, 600 bp, Homo sapiens
  misc_feature: GYAE6OF01AS7WF.4.37.D04.1.454.CMB.1.raw
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (298)..(299): a, c, t, g, unknown or other
  misc_feature (298)..(299): n is a, c, g, or t
  modified_base (594)..(596): a, c, t, g, unknown or other
  misc_feature (594)..(596): n is a, c, g, or t
  modified_base (598)..(598): a, c, t, g, unknown or other
  misc_feature (598)..(598): n is a, c, g, or t
tcagagcactgtagcacgaccggtgctcgatttagtagcatactgttgggtttgggggggtctcaggaggcagcgctctcgggacgtctccaccatggcctgggctctgctattcctcaccctctcactcagggcacgagggtcctgggcccagtctgccctgactcagcctgcctccgtgtctgggtctcctggacagtcgatcatcgccatctcctgcactggaaccagcagtcgacgttggngttataactntgtctctgtatcacngcaccagcaacgccccaatcataattannatgctgaggacgaggctagattacttactcgcacggtctactataagtaccaaagccagacgagacctaaggttcggggtaccttacgggaaccgttacgggaaccgtaacggttaccgaaccggttccgtaccccgtacgaccgacgaccccgaagaccccgaacccctacgtccggtaccctaacctcccgttaccggttccccctaaccccttcccgtaccgtaaccgtcggtccgtccctcgtacggaccggccggttccgagggtacccaacgggtcgacaagtcgacgnnngngc

SEQ ID NO: 228563 - DNA, 732 bp, Homo sapiens
  misc_feature: GYAE6OF01DJ13W.4.37.D04.1.454.CMB.1.raw
  modified_base (144)..(144): a, c, t, g, unknown or other
  misc_feature (144)..(144): n is a, c, g, or t
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (670)..(670): a, c, t, g, unknown or other
  misc_feature (670)..(670): n is a, c, g, or t
  modified_base (730)..(730): a, c, t, g, unknown or other
  misc_feature (730)..(730): n is a, c, g, or t
tcagagcactgtagcacgaccggtgctcgatttagtagcatactgttggggtttggggggggtctcaggaggcagcgctcgtcgggacgtctccaccatggcctggctctgcttattcctcaccctcctcactcgagggcacgngggtcctgggcccagtctcgccctgactcacgcctgccctccgtgtcgtgggtctccgtggacagtcgatcactccgacctatcctcctgcctacgtacggaaccngctaggtacggtacgtttgggtagttataactatcgtcctcgtagtactacaacncgcaccgaggaccaaaccgacccccaagtctaatttaattnacgtatcgaccgtagggaacggacgtacggtacttagttacgtttaacttcgtagtacgacgtctaacttaaacgtaactaaacgagacccaaggtacgaacggttcgttacggggttaccgggggttaccttaccggggtaaaccggtacgggaacccggtaacggtacccgtacccggttacccggacccgtaccgtaccgacccggaacccgaacccggtacccccgtaaacccctcgtaccgttacccgtacccgttcccgttaccccggtttccccccgtacccgttccctacctaaccggtctaccgtccgttaccgngggccgtccggggtccgttacgggaccggaacggtaccgcgttaacgagtcagcctaggnac

SEQ ID NO: 228564 - DNA, 825 bp, Homo sapiens
  misc_feature: GYAE6OF01ESGWV.4.37.D04.1.454.CMB.1.raw
  modified_base (205)..(205): a, c, t, g, unknown or other
  misc_feature (205)..(205): n is a, c, g, or t
  modified_base (657)..(657): a, c, t, g, unknown or other
  misc_feature (657)..(657): n is a, c, g, or t
  modified_base (791)..(791): a, c, t, g, unknown or other
  misc_feature (791)..(791): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctctcactcgagggcacgagggtcctgggcccagtctcgccctgactcacgtcctgcctcgtgtcgtgggtcctcgtggacngtcgatcactcgccattcctccgtagcctacgtacgggaacctaggtctaacggttcggttaccggtttgggttaaggtttaactaacgttagttcgtaccgttccgttaggttaactacaaaccgagtacccaaccgtacggaaccaaaccggaccccctaaaacgttacaacgtttaaagttttacgaggtaacgtcgtagtacggtaacgggtaacgtacggtaccttaggtaactttacgtaccgtagacctaggtcttaacggtaactaacgtaaccgtaaacgaccgaaggtaccacggtacgtaaccgggtttcgggttacgttaaccgggaaccgtttaggggaacccgttaaacggtcccgtaacccggttacccggttacccccgaacgggttaccaaaccccgggaccccggtaaaacgggccccctaaaacccccggttnttaccggttaccctaccttacccggtttaacctccccgtaaccccctttccgttacccgaacgtaccgccgtttccgaaccgtttaccgggacgggttacccgggtcgtaacgggacccgtaacggggaacccngttaaacgttcggaactggtaccaagccggtaag

SEQ ID NO: 228565 - DNA, 698 bp, Homo sapiens
  misc_feature: GYAE6OF01C6K50.4.37.D04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (272)..(272): a, c, t, g, unknown or other
  misc_feature (272)..(272): n is a, c, g, or t
  modified_base (666)..(666): a, c, t, g, unknown or other
  misc_feature (666)..(666): n is a, c, g, or t
  modified_base (692)..(692): a, c, t, g, unknown or other
  misc_feature (692)..(692): n is a, c, g, or t
  modified_base (695)..(695): a, c, t, g, unknown or other
  misc_feature (695)..(695): n is a, c, g, or t
tcagagcactgtagcacgaccggtgctcgatttagtagcatactggttgggtttgggggggtctcgaggagcagcgctctcgggactctccaccatggcctggctctgctattcctcaccctctcactcgagggcacagggtcctgggcccagtcctcgccctgactcacgcctgcctcgtgtcgtggtctcgtgacnggtcatcacnccgcctactcctcncgacacgtacggaacngcgtaggttcgtaggttggttaggttataacgtntcgttactcctaggttacacaacgtacgaccaccgaggaacccaaaccgacccctaaacactaacttaacttgtacgtacgtaggctaacggaacgggtacgacggttacctaaggttactttaaccgttacgacgtaccgacttacaacggttaacgtaataaccggtaaaacggctaaacggaccgtaacgtaccgggtacgggttacgggttacccgttaacgggaaccggttaaccgggaacccgtaacgggttacccgtaccccgggtttaccaccccggtaacccgtacgaacccggacccgtaaacccggacccaaacccgtcgtacgtccctaccgttcgttccccgtccgacccttccgaacttcggctaccgtcgtcgaccggngtccgtgacgcgacgctacgacgtgncgncgc

SEQ ID NO: 228566 - DNA, 650 bp, Homo sapiens
  misc_feature: GYAE6OF01BXIJU.4.37.D04.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (331)..(331): a, c, t, g, unknown or other
  misc_feature (331)..(331): n is a, c, g, or t
  modified_base (641)..(641): a, c, t, g, unknown or other
  misc_feature (641)..(641): n is a, c, g, or t
  modified_base (645)..(645): a, c, t, g, unknown or other
  misc_feature (645)..(645): n is a, c, g, or t
  modified_base (648)..(648): a, c, t, g, unknown or other
  misc_feature (648)..(648): n is a, c, g, or t
tcagagcactgtagcacgaccggtgctcgatttagtagcatactgttggggtttggggggggtctcaggaggcagcgctcgtcgggacgtctccaccatggcctgggctctgctattcctccaccctcctcactcagggcacgagggtcctgggcccagtctgccctgactcagcctgcctcgtgtcgtgggtctcgtggacngtcgatcatcgccatcctcctgcacgtacggaaccngcagtgtacgttggtagttataactatcgtctcgtgtatacaacagaccaccgaaggaccaaaccgacccccaaactctaaatttaatttanagtatcgcgtaggaagggacgaggtacttagtaactttactacgtcgacaggtcctactaaagttactaacgaacgacgagaccgtacggtaccgtagggtcggggttacgtaaccgggtaacggtacgggacgtaacggtccgtaccggtccgtacccgacgtaccgaccgacccgacgaccccacccgacgtctacctacgttcccgtcccgttcccccgtacccttccctacccgtacgtacggtacctccgtaccgtacggaccgggtccggtcggtacggaccgtacgggtacgacgtagtacgngagnagngc

SEQ ID NO: 228567 - DNA, 723 bp, Homo sapiens
  misc_feature: GYAE6OF01EFIOC.4.37.D04.1.454.CMB.1.raw
  modified_base (244)..(244): a, c, t, g, unknown or other
  misc_feature (244)..(244): n is a, c, g, or t
  modified_base (718)..(718): a, c, t, g, unknown or other
  misc_feature (718)..(718): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcgagggcacagggtcctgggcccagtctgcccgtgactcagcctgcctccgtgtcgtgggtctccgtggacagtcgatcactccgcattcctccagcctaactcggaaacccngcaggtgacgttggtaggttatactatcgtctccgtggtactcaagacgaccaccgtaagggaccaaaaccgaccccccctaaagttactaacgttaaacttttagtagaagttcgtacgtacgggaaacggtaccggtagggtcgttagtaatttacttaacgtcacacgtactactaatactaacgacgatacgacgacgacgtacggttacgggttaccgttaaccgggacgtacggggtaaacctacgggtacctacccgtccgtaccccgtacgtccgaacgacccccggtaaaggcccccaaaccgttacctccgtaccgtccttaacccgttcccgttacccccaacccctttcctaacccgttaacgccggttacgtacccgttcggaccggtaccggggtaccgggtcccggttaaggacccgggtaacggcccgtaacggtaaccttaggacgtcaggtcccgngacgg

SEQ ID NO: 228568 - DNA, 584 bp, Homo sapiens
  misc_feature: GYAE6OF01EVNHN.4.37.D04.1.454.CMB.1.raw
  modified_base (169)..(169): a, c, t, g, unknown or other
  misc_feature (169)..(169): n is a, c, g, or t
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
  modified_base (575)..(575): a, c, t, g, unknown or other
  misc_feature (575)..(575): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactnagcctgcctcgtgtctgggtctcctggacagtcgatcatcgcatctcctgcactggaaccngcagtgtacgttggtagttataactatgtctcctgtactcaacagccaccaggacaacgccccaatcataatttangatgctggagacgagtctgtattatacgtgacagctactaatacaacgaacgcaacgcacgactacggttgggtcctacggaacgtcgggaaccgtaacggtccgaccgtaccgtacccgacgtccaaccgacccaacggaccccaaacccgtacttaccgtaaccttccgttacccgttacccccaccccttaccttacccgtaacgtacgtcgtaccgtcgtacggtacggccgggtcgtacggacgaacggccgactagtaccgtnacancnngn

SEQ ID NO: 228569 - DNA, 557 bp, Homo sapiens
  misc_feature: GYAE6OF01E2RC7.4.37.D04.1.454.CMB.1.raw
  modified_base (311)..(311): a, c, t, g, unknown or other
  misc_feature (311)..(311): n is a, c, g, or t
  modified_base (505)..(505): a, c, t, g, unknown or other
  misc_feature (505)..(505): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
tcagagcactgtagcacgaccggtgctcgatttagtagcatactgttggggtttggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccgaggcaaacgcccccaaatcataatttangatgctggaggacgaggctagatttattactgctagctacatatacaagcagcagacgacgttggggtcttacgggaacgtcgggaaccaacggtccaccgtcgtccccgacgtaccgaccgacccgaacggccccaacccctactcgtccacttcctcccgttacccctacccttccctacctacctacgtcnccttcgtcgacggtccgggcgtaggaccacggggccactagtacnancnnga

SEQ ID NO: 228570 - DNA, 741 bp, Homo sapiens
  misc_feature: GYAE6OF01EKZLO.4.37.D04.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (739)..(739): a, c, t, g, unknown or other
  misc_feature (739)..(739): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacgacgggtcctgggcccagtctcgccctgactcagcctgcctcgtgtctggtctccnggacngtcgatcatcgcatcctctgacacgtacggaaccnggcagtggtacggttggttagttaataactnttcgtacctccgtaggtactaccaagtaccgaccaacccgaacggtaacccaaaaccggtaacccccctaaaataccgttaattaaacgttttacgagtagtcgtacgtaggaacgggagtacggtnttagtaatttacgtacgnggtcaacgtcctataacttaacgtaactaacggctaacggactacggtacggtacgggtttagggttacccgtaacgggtaacgtccggggtaaaacgtacggtacccgttaacggtccggtaccccgttacccgtaaagtaccccggtacccgaaacccggtaacccggaacccctaaaccccggtcttacggtccctaaccggttcccctttacccgtacccccccgttccttaaccctttacccgacgttcccggtacgtccgttccggtaacggcgggtcccgggtacgacgggtaaccgtacgccgttacgatacgctgactncg

SEQ ID NO: 228571 - DNA, 681 bp, Homo sapiens
  misc_feature: GYAE6OF01B6T4K.4.37.D04.1.454.CMB.1.raw
  modified_base (239)..(239): a, c, t, g, unknown or other
  misc_feature (239)..(239): n is a, c, g, or t
  modified_base (587)..(587): a, c, t, g, unknown or other
  misc_feature (587)..(587): n is a, c, g, or t
  modified_base (672)..(672): a, c, t, g, unknown or other
  misc_feature (672)..(672): n is a, c, g, or t
  modified_base (680)..(680): a, c, t, g, unknown or other
  misc_feature (680)..(680): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcgtggacagtcgatcatccgcattcgtcctgctacgtcggaaccngcaggttcgacggtttgggtagtttaataactagttcgtccttcgtaggttactccaacgacgccaacccgaggaccaaaaccgtccccccaaaattcaaactttaagtttaactaggactgtacgagggtaaggacgtaggacttagtaacgtttacttaacgcggactacgccttaacaatactaaacgagtacgacgcgtaacgcggttaacggttcgggtacgttacgggtaaccgtcggaaccgtacggtaccgtacccggttccgtacccgaacgtccgaaccgcccgtaaacgccccaaccgtacgtcgacctcgttacccgtcccgtaccccttaccccnccttaaccgtccgacggtcctaccgtccgttagggaccggtcccgggtcttaccgggacgtaaccgggcgtaccgaagttccgancgcagtcng

SEQ ID NO: 228572 - DNA, 491 bp, Homo sapiens
  misc_feature: GYAE6OF02JEOOC.4.37.D04.1.454.CMB.1.raw
  modified_base (304)..(304): a, c, t, g, unknown or other
  misc_feature (304)..(304): n is a, c, g, or t
  modified_base (480)..(480): a, c, t, g, unknown or other
  misc_feature (480)..(480): n is a, c, g, or t
  modified_base (486)..(491): a, c, t, g, unknown or other
  misc_feature (486)..(491): n is a, c, g, or t
tcagagcactgtagcacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaatcataattangatgctgaggacgaggctgattatactgcagctcatatacaagcagcagcacgtgggtcttcggaactgggaccaaggtcaccgtcgtcccagtcagcccaaggcccaacccactgtccactcctacgttccccaccctcctccctacagttcgctctgacgcggctggcaaggcncatagnnnnnn

SEQ ID NO: 228573 - DNA, 519 bp, Homo sapiens
  misc_feature: GYAE6OF02I8NN5.4.37.D04.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
  modified_base (470)..(470): a, c, t, g, unknown or other
  misc_feature (470)..(470): n is a, c, g, or t
  modified_base (504)..(504): a, c, t, g, unknown or other
  misc_feature (504)..(504): n is a, c, g, or t
  modified_base (514)..(519): a, c, t, g, unknown or other
  misc_feature (514)..(519): n is a, c, g, or t
tcagagcactgtagcacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggngttataactatgtctcctggtctacaacagcaccacggnaaacgccccaaactcaataactttatgatcgctagaggacgaggctgtattattactgcagctcaatatacaagacagcagcacgtgggtcttacggaacgtgggaaccaagtacaccggtcctcccacgtnaacgacccgaaggcccaacccactgtacactctcgttacccaccctcctactaccngacgtctactagcgaccggtcggtacaacggtcncgtaatcggnnnnnn

SEQ ID NO: 228574 - DNA, 522 bp, Homo sapiens
  misc_feature: GYAE6OF02HIVPD.4.37.D04.1.454.CMB.1.raw
  modified_base (434)..(434): a, c, t, g, unknown or other
  misc_feature (434)..(434): n is a, c, g, or t
  modified_base (517)..(522): a, c, t, g, unknown or other
  misc_feature (517)..(522): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaatcaattaatttatgatgctaggaggacgaggctagattattactgcagctcatatacaagcagcagcacgtggggtcttacggaactgggaccaaggtcaccgtcgacccacgtcacgccccaaggccccaaacccnctcgtccaccttcctccgttccccacccttccctacctacagtcgccttcgtgacggccgggctcggacaaggcgacagtagnnnnnn

SEQ ID NO: 228575 - DNA, 530 bp, Homo sapiens
  misc_feature: GYAE6OF02G4X7K.4.37.D04.1.454.CMB.1.raw
  modified_base (230)..(230): a, c, t, g, unknown or other
  misc_feature (230)..(230): n is a, c, g, or t
  modified_base (367)..(367): a, c, t, g, unknown or other
  misc_feature (367)..(367): n is a, c, g, or t
tcagagcactgtagcacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctcctggtatcaacagcacccaggcaaacgcccccaaactcatcgtttatgatgtcactgatcggccctgaggggtttctagtcgcttctctggctcaagtctggcaacncggcctcctgaccatcctcgtcgggcctccgaggtctaggacggacgaggcttagatttattactgcagtctcaatactacaagcagcagcactcggtaggggtacttcgggacgggaacggaccaaggcctacggacccgttccgtagggtcacgtacccgg

SEQ ID NO: 228576 - DNA, 700 bp, Homo sapiens
  misc_feature: GYAE6OF02JCSM9.4.37.D04.1.454.CMB.1.raw
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
tcagagcactgtagcacgaccggtgctcgatttagtagcatactgttgggtttgggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcatcatcgcatctctgcactggaaccancagtgacgttgtgttatactatgtctctgtatcaacncgcaccgagacaaacgccccaaatcaattaattacngatgctaggagacgaggtctagtatttatacgtcgacgtaacgtctactaatactaacaaggccaagaccgacgaccgttaacggtcggggttacctttacgggaacgttacggggtaaccgtaaacggttcccgtaaaccggttcccggtaccccgtaacggtacctaccggaacccccgtaaacggacccccgtaaaccctacgttacgtacccgtaccttacccgttcccgtttaccccctaacccgttccccgttaaccgtaccgtacggttccgtaccgttacgttaccgggaaccgggtcccgggttccggtaaccgggtaccggtaaaaccccggggtccgtacccgttaaacggtttaccggtccgtaccgaacgtttaccgacggtaccg

SEQ ID NO: 228577 - DNA, 648 bp, Homo sapiens
  misc_feature: GYAE6OF02H49DB.4.37.D04.1.454.CMB.1.raw
  modified_base (355)..(355): a, c, t, g, unknown or other
  misc_feature (355)..(355): n is a, c, g, or t
  modified_base (512)..(512): a, c, t, g, unknown or other
  misc_feature (512)..(512): n is a, c, g, or t
  modified_base (640)..(640): a, c, t, g, unknown or other
  misc_feature (640)..(640): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
tcagagcactgtagcacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactaggaaccagcagtgacgttggtaggttataactatgtctcctggtatcaacagcacccagacaaaccgaccccaaactcaataatttatgatgcgtggaggacgagtctagtacttattacgtgcagtctanaattaactacgaagccgagtaccgagaccgtacggtttgggggttacctttaccggggaaaccgttcggggaaaccctaacggggttcccaacccgggttaccccgttaccgaaccggtaccgacccgtaccccgaaacggacccccaaaccccgtnttaccggtacctacccgttcccgttacccggttaccccccgtccctttaccccttaacccgtacccgtaaggtcccgtcctaccggtggaccggtcccgggctacgggcgaacggtccactagtcgancgtangnc

SEQ ID NO: 228578 - DNA, 587 bp, Homo sapiens
  misc_feature: GYAE6OF02HHLA4.4.37.D04.1.454.CMB.1.raw
  modified_base (273)..(273): a, c, t, g, unknown or other
  misc_feature (273)..(273): n is a, c, g, or t
  modified_base (579)..(580): a, c, t, g, unknown or other
  misc_feature (579)..(580): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcactggaaccagcagtgacgttggtagttataactatgtctctgtatcaanagcaccaggacaaacgcccccaaactcaattaatttatgatgctgaggacgaggctgattatactgacagctacgataactaacaagcagcacgcgtacgtcggggttaccttacgggaacgtacggggaacctaacggtccaccggttccgtcccgacgtaccgacgaccccgaacgaccccaaacccctcgtaccgttaccacctttccgtcccgttccccgtcccttccccgttacctaccgtacgtccgccttaccgtcgggacggtccgggtctacgggacgaacgggcctacgaacgtgnngacngnn

SEQ ID NO: 228579 - DNA, 665 bp, Homo sapiens
  misc_feature: GYAE6OF02J04KM.4.37.D04.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (338)..(338): a, c, t, g, unknown or other
  misc_feature (338)..(338): n is a, c, g, or t
  modified_base (653)..(653): a, c, t, g, unknown or other
  misc_feature (653)..(653): n is a, c, g, or t
  modified_base (663)..(663): a, c, t, g, unknown or other
  misc_feature (663)..(663): n is a, c, g, or t
tcagagcactgtagcacgaccggtgctcgatttagtagcatactgttgggtttggggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggaacngtcgatcatcgacattctcctgacactcggaaccaggccagtggtacgtttgggtaggttatactatgtccttctggtatccaanacgccaccccgaggccaaaaccgtcccccaaacctactaattaacttttanagtaactcgtacaggtacggacggtagcgttagtaatttacgtttaactcgactagtactactaattaactaacgaacgcacgactaacgacgtacgtcggggttctaaccgggtacgtacggggtaccacggtacctacccggttccgtacccgtacgtaccgtacccgacccgtaacccggacccaaaccccgactccgtacctaccgtccttaccgttccccctaccctacccttccgtaacctcggtcctccttacgacgcgggttaccggccggtaggtacccggaaacgtcccggaactacggggtacncctgtctcgngc

SEQ ID NO: 228580 - DNA, 498 bp, Homo sapiens
  misc_feature: GYAE6OF02JGZ9V.4.37.D04.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (421)..(421): a, c, t, g, unknown or other
  misc_feature (421)..(421): n is a, c, g, or t
  modified_base (494)..(498): a, c, t, g, unknown or other
  misc_feature (494)..(498): n is a, c, g, or t
tcagagcactgtagcacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaangcaccaggcaaacgcccccaaatcaataatttangatgctagaggacgaggctgattntactgcagctaanatacaagcagcagcactgggtcttaggaactgggacaaggtcacggtctacccagtcacgcccaaggtccaaccctancgtcaactctccgttacccaccttccgtccttacatcgactctgacgtcggctcggataacggcgtacatgcnnnnn

SEQ ID NO: 228581 - DNA, 543 bp, Homo sapiens
  misc_feature: GYAE6OF02FV3HP.4.37.D04.1.454.CMB.1.raw
  modified_base (255)..(255): a, c, t, g, unknown or other
  misc_feature (255)..(255): n is a, c, g, or t
  modified_base (311)..(311): a, c, t, g, unknown or other
  misc_feature (311)..(311): n is a, c, g, or t
  modified_base (490)..(490): a, c, t, g, unknown or other
  misc_feature (490)..(490): n is a, c, g, or t
  modified_base (536)..(536): a, c, t, g, unknown or other
  misc_feature (536)..(536): n is a, c, g, or t
  modified_base (539)..(543): a, c, t, g, unknown or other
  misc_feature (539)..(543): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactntgtctcctggttatcaacagccacccgaggacaaacgcccccaaatcataatttancgatgctggaacggcgaggctagattactactgcagctacattactacaagcagcagcacgtgggtactacggactcgggacctaagtccaccggttcctacccgacgtcaacggccccaaggccccaaccctacgtacgtccaccgttcctaccgttccctacccctcctacctacgnttcgactcgtgacggccgggtactggaccgtacggccactagtacncgnnnnn

SEQ ID NO: 228582 - DNA, 637 bp, Homo sapiens
  misc_feature: GYAE6OF02HG5UC.4.37.D04.1.454.CMB.1.raw
  modified_base (231)..(231): a, c, t, g, unknown or other
  misc_feature (231)..(231): n is a, c, g, or t
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
  modified_base (633)..(633): a, c, t, g, unknown or other
  misc_feature (633)..(633): n is a, c, g, or t
tcagagcactgtagcacgaccggtgctcgatttagtagcatactgttgggtttggtgggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcatcgccatctcctgcactggaaccngcagtgacgttggtgttataactatgtctcgtgtactcaancgcaccgagacaaacgaccccaaatcaattaatttangatgctggaggacgaggctagtattatactgactagctactaataactaacaagcaagcgagccgtacgttgggggtacctttacgggaaacgtcgggaaccgtaaagggttcccgtaacccggttccgtacccgtaacggttacccgaacgaccccgaacgggaccccctaacccgtacgttcgttaccctaccgttcccgttacccgtttacccccaacccctttcccgtaacccgtacgtacgttcccgtcccttacgtacggaccgggtccggggtacctacgggtacccgtaacgggccgtacgaacggtcgagtctangtac

SEQ ID NO: 228583 - DNA, 700 bp, Homo sapiens
  misc_feature: GYAE6OF02G72AS.4.37.D04.1.454.CMB.1.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
  modified_base (698)..(698): a, c, t, g, unknown or other
  misc_feature (698)..(698): n is a, c, g, or t
tcagagcactgtagcacgaccggtgctcgatttagtagcatactgttggggtttggggggggtctcaggaggcagcgctctcgggacgtctccaccatggcctgggctctgctattcctcaccctcctcactcgagggcacgagggtcctcgggcccagtctgccctgactcagcctgcctcgtgtcgtgggtctccgtggacagtcgatcatccgcatctcctgcacgtcgaaccngcagtgacggttggtagttatatatgtctcgtgatacaacacgcacgagaccaaccgacccaatactaataattanagatcgagtaggacgacgagctagtacttatacgngacacgctaacataacgtaanaacgtacacggacgtaggtaccgtagggtttacggggttaccgttaacgggtaaccggtaacggggtaaaccgtaacgggtacccgttacccgggttcccgttaacccgaccgttacccgaacccgtaccccggaaaccggaaccccctaacccggtaaccttccggtaaccctacccgttacccgtttacccgttaccccccttacccgtttaccccgtaacccgttaccgtacggttccgtaccgttacgggtacgtccggggttcgggaacccggttcggaaccggggtaacccgtcggtaaactcgggtacacgcgcgcgtaccncg

SEQ ID NO: 228584 - DNA, 689 bp, Homo sapiens
  misc_feature: GYAE6OF02GRVJT.4.37.D04.1.454.CMB.1.raw
  modified_base (309)..(309): a, c, t, g, unknown or other
  misc_feature (309)..(309): n is a, c, g, or t
  modified_base (683)..(683): a, c, t, g, unknown or other
  misc_feature (683)..(683): n is a, c, g, or t
  modified_base (687)..(688): a, c, t, g, unknown or other
  misc_feature (687)..(688): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgcatctcctgcactggaaccagcagtgacgttggtagttataactatgtctctgtatcaacagcaccgagacaaacgaccccaaactcaattaacgtttanagtagtgacgtaggagggacgaggcgtagtaatttacgttactgcgtaagtctacaattactaacaagcaaggcacggtacgaacggttcggggttacgttaccgggaaacgtcggggaaacccgtaacggttaccgaccccggttaccgtaccccgaaccggttaccgaaaccggacccccgtaaacggaccccgaaaccccgtacgttaccggtaccctaaccgttcccgttcccggttaccccccgtcccctttaccccgttcccgttaacgtaccggtacgttccgttacccggtacgggtaccgggtaccgggggtaccgtacggggtacccggaaaccggggacctaacgtacggttacgacgtaccngacnnc

SEQ ID NO: 228585 - DNA, 627 bp, Homo sapiens
  misc_feature: GYAE6OF02IUF9F.4.37.D04.1.454.CMB.1.raw
  modified_base (384)..(384): a, c, t, g, unknown or other
  misc_feature (384)..(384): n is a, c, g, or t
  modified_base (618)..(618): a, c, t, g, unknown or other
  misc_feature (618)..(618): n is a, c, g, or t
  modified_base (626)..(626): a, c, t, g, unknown or other
  misc_feature (626)..(626): n is a, c, g, or t
tcagagcactgtagcacgaccggtgctcgatttagtagcatactgttggggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcagtccgccatcctcctgccactggaaccagcaggtgagttggtgttaataactatgtctcctggtatacaactagaccaacccaggaccaaaacgaccccccaaaatacctaattaactttatagaacttcgactggaacggacgaggactagtaatttatactgacagtacctanaatataaacaacgacagactagacacggttggggtaccttacgggaaacgtcggggaaccaacgggttacctaccgtcgtacccaacggtcgaacgacccgaacggtacccaaacccctagtcgtacctaccttcgttacccttccccgaaccccttccgtaccgttaactacggtcacttcgtggaaccgtcggggactacgggactaacgggtcccaagtacgttaggctanactgacanc

SEQ ID NO: 228586 - DNA, 533 bp, Homo sapiens
  misc_feature: GYAE6OF02F9MPK.4.37.D04.1.454.CMB.1.raw
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatcctcctgcacgtacggaaccagcaggtgtacgttggtaggttataactatgtctctgtancaacngcaccagcaaacgccccaatcataattangatgctagaggacgagctagtaatttatactgcacgctacataactacaagcagcagctacggtgggtccgtacggacgtagggaccaacggtccacccggtcgtcccgacgtcaacgacccaacgaccccaaccctctcgactacctctcctcccctacctccctactaccacgtctctcgacgcggcgggtcacggacgacggcgtacacgtacncagnannc

SEQ ID NO: 228587 - DNA, 584 bp, Homo sapiens
  misc_feature: GYAE6OF02FLE3B.4.37.D04.1.454.CMB.1.raw
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctctggtatcaacagccacccaggaccaaacgccccccaaaactcaataattttangaatcgctagaagggacgaggtctagatttattactgctagctanattaanaacgaagcagcagctacggttcgggtactcggaaacgtcgggaaccagggtccaaccggttcctacccgacgtcaacgaccccgaacggaccccaaaccccgtcttacgacctaccgttccgttacccgttccccgcccttccgtactacgtacgtctcgtaccgtcgacggtcgggtcctggaccggaacggccgacaagttccgnttcgngtacntg

SEQ ID NO: 228588 - DNA, 608 bp, Homo sapiens
  misc_feature: GYAE6OF02HLZIS.4.37.D04.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
tcagagcactgtagcacgaccggtgctcgatttagtagcatactgttggggtttgggggggggtctcaggaggcagcgctctcgggacgtctccaccatggcctgggctctgctattcctcaccctctcactcagggcacagggtcctgggcccagtctgccctgactcagcctgcctcgtgtctgggtctctggacaggtcgatcaccntctctgcacgtggaaccngcaagtgactagttggtagttataactatcgtctacctggtaccagcaacaccaggcaaacgccccaaactcattcgttatgatcgtacactgactccgcctcgagggtttcagtcgtcttctcgtgtcctactagtcctggaccaaccaccggtccctcccgtcgacctacttaccgtcgtaccggtctcccgtaaggactacgggacgggtacgtacggtcttaggtactttaagttccgagactacgtcacgttatacgtaacgacgccgacgacgactacgtacgttcggttacggggtacgttccggggaacggtacggaacgtaacgcggtaccgtaccggtacgtacggtccggtccgaccggtagtccccgg

SEQ ID NO: 228589 - DNA, 606 bp, Homo sapiens
  misc_feature: GYAE6OF02H7ZEJ.4.37.D04.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (603)..(606): a, c, t, g, unknown or other
  misc_feature (603)..(606): n is a, c, g, or t
tcagagcactgtagcacgaccggtgctcgatttagtagcatactgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcatcatcgccactctgcatcggaacngctagtgacgttggtagttataactatgtctctaggtatacaacagcaacccgagtaccaaacgcccccctaaatactaacttaatttacgtgaacttgcgtaggacggagaggtctagtactttaataccgtgactagctactaattaagtaacagtacaggcacgactaccggttggggttacttacggggacgttacgggaaccgtacgggtacctaacggtcccgttacccacggtacaaccggaacccgtaacggacccaaccccgtatcgtacctacgttccctaccgttacccctccctacctaccttagtacggtctcgtacgtcggagtccggttacgcggtaacgaccgcggtaacatgcgtcannnn

SEQ ID NO: 228590 - DNA, 742 bp, Homo sapiens
  misc_feature: GYAE6OF02GL01C.4.37.D04.1.454.CMB.1.raw
  modified_base (207)..(207): a, c, t, g, unknown or other
  misc_feature (207)..(207): n is a, c, g, or t
  modified_base (738)..(738): a, c, t, g, unknown or other
  misc_feature (738)..(738): n is a, c, g, or t
tcagagcactgtagcacgaccggtgctcgatttagtagcatactggttggggtttggggggggtctcaggaggcagcgctctcgggacgtctccaccatggcctgggctctgctattcctcaccctcctcactcgaggcacgaggtcctggcccagtctcgccctagactcagcctgcctccgtgtcgtggtctcgtgacagtcgancatccgcactcctcctgactacgacggaaccaggtactacggtagtaccggtttaggttagggttaaattaaccgtaagttccgtcgttaccgtaggtatacaacgacgtaccaaccgaaggacctaaaccgacccccaaagtacctaacgttaattatcgtacgtcgtaacgaggaacgggtaacgacggtacgtagtaagtttaacgttaccgtacggacacggttactaacgtaagttaaaacgtaacgaacgaaccgaacgacgtaaccggacgttaccggtacgggttacggggtacgttaccggggaacgggtaccggaacgtacgacgtacggtaccgtacgtaacgcgtaaccgaccggtaacgtccgtaccctacccggtacgttaccgtaccgttaccgtacccgttaccccgttaaccccgtccctaccgttacgtccgtacgtacctacggtaccggacgggtaccggggtcctaacgggtaaccggaacgtccggaacgtaccgtacgacctgacctnacgg

SEQ ID NO: 228591 - DNA, 688 bp, Homo sapiens
  misc_feature: GYAE6OF02G0TAL.4.37.D04.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (682)..(682): a, c, t, g, unknown or other
  misc_feature (682)..(682): n is a, c, g, or t
  modified_base (686)..(686): a, c, t, g, unknown or other
  misc_feature (686)..(686): n is a, c, g, or t
tcagagcactgtagcacgaccggtgctcgatttagtagcatactgttggggtttgggggggggtctcaggaggcagcgctctcgggacgtctccaccatggcctgggctctgctattcctcaccctcctcactcagggcacagggtcctgggcccagtctgccctgactcagcctgcctcgtgtcgtggtctcgtggacngtcgatcatcgcctatcctcgtgcctacgtcggaaccngctaggtcggacggtttggtaggttaactaaacgttattcgtccttcgtggtactaccaacacgaccgaaccgaggaaccaaaccccgacccccaaaacgtactaaacgttaatttagcgtaagtcgcgttacggacggtacggagtaccgtagtaactttagttcgagactacgtactaataacgtaaagtaacgaaacgtcgaacgcgaacgcggtacggggttcgggttacccgttaccgggaaccggttacgggaacctaacggtccgacccggttacccgacccgtaccgaccggaaccgacccgaacccgacccaaccctaggttaccgtacctacgttcctacccgttacccctaccctccgtaacctcggtactcctaccgcgacggtcgggccggtacgtacggaccgggacgcgtacgtaacgtcgcgtagtcncgancg

SEQ ID NO: 228592 - DNA, 810 bp, Homo sapiens
  misc_feature: GYAE6OF02IWUWB.4.37.D04.1.454.CMB.1.raw
  modified_base (262)..(262): a, c, t, g, unknown or other
  misc_feature (262)..(262): n is a, c, g, or t
tcagagcactgtagcacgaccggtgctcgatttagtagcatactgttggggtttggggggggggtctcaggagggcagcgctctcgggacgtctccaccatggcctgggctctgctattcctccaccctcctcactgacgggcacgacgggtcctgggcccagtctggccctgactcacgcctcgccctccgtgtccgtgggttctccgtggacagtcgactcactccgcctactcctccacgctacgtacggaaccagtcnggtaggtacggttgggttaggtttaactaacttagttacgtccttaccgttacggttactacccgaaacgcggacctaaccggaacgaacggaaacccaaaccccgaccccctaaacgttcgtaaatttaacgtttaatacggttactcgggtacgtaacggggtaacgggaacggtacgggtaccttaggttaaacgtttttacgtaaccggtacgtaccggtagtaccccgtaatttaaacctaaacggaactaaaccggtactaccggactaacggacggttaccgggttacgggtttaccgtaccgggtacgggtaccggaaccggtaccgtaccgacccggttacccgtaccgaccggtccgaacccgacccgtaacccggaccccgtaaccctcggtcctaccgtacctttacccgtaccgtaccccctacccgttcccgtaacctacggtccgtaccgtaccgttacggaccggtaccgggccgggtaccggtaccggtaccggaccggtccgtacggacgtaccgtcgcggtacacggtc

SEQ ID NO: 228593 - DNA, 703 bp, Homo sapiens
  misc_feature: GYAE6OF02F9CLT.4.37.D04.1.454.CMB.1.raw
  modified_base (638)..(638): a, c, t, g, unknown or other
  misc_feature (638)..(638): n is a, c, g, or t
  modified_base (695)..(695): a, c, t, g, unknown or other
  misc_feature (695)..(695): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcgatccgccattcctcgtgacctacgtacggaaccagcaaggtcggtagtttgggtaggtttaactaactagtcgtctacctaggttactacaacgacgacctacccgaacggaccaaaaccgacccccctaaactaccgtaacttaaacgttttaagtacgtactcggtaccgtagggaacgggacggtacggtctaggttaatttacgttacgtacgtacgaccgtactacgtaaatacttaacgaacgtcgaacgtcaacgtaccgtacggggttcgggttaccgttaccgggtaacggtacgggaaccgtacggtaccgtacccggtccgtacccgacgtaccaaccggacccgaacgtacccaaccgtacgtctacgtaccgtccgttaccgtccccgtacccgtccttacccgtacgtacgttcnccgttacgtcgacggtccggtcggttacggaccggacggtacgacgtacggtatcgntcgctagc

SEQ ID NO: 228594 - DNA, 792 bp, Homo sapiens
  misc_feature: GYAE6OF02F3LZM.4.37.D04.1.454.CMB.1.raw
  modified_base (257)..(257): a, c, t, g, unknown or other
  misc_feature (257)..(257): n is a, c, g, or t
  modified_base (780)..(780): a, c, t, g, unknown or other
  misc_feature (780)..(780): n is a, c, g, or t
  modified_base (784)..(784): a, c, t, g, unknown or other
  misc_feature (784)..(784): n is a, c, g, or t
  modified_base (789)..(789): a, c, t, g, unknown or other
  misc_feature (789)..(789): n is a, c, g, or t
tcagagcactgtagcacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtcctcgtcggacctagtccgtatcgactccgacctacttcctcccgtcgaccgtactacggggaaacccngtacgtaggtacggtacgggtttaggttacggtttaaacttaaccttaagttcgttaccttccggttaggttaactaccgaaacgtacgacccgaaccccgtaaggaaccctaaaacccggacccccctaaaactaccgtaaactttaaattttagtacgtaacgttcggtacggttacggaaacgggtacggtaaccgggtacgttagttaaacgtttaccgttaacgtccgtaacgtacgttcctaaacgtaagtaactaaacgaacgacgtagaccgtacgacgtacggttcggggtacgtacggtaacgacggtaaccgtacgggtaccctaccggttcccggtaccctaaccggtacgaacccggacccgaacccggtaaccccaacccgttacgtacctaccgtaccgttaccgttaccccgttaccccacccttaccctacctacgtacggttccgtaccttcgggcgaccgggtcggtaaccggtaccgggagaaccgaggttccaacggttacngacngtacntac

SEQ ID NO: 228595 - DNA, 487 bp, Homo sapiens
  misc_feature: GYAE6OF01DRNXB.34.35.D02.1.454.CMB.1.raw
  modified_base (474)..(474): a, c, t, g, unknown or other
  misc_feature (474)..(474): n is a, c, g, or t
  modified_base (479)..(487): a, c, t, g, unknown or other
  misc_feature (479)..(487): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacgccccaaactcctcatctatagtaataatcagcggcctcaggggtccctgaccgattctctggctccaagtctggcacctcagcctccctggccatcagtgggctccggtctgaggatgaggctgactattactgtgcagcatgggatgacagcctgaatggctctatgtcttcgaactgggaccaggtcaccgtctaggtcagcccaaggccaacccactgtccactctcgttcccacctcctcatcacgtgtactgacgcggctggcaaggcnatcgnnnnnnnnn

SEQ ID NO: 228596 - DNA, 187 bp, Homo sapiens
  misc_feature: GYAE6OF01BIC0F.34.35.D02.1.454.CMB.1.raw
  modified_base (173)..(187): a, c, t, g, unknown or other
  misc_feature (173)..(187): n is a, c, g, or t
tcagtacacgtgatcacgaccggtgctcgatttagcacacgatagttgggtttgggggaaggaggaagactgacggtcccccaggagttcaggtgctgggcacagcggcctgggctgcctggtcaaggactacttccatcacgtgtactgagcgggctggcaaggcgcatagnnnnnnnnnnnnnnn

SEQ ID NO: 228597 - DNA, 494 bp, Homo sapiens
  misc_feature: GYAE6OF01BGML4.34.35.D02.1.454.CMB.1.raw
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (483)..(494): a, c, t, g, unknown or other
  misc_feature (483)..(494): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggccccaaactcctcatctatgctaacaccaatcggccctcaggggtcccctgaccgattctctggctccaagtctggcacctcagcctccctggccatcactgggctccgggctgaggatgaggctgattattactgtcagtcctttgactagcagcctgagtgcttatgtcttcggaactgggaccaaggtcaccgtctaggtcagcccaaggcccaacccatgtcactctcgttcccaccctcctcatcacgtgtactgagcgggntggcaggcncatagnnnnnnnnnnnn

SEQ ID NO: 228598 - DNA, 172 bp, Homo sapiens
  misc_feature: GYAE6OF01CI45K.34.35.D02.1.454.CMB.1.raw
  modified_base (172)..(172): a, c, t, g, unknown or other
  misc_feature (172)..(172): n is a, c, g, or t
tcagtacacgtgatcacgaccggtgctcgatttagcacacgatagttgggtttggggaagaggaagactgacggtcccccaggagttcaggtgctgggcacagcggccctgggctgcctggtcaaggactacttccatcacgtgtactgagcgggctggcaaggcgcatagn

SEQ ID NO: 228599 - DNA, 769 bp, Homo sapiens
  misc_feature: GYAE6OF01AOHIK.34.35.D02.1.454.CMB.1.raw
  modified_base (635)..(635): a, c, t, g, unknown or other
  misc_feature (635)..(635): n is a, c, g, or t
  modified_base (691)..(691): a, c, t, g, unknown or other
  misc_feature (691)..(691): n is a, c, g, or t
  modified_base (755)..(755): a, c, t, g, unknown or other
  misc_feature (755)..(755): n is a, c, g, or t
tcagtacacgtgatcacgaccggtgctcgatttagcacacgatagttgggtttggggggagaggagccccagccttgggattcccaagtgttttcattcagtgatcaggactagaacacagagactcacagtggtaggttggctgagtcgtggttacttttcgtgtcgtgtactttaaagtttaaaaggtcgtacgtaggtgtggtaggtgacgaggtcgttgggtaggtaggttcggggtaggggggttagggtttaacgggtaaaccggggggtccccggggggttacccttaacggttacccgttttccggtgggtaggaccgtccgttcggtaggtacttcgacgttcctacgtaacggtaaccgccgtaggagtgacgtcggtccggggtccccgacgacggtcctaccgggaaggggggacgggtcgtagggtacgggttggggttcggaccgttaaagtaaaacgaacctaaaacggtgtaggtggggtacggaacaacgacgtaacgtcgctcgacccgtaccggtaaggaaacggtcgaagtactacccgaccgtctaacgaaggagtagtacgtaacttaaacaaaaaccgcgtacgtagtactaacgtaaactaagtacgaaanacgactaataaacggaaaccgagaacacgacgtcgtagtattagttaggtaggtanaacgtagtcgttagttaccgtaccgtcggtacggacgtaccggtacctggaccgtacgtctccncgcgtccgtacccg

SEQ ID NO: 228600 - DNA, 578 bp, Homo sapiens
  misc_feature: GYAE6OF01E0WD5.34.35.D02.1.454.CMB.1.raw
  modified_base (431)..(431): a, c, t, g, unknown or other
  misc_feature (431)..(431): n is a, c, g, or t
  modified_base (505)..(505): a, c, t, g, unknown or other
  misc_feature (505)..(505): n is a, c, g, or t
  modified_base (568)..(568): a, c, t, g, unknown or other
  misc_feature (568)..(568): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggtttggtaaaggccgggggggtcccttagactttcctgtggagcctctggattcagtctcagtaacgcctggatgagctgggtccgcaggctccgaggggagggctggaggtgggtggccgtaattaaagcaaaactgatggtagggacaacagactacgctgcacccgtgaaaggcaagacttcaccgtctacaagagatgaattacaaaaacncgactagtatactaacaaatagaacagacaatacgaaaccgagaacacgagccgtagtattagttgtagggtanacgtagtagtgttacttacccgtacgtgggaccacgggaccctggtacctaccgtctacctcncgcctacccg

SEQ ID NO: 228601 - DNA, 498 bp, Homo sapiens
  misc_feature: GYAE6OF01CMRH0.34.35.D02.1.454.CMB.1.raw
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (480)..(480): a, c, t, g, unknown or other
  misc_feature (480)..(480): n is a, c, g, or t
  modified_base (488)..(498): a, c, t, g, unknown or other
  misc_feature (488)..(498): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatagtaataatctgcggccctcaggggtcccctgaccgattctctggctccaagtctggcacctcagcctccctggcccatcagtgggctccggtccgaggatgaggctgattatactgtgcagcatgggatgacngcctgagtggttggtgttcggnggagggccaagctgaccgtctaggtcagcccaaggcctgccccctggtcactctcgttccccacctcctcactcaccgtgtactgagccgggctggcaaggcncagtacgnnnnnnnnnnn

SEQ ID NO: 228602 - DNA, 537 bp, Homo sapiens
  misc_feature: GYAE6OF01CJADU.34.35.D02.1.454.CMB.1.raw
  modified_base (524)..(525): a, c, t, g, unknown or other
  misc_feature (524)..(525): n is a, c, g, or t
  modified_base (528)..(537): a, c, t, g, unknown or other
  misc_feature (528)..(537): n is a, c, g, or t
tcagtacacgtgatcacgaccggtgctcgatttagcacacgatagttgggtttgggggccgttcctgggcccagtctgtgctgactcagccaccctcagcgtctgggacccccgggcagaggtcaccatctcttgttctggaagcagctccaacatcggaagaaattatgtatattggcaccagcagttcccaggaacggcccccaaactcctcatctatagtaataatctgcggccctcaggggtccctgaccgattctctggctccaagtctggcacctcagcctccctggccatcagtgggctccggtccgaggatgaggctgattattactgtgcagcagtgggatgacagcctggagttgggttgggtgttcggcggagggaccaagcgtcggaccgtccgtaggtcacgcccgaaggctcgcccccgtcggtcctactcgttccgttccccgcccttccctcactccgacgtcgttacctggacggcgggtcgtgggcgacggcggtccgaagtcggnngcnnnnnnnnnn

SEQ ID NO: 228603 - DNA, 542 bp, Homo sapiens
  misc_feature: GYAE6OF01D23GR.34.35.D02.1.454.CMB.1.raw
  modified_base (319)..(319): a, c, t, g, unknown or other
  misc_feature (319)..(319): n is a, c, g, or t
  modified_base (380)..(380): a, c, t, g, unknown or other
  misc_feature (380)..(380): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (534)..(535): a, c, t, g, unknown or other
  misc_feature (534)..(535): n is a, c, g, or t
  modified_base (537)..(542): a, c, t, g, unknown or other
  misc_feature (537)..(542): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacgcccccaaactcctcatctatagtaataatctgcggccctcaggggtccctgaccgattctctggctccaagtctggcacctcacgcctccctggccatcagtgggctccggtccgaggntgaggctgattatactgtgcagcagtgggatgacagccgtgtaggtggttgggtgttcggnggtacgggaccaagcgtcgaccgtccgtaggtcagcccaaggcctcgccccctcggtccaccgtcgtcgttccccgccctccctcacttccacgtcgtacgtcggacggtccgggcgtacggcgaacgggccgacgtaacgtacggntgcncgnncnnnnnn

SEQ ID NO: 228604 - DNA, 511 bp, Homo sapiens
  misc_feature: GYAE6OF01CGAY8.34.35.D02.1.454.CMB.1.raw
  modified_base (438)..(438): a, c, t, g, unknown or other
  misc_feature (438)..(438): n is a, c, g, or t
  modified_base (485)..(485): a, c, t, g, unknown or other
  misc_feature (485)..(485): n is a, c, g, or t
  modified_base (501)..(511): a, c, t, g, unknown or other
  misc_feature (501)..(511): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaaactcctcatctatagtaataatctgcggccctcaggggtccctgaccgattctctggctccaagtctggcacctcagcctccctggccatcagtgggctccggtccgaggatgaggctgatttattactgtgcagcagtggggatgacagcctggagtgggttgggtgttcggcgggagggaccaagctgaccgtcgtaggtcagcccaaggcctcgccccctggtccncctcgtcgttccccgccctccctcactcacgtcgtactgagcgggcnggcaaggcgcagtagnnnnnnnnnnn

SEQ ID NO: 228605 - DNA, 617 bp, Homo sapiens
  misc_feature: GYAE6OF01CX3ZS.34.35.D02.1.454.CMB.1.raw
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctggggaggtttgggtaaaggccgggggggtcccttagactttccgtgtggagcctcgtggattcagtctcagtaacgcctggatgagcgtgggtccgcaggctcgaggggagggctggagtgggtgacgtataaagcaaactgatggtggacaanagactacgctgcaccgtagaaggcagcttcaccgtntacaaganaatgattacaaaaacncgactagtatactaanaatagaacagacaagtacgaaaaccgagaacacgagtaccgtagtattagttaggtagggtagtaacgtagttagttacggtttaacgttaaccccgtacggtaggggacccgtaacggggtaaccccgttaggtacccgtacccgttaccctaccctacgtccgtcccgtaaccccg

SEQ ID NO: 228606 - DNA, 633 bp, Homo sapiens
  misc_feature: GYAE6OF01EMFYV.34.35.D02.1.454.CMB.1.raw
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagcgtgagtttccttaggctgcttattttaaaggtgtcagtgtgaggtgcagctggtggagtcgtgggggaggtttggtaaaggccgggggggtcccttagacttttccgtgtggagcctctggatttcagtctcagtaacgcctggatgagctggggtccgccaggctccgagggaaggggctggaggtggggtggccgtataaaggcaaaactgatggtagggacaacgagactacgactgacacccgtagaaacggcaaggtattcaccgtctcaagagatagattacaaaacacgactagtactactaacaaatacgaacagacaagtagaaaccgaggacaacgaagccgtagttaattagttaggtaggggtagacgtaggttacggttaggttaacttacccggttacgtacggggacctacggggtaaccccttgggtaccctacccggttaccttaccctcgtccgtcccctaacccg

SEQ ID NO: 228607 - DNA, 527 bp, Homo sapiens
  misc_feature: GYAE6OF01CG8V8.34.35.D02.1.454.CMB.1.raw
  modified_base (517)..(527): a, c, t, g, unknown or other
  misc_feature (517)..(527): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatagtaataatctgcggccctcagggggtcccctgaccgattctctggctccaagtctggcacctcagcctcctggccatcagtgggcctccggtccgaggatgaggctgattattactgtgcagcagtgggatgacagctggagttgggttgggtgttcgggcggagggaccaagctcggaccgtcgtaggtcacgcccgaaggcctcgcccccgtcggtccaccgtccttccgttccccacccttccctctactcctacgtcgtacgtgacggcgggctggcgaggccgacagtgnnnnnnnnnnn

SEQ ID NO: 228608 - DNA, 508 bp, Homo sapiens
  misc_feature: GYAE6OF01AYOTG.34.35.D02.1.454.CMB.1.raw
  modified_base (448)..(448): a, c, t, g, unknown or other
  misc_feature (448)..(448): n is a, c, g, or t
  modified_base (491)..(491): a, c, t, g, unknown or other
  misc_feature (491)..(491): n is a, c, g, or t
  modified_base (496)..(508): a, c, t, g, unknown or other
  misc_feature (496)..(508): n is a, c, g, or t
tcagtacacgtgatcacgaccggtgctcgatttagcacacgatagttgggtttgggggccgttcctgggcccagtctgtgctgactcagccaccctcagcgtctgggacccccgggcagaggggtcacccatctcttgttctggaagcagctccaacatcggaagaaattatgtatattggcaccagcagttcccaggacggcccccaaactcctcatctatagtaataatctgcggccctcagggggtcccctgacccgattctctggctccaagtctggcacctcagcctccctggccatcagtgggctccggtccgaggatgaggctgatttatactgtgcagcagtgggatgacagcctgagtgggttggtgttcggcggagggaccaagctgaccgtccgtaggtcagcccaaggcctcgcccctcggtcactctcgttcccnccctcctctactcacgtgtactgagcgggctggcaggcgacgngtggnnnnnnnnnnnnn

SEQ ID NO: 228609 - DNA, 695 bp, Homo sapiens
  misc_feature: GYAE6OF01AP1AZ.34.35.D02.1.454.CMB.1.raw
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttgggctgagctggattttccttgctgctattttaaagtgtcagtgtgaggtgcagcgtggtggagtcgtgggggtaggtttgggtaaaggccggggggtccttaggactttccgtggtggagtcctcgtggtattcagtctcagtaacgcctggatgagcgtcgggtcccgcgacggcctaccggaggggaacggggcgtacggggtagggttcggggttcgggtaccgttaaagttaaaaacggaccgtaaaaacgttggaagtcggggtagggaactaaacgacggaaccgtaaccggactcgaccgtaacccggtaggaaaacggtcgaacgtacttaccgaccgtcctaacgaagacgtaatacgtaactaaacaaaaacgcgtactagtaactactaaacaactacgaaacagactaagacgaaaaccgagaaccaacgacggacttaagtattagtaggtgggagtagtaaggttacgtaggttaccttacccgagggtccgggtacgtaaccgggtaccctggtacccaccgttcgtaccccg

SEQ ID NO: 228610 - DNA, 647 bp, Homo sapiens
  misc_feature: GYAE6OF01ELQKE.34.35.D02.1.454.CMB.1.raw
  modified_base (192)..(192): a, c, t, g, unknown or other
  misc_feature (192)..(192): n is a, c, g, or t
  modified_base (354)..(354): a, c, t, g, unknown or other
  misc_feature (354)..(354): n is a, c, g, or t
tcagtacacgtgatcacgaccggtgctcgattttagcacacgatagttgggtttggggggccgttcctgggcccagttctgtgctgactcagccgacccctcagcgtctgggacccccgggcagagggtcaccgattcgtcttgttctggaagtcagctccaaactagtcggaagaaattatgtatattggnaccagcgtagtttcccgaggaaccggccccaaacgtcccgtcatctactagtaataactctcgcggccctacgacgggttccctgaccgatttctcgtgctaccaagtcgtcggacacctcacgccgtcctcggccatcgtagtcggcgtccggtcgacggntggaggtctgtattagttacgtgtcgcagcgagtgggatgacagccgtagtacggttgggttacgggtcgttacgggacggtacgggaaccgtaagtccggtacgtaccgtacgttacggtacacgtaccgaaggtccgtaccgtccccgtcggtacctaccgtcgtttccgttcccctacctttccctactaccgtacgtacgttacgttacgtggtaccggtaccgggtcgttcgggaccgtaacggtccggtacgtacgtacgcgtgctagctcgtatcacgctgacgtc

SEQ ID NO: 228611 - DNA, 947 bp, Homo sapiens
  misc_feature: GYAE6OF01DBR7Z.34.35.D02.1.454.CMB.1.raw
tcagtacacgtgatcacgaccggtgctcgatttagcacacgatagttgggtttggggagctctgggagaggacgccccagccttgggacttcccaagtgttttcattcagtgatcaggactgaacacagaggactcaccatggagttgggctgagctggtattttccttgctgtacttaagttttaaaaggtgtccagtgtgaggtgcagcgtgggtggagtcggtgggggtaggtttagggtaaacgggtcccgggggggttaccttacgtaccgttttccggtggtcggtacgtcccgtgtggtacttcgtagtcctacgtaacgtaaccggtccttagggattcggacgtccggtcggggtccccgtaccggacggggtacccgttaccgggaacgggggtaacgggggtccggttagggggtaagggtttcgggggttacgggtaaccggtttaaaaagttaaaaacggaacgtaaaaaacggtcggtaaaggttcggggtaacgggtaaacaaaacggtacgaaaccgttacgaccgtacgacccgtaacccgggtagaaacgggacgtaagtaaccgttacccgaacccgttacgtaccgaaagaacgtaagttaacggtaaacttaaaaccaaaaacgtacggtaacttaacgttaacgtaactaaaaccgtaaagtaacgaaaaccgtaacgtaaacctaaggtaaaccggaaaaacccgggacggaaaacccgtaaccggtaacggtacccggtttaaaggttaatttaacgggtttaacgggtaaggggttacgtaaacggttaaaggggtttacggtttaaacgggtttaacccctttaacccgggttaacccggggtacgggttaaaccccgggtaaacccggggttaaccccggttaccgggtacccccggttaaccccgtcccgttaaccccg

SEQ ID NO: 228612 - DNA, 885 bp, Homo sapiens
  misc_feature: GYAE6OF01BUBB6.34.35.D02.1.454.CMB.1.raw
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttgggctgagctggattttcctgctgctatttaaaaggtgtccagtgtgaggtgcagcgtgggtggagtcgtgggggtagggtttgggtaaaggccggggggtccttaggtactttccgtggtggagcctcgtggattcaggtctcaggtaacgcctggatcggagcgtcgggtccgccgaggctaccggaggggagggcgtagggaggttggggttcggaccgttaagtaaaacggcgtaaaaacgtggtaagtagggtacgggaacaaacgacgtaaccgtacggacgttcgaccgtaaccccggtaggaaaacgggcctaaggtaacgtttacccgaacccggttaccttaaccggaaacggtaacggtaacgttacgggtaaaacctttaaaaaccgaaaaaaaccgtaaccggtaaccgttaacggttaaacttaaaccgtaaaccgtaaaattaacggaaactaacggaacctaaacggttaaacgggaaaaaccccggaagggtaaacccaacccggtaaaggtacccggttaacggtttaaagtttaaggtttaaccggggttaagggggttaactaaacccgggttaaggtttaaacgggttaccgggttttaaaaccctttaccccccggttaaacggggttacccggggggtaaccccggttaaacccgggggttaaacccccgtttaccggggtaaccccttaaaccccgggttcccgttaacccccgg

SEQ ID NO: 228613 - DNA, 617 bp, Homo sapiens
  misc_feature: GYAE6OF01AQ1ZL.34.35.D02.1.454.CMB.1.raw
  modified_base (416)..(416): a, c, t, g, unknown or other
  misc_feature (416)..(416): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctggggaggtttggtaaagccgggggggtccttaggactttcctgtggagcctcgtggattcagtctcagtaacgcctggatgagctggtccgcaggctccgaggagggctggagtggtggccgtataaagcaaaactgatggtggacaacgagactacgctgcaccgtgaaggcagactcaccgtcacaagagatagataacaaaacncgtactagtaactactaactaactagtaaacacgactaacgtaacgaaaaccgaacgaacaacgaacggtacgtagttaacgttagttaggtagggtagacgtaggtacgttacggttacttacccgtacgtacggggtaccgaaccgggtaacccgttacggtaccgtacccgtcgtccctacgtccgtcctaaccccgg

SEQ ID NO: 228614 - DNA, 549 bp, Homo sapiens
  misc_feature: GYAE6OF01CQ6JG.34.35.D02.1.454.CMB.1.raw
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (539)..(549): a, c, t, g, unknown or other
  misc_feature (539)..(549): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagtaatactgtaaactggttcagcaactcccaggaaccggccccaaactcctcatccatagtaataatcagccggccctcgacggggtccctgaccgtattctcgtggctccaagtctggccacctcacgccctccctggccatcacgtcggcctccgaggcgtgaggacgtggaggtctgtatttacgttactgtactacgttcctttagacagcgacgtccgtgagtgtctttagtcgttcgtacggacgtcgggacctaacggtccaccgtcgtacggtcacgacccacggcccaacccgntctcctacgtctccgttccccnccctcctcactccncgtcgtacgtgacgtcggcgtggacgaggcanagngcnnnnnnnnnnn

SEQ ID NO: 228615 - DNA, 852 bp, Homo sapiens
  misc_feature: GYAE6OF01AEVGE.34.35.D02.1.454.CMB.1.raw
tcagtacacgtgatcacgaccggtgctcgatttagcacacgatagttgggtttgggggggtaggaggagccccagccttggattcccaagtgttttctattcagtgatcaggactgaacacagaggactcaccatggagtttggctgagctggattttccttgtctgttagtttaaaggtgtctaatgtgaggtgcagcgtgttggagttcgtgggggacgacgttcgtacgacggtccggggggtccctggacgacctctccgtagtaaacgcccgtacgtcggtacttcctaccgtttcgaccctaactatcggccgttcgtcccgtcggtccgccgacggccgtacgacggggaacgccgggtcgtgggtaacggttcggggtccctttgacggtccgttaagtttacggtagggtaaagtacgttacgggttaacggtaccccgtaaaacccggttaccttaaacccgtaacgtaacccgtacggtaaacccgtcccgggtaaggtaacccgggggtaccccgtttaccccgaaaccgtaccgttccccgtaaccgaacgggtaacctaacgtaaacccgtttaacccggaacggaacgtaccgtaaaccggtacgttaacggttaaccgtccgttaccgggacgtaacccgtaacgaactccggtacccgtaagcccgggtaacggaccggaacgggacccgtaccgggttaccttaacgttaagttccgtacgtcggtaccgacccgtaaaccgccgtaaccggttccgtaggtcccgttacctttaaccgttaccgttaacggtacgtaacgggtttccggggacgggttaacggttttacccgg

SEQ ID NO: 228616 - DNA, 712 bp, Homo sapiens
  misc_feature: GYAE6OF01BGTGC.34.35.D02.1.454.CMB.1.raw
tcagtacacgtgatcacgaccggtgctcgatttagcacacgatagttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtggggaggtttggtaaaggccggggggtccttaggactttccgtggtggagcctcgtggattcagtctcagtaacgcctggatgagcgtgggtccgccgaggccgtccgaggggagggctgggaggtgggtggccgtaagttaaagacaaaactgagtggtaggaacaacgagtactacgcgtacgacgacccgtaggaaacgctaaggacttaccgaccgtctacaagtacgagtacgtaacttaaccaaaaacgcgtacttaacgtaataacctaaacaactacgaaacaacgtacaagtaacggaaacccgtagaaccaacgtacgaccgttagttaagttaagttacgggtagggtacgtaacgttaggtacggtttacggtttaaccgtttaaccccggtaacgggttacggggaacccggtaccgggtaaaccccgttacgggtacccgtaacccggtttccctacccgttaccgtaaccgtcccccgtaacccccgg

SEQ ID NO: 228617 - DNA, 182 bp, Homo sapiens
  misc_feature: GYAE6OF01DY8M5.34.35.D02.1.454.CMB.1.raw
  modified_base (174)..(182): a, c, t, g, unknown or other
  misc_feature (174)..(182): n is a, c, g, or t
tcagtacacgtgatcacgaccggtgctcgatttagcacacgatagttgggtttgggggaagaggaagactgacggtcccccaggagttcaggtgctgggcacagccggccctgggctgcctggtcaaggactacttccatcacgtgtactgagcggctggcaagggcgcatagnnnnnnnnn

SEQ ID NO: 228618 - DNA, 653 bp, Homo sapiens
  misc_feature: GYAE6OF01AXPSL.34.35.D02.1.454.CMB.1.raw
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtttgggtaaaggccgggggggtcccttagactttcctggtggagcctctggattcagtctcagtaacgcctggatgagcgtgggtcccgccgaggctcccgaggggaaggggctggggaggtgggttggccggttaattaaaaggcaaaaacgtgatggggtaggacaacgagactacgctgcacccgtgaaaggcagattcaccgtctacaaganatgaattacgaaaaacncgactagtatactaacaaatgaacagacaagtacgaaaaccgaggaaccaacaacggtaccgttagttaacttaagttgggtaaggggttggaacgtaggttaggttagggtttaacgttacccccgttaacggtaccggggtacccgtaaacgggggtaacccctaggggtaccctacccggttccgttaccccg

SEQ ID NO: 228619 - DNA, 547 bp, Homo sapiens
  misc_feature: GYAE6OF01ERYFT.34.35.D02.1.454.CMB.1.raw
  modified_base (368)..(368): a, c, t, g, unknown or other
  misc_feature (368)..(368): n is a, c, g, or t
  modified_base (454)..(454): a, c, t, g, unknown or other
  misc_feature (454)..(454): n is a, c, g, or t
  modified_base (471)..(471): a, c, t, g, unknown or other
  misc_feature (471)..(471): n is a, c, g, or t
  modified_base (533)..(535): a, c, t, g, unknown or other
  misc_feature (533)..(535): n is a, c, g, or t
  modified_base (542)..(547): a, c, t, g, unknown or other
  misc_feature (542)..(547): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaatactgtaaactggtttcagcaactcccaggaacgccccaaactcctcatccatagtaataatcagccggccctcacggggtccctgaccgattctcgtggtcctccaagtctggccacctcacgcctccctggccatcaggtcgggccttccggtctgaggtatggaggctgacttagttactgtgcagcagtgggatgacncgctgatcggctctatgtcgtgaacgtgggacctaggtccaccgtcgtacggtcacgacccgaacgaccccaacccgctcgtaccnccttcctccgttccccnccctccgtcactccgtaccgtcgtactggacggccgggtgacggcgacggccgacgagtagnnnagcgtcnnnnnn

SEQ ID NO: 228620 - DNA, 681 bp, Homo sapiens
  misc_feature: GYAE6OF01BZAOP.34.35.D02.1.454.CMB.1.raw
  modified_base (392)..(392): a, c, t, g, unknown or other
  misc_feature (392)..(392): n is a, c, g, or t
  modified_base (664)..(664): a, c, t, g, unknown or other
  misc_feature (664)..(664): n is a, c, g, or t
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
tcagtacacgtgatcacgaccggtgctcgatttagcacacgatagttgggtttgggggccgttcctgggcccagtctgtgctgactcagccacccctcagcgtctcgggacccccgggcagagggtcaccatctcttgttctggaagcagctccaacatcggaagaaattatgtatattggcaccagcagttcccaggaaccgcccccaaactcctcatctatagtaataatctcgccggccctcgacggggtcccctgaccgtatttcctctggcctccgaagtcgtcggccacctcaccgccctcccgtgccatcgaggtcgggcctccggtaccgaggatggaggtcctagtatttagtttaccgtgtacgcagctaggtgggatgacncgtccgtggagttcgtcgtttagtcggttacgttaccgggaacgttacggggaacccgtaacggtaccctaccggttcgtaacggtacccgaaccggaccccgaaccggaccccctaacccccgtcttaccgtacctacccgtttccgttaccccgtttaccccccacccttcccgtaactaccgttcccgtaccggttacgtacccgtcggaaccgggtccgggtccggtacggaccggaaacggggccgttaacgacgttaggctcgacncgatacctgancgtngn

SEQ ID NO: 228621 - DNA, 713 bp, Homo sapiens
  misc_feature: GYAE6OF01C6ZCC.34.35.D02.1.454.CMB.1.raw
  modified_base (202)..(202): a, c, t, g, unknown or other
  misc_feature (202)..(202): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
  modified_base (567)..(567): a, c, t, g, unknown or other
  misc_feature (567)..(567): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttggctgagctggattttccttgctgcttattttaaaaggtgtccagtgtgaggtgcagctggnggagtcgtgggggtaggtttagggtaaacggcccgggggggtcccttaggtaccttttccgtggtggcgcccgttcgtggtactttcgagttcctcgaacgtaaccgccttggatgaacgcgtcggggtccgaccgaggcctaccggagggggtaacggggctaggggacggtgggggttcggaccgttaagttaaaagacctaaaaacgtggaagtgggtacgggaacaacgtaagactaacgctagccaccgtaagaacggcagactcgaccgtntacaagngaatagtataaacaaaaacgcgtacgtacgtacttaaacgtaaccaaatagaaacgtaacgacaacgtaaggaaaacccgnggacaacgacggtacgttagtagttacgttaggtaacgggtgacgttaggtaagttacggttaccttacccgcggttcgggaacccgaacggggtaacccttcgggaccttacccggtactcccgtaccaccgtcccctaacccgg

SEQ ID NO: 228622 - DNA, 758 bp, Homo sapiens
  misc_feature: GYAE6OF01CU43Q.34.35.D02.1.454.CMB.1.raw
  modified_base (741)..(741): a, c, t, g, unknown or other
  misc_feature (741)..(741): n is a, c, g, or t
  modified_base (752)..(752): a, c, t, g, unknown or other
  misc_feature (752)..(752): n is a, c, g, or t
  modified_base (754)..(755): a, c, t, g, unknown or other
  misc_feature (754)..(755): n is a, c, g, or t
tcagtacacgtgatcacgaccggtgctcgatttagcacacgatagttgggtttgggggccgttcctgggcccagtctgtgctgactcagccaccctcagcgtcgtcgggacccccgggcagagggtcaccatctcttgttctggaagcacgctccaacatacggaaagaaattatgtatattggcaccagcacgtcccaggacccgaccccaaactcctcactactaataagtaataactcgtcgccgtaccgtcgtacgggtccctcgaccgtacttctcgtcggactaccgtaacgtcgtcggcctacctacgaccgtccctcccgtcggacctacgtaccgtacgggtccgggtccgttcccgggtaccggaacggtacgtacggtacggtaccgttagttaacgtttaacgttacgtcggtacgacgagtacgtaggtacgggtactacggaaccgtacgtacgtagggtagggtttggggtcggggttagggtccggggacgggtacggaacgacgtcggtacgtacccggtacgtacggtacgacccgaccggtaggtcccgtccccgtcccgggtacgtacccgttaccgtcccgttacccgttcccccgtacccttaccgtaacctaacccgtttaccgaccggttttaaccggtaccgggtacggtcccgggtacggggtaccttaacgggggaacccgtaggggaccctagggttaagtccggagcgaacngtcagacgcancnngac

SEQ ID NO: 228623 - DNA, 646 bp, Homo sapiens
  misc_feature: GYAE6OF01A5N6M.34.35.D02.1.454.CMB.1.raw
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtggggaggttggtaaggccggggggtccttagactttcgtgtggagcctcgtggtattcgagtctcgagtaacgcctggatgagcgtggtccgcaggctccgagggacgggctgggaggtgggttcggaccgttaagtaaacgacgtaaaacgtgaagtgggtaggaaccaacgacgaactacgcgtacgaccgtaacccggagaaacggtcaacgtacttccgaaccgttctacgaagagtaacgtagaacttaacaaaaactcgactagtactactaacaatagaacagacaagtaacgaacgacgacacgacgcgtagtaattcgttaggtggtagtacgtagtacgtcgttacgttcccgtacggtcgggaaccgtaccgggtaacccgtcggtacccgtaccggtccctaccgtccgagtcccgtaccccg

SEQ ID NO: 228624 - DNA, 699 bp, Homo sapiens
  misc_feature: GYAE6OF01BN07G.34.35.D02.1.454.CMB.1.raw
  modified_base (309)..(309): a, c, t, g, unknown or other
  misc_feature (309)..(309): n is a, c, g, or t
tcagtacacgtgatcacgaccggtgctcgatttagcacacgatagttgggtttggggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtttggtaaaggccgggggggtcccttaggacttttccgtggtggagcctcgtggattcagtctcagtaacgcctggatgagctggccgcnggctccgaggggacgggctgggaggtgggttggaccgtaagttaaaacgactaaaacgtggagtgggtagggaacaacgagaactacgctagaccgacccggtagaaacgggcaagtacttacgaaccgtctaacgaagtagtaatagtaattaaacaaaaacgtaccgtactaagttaactaactaaacctaaatagaaaccagacaagtaacgaaaaccggaacggaacaacgaacgtaccgtagttaacttagtttagggttagggtacgtaagtaggttaggttacggtttaaccgttaacccgtaccggtacggggaccggtaaccggggtaacccgttcggtaccccgtaccgttacctacccgtctcccggacccgtaccccg

SEQ ID NO: 228625 - DNA, 571 bp, Homo sapiens
  misc_feature: GYAE6OF01DB1PD.34.35.D02.1.454.CMB.1.raw
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (560)..(560): a, c, t, g, unknown or other
  misc_feature (560)..(560): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccagtggagtttgggctgagcgtgtagtttcctagcgtacgtacgttaagttaagngtcagtgngagtncgagntggtgtgtggtggggtagttaggtaacggtccggggtcttacgtcgtttcgnggtggctcgtgtagattcagtctatagacgcgtgatgngtcgtcgcgacgcgcgtacggagggacggngtggtcgtggtagtacgtaagtaaanactaaagngtagcgagacaagngtactgagtcacgtcganacgngaatcacacgtcagtagagtnanaataacgaactgactataccganacgtanaccganacgtanaacgtaacgacgactagacgtacggtctagtacgtagttaggcgttagacgtttagcgttaacgtcgtaacgtcgagtacgacgtccgctacgtcctacgacncctgctaccgg

SEQ ID NO: 228626 - DNA, 873 bp, Homo sapiens
  misc_feature: GYAE6OF01CKL6N.34.35.D02.1.454.CMB.1.raw
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (419)..(419): a, c, t, g, unknown or other
  misc_feature (419)..(419): n is a, c, g, or t
tcagtacacgtgatcacgaccggtgctcgatttagcacacgatagttgggtttggggggagaggagcccacgccttcgggattcccaacgtgttttctattcagtgatcaggactgaacacagaggactcaccatggagttgggctgagctggattttccttgctgcttattttaaaagtggtccagtgtgacggtgcagtctgggtggagtcgtggggagggtttggtaaaggccgggggtccgttacgactttcctgtgagctcttggnttcngtctcatagcctggatgagcngggtccgcaggcctcgacgggaaggggggccttgggacgtagggtttgggacccttagtttaaaacggctaaaacctagggatgggttaagggggaccaaacctacggaacccttacgggtcncggtacccgccccgttaacggaaaagggcgtaaacgattttaccggaacccccgtttccacgtaaggttaacggaacttacggtaaacgttaaccttaaaaaccggaacccgaaccctttgggtaaaccttaccttaaacgtaaacgttaaccggaaacttagggaacccaaaggttaacgtaaaaccccggaacgggggaaacccaacggaacgttacccggggttaacgtttaacggttttcggtttagggtttaaaggggggttacggttaacggtacccgggttaaggttcggggttttaaacctttacccccgggggtttaacccctaacccggggggggttacccccggttaacgggggaaaccccccgggtttcggtaccccgggttaccccttaacccccggggtttcccctaccgggttaacccgacccccgggtttaacccccg

SEQ ID NO: 228627 - DNA, 1000 bp, Homo sapiens
  misc_feature: GYAE6OF01CQOBH.34.35.D02.1.454.CMB.1.raw
  modified_base (180)..(180): a, c, t, g, unknown or other
  misc_feature (180)..(180): n is a, c, g, or t
tcagtacacgtgatcacgaccggtgctcgatttagcacacgatagttgggtttggggggggagaggagccccagccttgggattccccaagtgttttcattcagtgatcaggactgaacacagaggactcaccatggagtttggctgagctggtattttcctgctgcttatttaaaggtntcagtgtggaggtgcagctgggtggagtcggtggggggtagggtttagggtaaacgggtccgggggggttacccttagaccttttccgtggtggagccttcgtggtattacgagttcctacgtaacgtaaccggacctgggtaacgttggaggtcccgggttcggggtaccccgaccgacgggccgttacccggaagggggggaacggggtccgtagggggtacgggtttagggggtttacggggtaacccggttttaaaagttaaaaaacgggtaccctaaaaacggtttaggtaagggttaacggggggttaacggaaaacccgtaaacgtaaccggaaccggttaaaccggtccggtaacgtaaccccgtaacccgggtaaacgggaaaacgggtaccgaaacggttacgtttaccccgaaacccggttccttaaacccgggaaaggaaccggttaacgttaaacgtaaaacgtttaaaaccccggtaaaaaaaaccgtaccggtaccgtttaaacgtaaccttaaacgttaaaccgtaaacgttaaaccgaaacgtaacgaaacgtaaccggtaaaccggaaaaacccgggtaaccggaaccgtaaaccgaccgggttacgttaacgtttaacggtttaagttacggggttaacgggttaggtaaaccgggttacggttaagggttaccggttttaaccggttacccccggttaccggggttacggggtaccccgggtaaaccgggttaccccgttaaccggggttccctaaccggttcccgttacccgacgttaccccgcccccgtaaaccccgg

SEQ ID NO: 228628 - DNA, 686 bp, Homo sapiens
  misc_feature: GYAE6OF01DXMR9.34.35.D02.1.454.CMB.1.raw
  modified_base (120)..(120): a, c, t, g, unknown or other
  misc_feature (120)..(120): n is a, c, g, or t
  modified_base (144)..(144): a, c, t, g, unknown or other
  misc_feature (144)..(144): n is a, c, g, or t
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (430)..(430): a, c, t, g, unknown or other
  misc_feature (430)..(430): n is a, c, g, or t
  modified_base (675)..(684): a, c, t, g, unknown or other
  misc_feature (675)..(684): n is a, c, g, or t
  modified_base (686)..(686): a, c, t, g, unknown or other
  misc_feature (686)..(686): n is a, c, g, or t
tcagtacacgtgatcacgaccggtgctcgatttagcacacgatagttgggtttgggggccgttcctgggcccagtctgtgctgactcagcccaccctcagcgtcgtcgggacccccgggnaggaggtcaccatctcttgttcgnggaagcagcctaccaacngtacggaaagtaaattntgtattagtcggcaaccagctacggtccccgaaggaacccgcccctaaactcctcgatctaataataatactcgtcgccgccctggaccgggtccctagaccgtcttccgtcgtcggtcctaccgtaagttcgtccggacctaccgtcgaccggtccctccgtcggacctacgtcggtcgggtccgggtcccgttaccgggacgtaggtacgtcggacggtccgtaagtttattacgttaccgtgtaccgngacgcgtaggttggactacgacgtacggtccgtgggttacggggttgggttcgggtcgggtacggacgggtacggacgtacggtacgtaccggtacgtcgggttaccggcccggtaaccgcggtcccgtcccggtacccgtcgggtacctacccggtccccttcccgtccccctaccgtcctctaccgtcgtaccgttcggcgtcggacggtcgacgacggtacgacgtcgacgagtgccgagcnnnnnnnnnngn

SEQ ID NO: 228629 - DNA, 848 bp, Homo sapiens
  misc_feature: GYAE6OF01CZ822.34.35.D02.1.454.CMB.1.raw
  modified_base (719)..(719): a, c, t, g, unknown or other
  misc_feature (719)..(719): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggtagtttggctgagctggtacttttccttgcctgtacttaagttttaaacggtcgtaccgtagttgtggtaggtcgacgtacggtcttggggtcggtacggttacgggttggggggtacgggttttaaggggttaaaccggggtcccgggggggttacccctttaacggttcccttttcccgtgggttacggtacgtcccgttcgtggtacttcgtacgtctacgagtaccgccgtggatcggacgtcgtcgggtaccgccgaggtcctacgggaggggtacgggtcgtagggtacggttcgggtacggtaccgttaaagtaaacgaccgtaaaacgttggaacggtcgggtaacggaactaaacgtacggtacgttaacgcgtacccgaacgtacccggtaaggaaacggtcgtaacgttcttaccgaccgttaacgaccgaaggtacgtaacttacgaaaccttaaacgaaaccgtcgtacttacgtaacttaacgtaacactaacgtaacgaacgtacgaacggtaaaccaaccgggaacgttacgaacgttacgtacgttaagttacgttaggtaacggtntacggacttacggtaagttaccgtagtttaaccccgtaaccgttacccggttacgggtaccgggtacccgggttaaccccgtacgttacccggttacccggtaaccttcccgtaacccgcgtacccccg

SEQ ID NO: 228630 - DNA, 784 bp, Homo sapiens
  misc_feature: GYAE6OF01B3JPF.34.35.D02.1.454.CMB.1.raw
  modified_base (749)..(749): a, c, t, g, unknown or other
  misc_feature (749)..(749): n is a, c, g, or t
  modified_base (758)..(758): a, c, t, g, unknown or other
  misc_feature (758)..(758): n is a, c, g, or t
  modified_base (764)..(764): a, c, t, g, unknown or other
  misc_feature (764)..(764): n is a, c, g, or t
  modified_base (772)..(772): a, c, t, g, unknown or other
  misc_feature (772)..(772): n is a, c, g, or t
  modified_base (774)..(774): a, c, t, g, unknown or other
  misc_feature (774)..(774): n is a, c, g, or t
  modified_base (778)..(780): a, c, t, g, unknown or other
  misc_feature (778)..(780): n is a, c, g, or t
  modified_base (782)..(784): a, c, t, g, unknown or other
  misc_feature (782)..(784): n is a, c, g, or t
tcagtacacgtgatcacgaccggtgctcgatttagcacacgatagttgggtttgggggccgttcctgggcccagtctgtgctgactcagccaccctcagcgtctcgggaccccgggcaggaggtcaccagtctcttgttctggaagcagcctaccaacagtacggaaagtaaattatgttatagttggaccaccgtagcctacgttcccgaacggaacccgaccccaaactcctcatacctaagtagtaataactcgtcgccggtccctacggaccggggtcccctagaccgttacttccgtcgtacggtcctaccgtacgttccgccggaccctacctacctaccgtccccgttcctaccggacccttacggtacggtaccggttccggggcccgttacccgggtccggaacggtagtacggtacggtcgtaactttagttaaccgtttcgttacggcgaccgtaggtaccgtaggttacgggtactaaccggacggtaacgtcggttaggtagggtttcggggttcgggtacgggtaccggggacggtacgggaacgtaggcccggttcgtaaaccccggttcgacggtaccgaacccgggtacccggtaccggtcccttccccggaacccgggttccctacccgttaccctcccgggttcccccgtacccccgtcccttagacccttacgtcccgttaacgggttcgacccgggttcggaacgggccggtacggtcggaccggacnccgtaaagntcccgngtagcaancncgcnnncnnn

SEQ ID NO: 228631 - DNA, 759 bp, Homo sapiens
  misc_feature: GYAE6OF01AWZP1.34.35.D02.1.454.CMB.1.raw
  modified_base (300)..(300): a, c, t, g, unknown or other
  misc_feature (300)..(300): n is a, c, g, or t
  modified_base (748)..(748): a, c, t, g, unknown or other
  misc_feature (748)..(748): n is a, c, g, or t
  modified_base (750)..(752): a, c, t, g, unknown or other
  misc_feature (750)..(752): n is a, c, g, or t
  modified_base (754)..(756): a, c, t, g, unknown or other
  misc_feature (754)..(756): n is a, c, g, or t
  modified_base (758)..(759): a, c, t, g, unknown or other
  misc_feature (758)..(759): n is a, c, g, or t
tcagtacacgtgatcacgaccggtgctcgatttagcacacgatagttgggtttgggggccgttcctgggcccagtctgtgctgactcagccaccctcagcgtcgtcgggacccccgggcagagggtcaccatctcttgttctggaagcagctccaacatacggaaagtaaattatgtatagttggcaccagcacgttcccaggaaccgaccccaaactcctcatctatagtaataatctcgccgccctcgacggggtccctagaccgtattctctggcctccaacgtctcggccacctcncgccctcccgtggcctactcgacggtcgggaccgttccggtcgtaggaggtagtacggcggtacttacgtacgtttaagttaccgttggtacgaccgtacggacgtaggttacgggaacgttacggaaccgtaccggtaccgttagaaacggtttccggtaccgtttaccgtttagttacccgggttcgtttaaccgggggtaaccgggttaacccgggtaaaccggtaaccggttacccggtacccgttacccggttaccgggaaccttaacccggaaccccggtaacccggaacccccgtaaaccctaccgggtacccttaccgtaaccccgtttccgttcccgtttaacccccttaccctaccctaccgttacctaccggttacgttacgttacgacggtaccggcggtccggtacggtaccgaacgggtcccaagtacgtacgngnnncnnngnn

SEQ ID NO: 228632 - DNA, 818 bp, Homo sapiens
  misc_feature: GYAE6OF01AY9VT.34.35.D02.1.454.CMB.1.raw
  modified_base (706)..(706): a, c, t, g, unknown or other
  misc_feature (706)..(706): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggtatttttccttgcttgtacttaagttttaaaaaggtgtccgagtgtgaggtgcagtcgtagggtggtagtcggtgggggtaggtttagggtaaacgggccggggggttacccttagtaccgtttccgtggtcggacgtcctcgtggtcttcgagttcctcgaggtaaccgtccgtaggagtggacgtcggtccgggtacccgaccgtcggccgtaccggaagggggacggggtccggtagggtaggggttggggttacgggtaaccgttaaaggttaaaacggacctaaaagtcggtaaggtagggtaacgggaaccaaaggtaacggaactaccggtccgttacggacccgtaacccggtaaggaaaccggcggtaacgtacgtacccgaccgttactaacgaacgtacgtaagtacgtaaacctaaccaaaagtccgaagttacgttaactaaccttaaacgaaagtacgaaacaacgacaacgtaaacggtaaaccgaagaacccgaacgtacggtaccgttaagttacgtttaaggtgggttaacgggtnaacggttagttacggttaccgttaacccgtaccgtacgggtacggaccggttaaccgggaccttacgggtccctacggttaccctaccgtaccgtacccgcccgtaacccgg

SEQ ID NO: 228633 - DNA, 812 bp, Homo sapiens
  misc_feature: GYAE6OF01DE40J.34.35.D02.1.454.CMB.1.raw
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
  modified_base (480)..(480): a, c, t, g, unknown or other
  misc_feature (480)..(480): n is a, c, g, or t
  modified_base (614)..(614): a, c, t, g, unknown or other
  misc_feature (614)..(614): n is a, c, g, or t
  modified_base (785)..(785): a, c, t, g, unknown or other
  misc_feature (785)..(785): n is a, c, g, or t
tcagtacacgtgatcacgaccggtgctcgatttagcacacgataggttgggttgggggggagaggagcccagccttggattcccaagtgtttcattcagtgatcaggactagaacacagaggactacaccagtggagtttggctgagcgtgtactttccgtgtctgacttaagtttaaaggtcgtaccaggttgtgaggtcgcgagtcgtgggtggtacggtcggtgggggtacggtttagggtaaccggggtcccgggggggttacctaagttaccgtttccgtagtcggtacgtcccgtggttaggtactctaggtcctacgtagtaccgtcgtggactcgacgtcgtcgggtccncgtacggctaccggaggggacgggtctaggggtacggttgggtaacgacggttaagtaaacgacgtaaagnggaggtagtacggaactanacggacttacgctaccgacgaacgtaagacgngtacgttactaccgttaccgtaccgaagagtaccgtaagttacaaacggttaaacaaaaccggaccttgttaagtaaaccctaacgtaaagtaacgtaacgaacgtaaacgaacgttaacgaaccccgggaaanaccgggtaactaccgggaaacgttccggtttaaagttaaggttaccgggttaacgggttacgggtaacggttaaggttacggttaacgggttaaccgtttacccggtaacccgggttaaccgggttacggaaacccgggttaccgaccggtacccgtaccgtacccgttanacccggtaccgtccgtaaccgaccccg

SEQ ID NO: 228634 - DNA, 763 bp, Homo sapiens
  misc_feature: GYAE6OF01BFJNR.34.35.D02.1.454.CMB.1.raw
  modified_base (116)..(116): a, c, t, g, unknown or other
  misc_feature (116)..(116): n is a, c, g, or t
  modified_base (734)..(734): a, c, t, g, unknown or other
  misc_feature (734)..(734): n is a, c, g, or t
  modified_base (741)..(741): a, c, t, g, unknown or other
  misc_feature (741)..(741): n is a, c, g, or t
  modified_base (747)..(747): a, c, t, g, unknown or other
  misc_feature (747)..(747): n is a, c, g, or t
  modified_base (753)..(753): a, c, t, g, unknown or other
  misc_feature (753)..(753): n is a, c, g, or t
  modified_base (755)..(758): a, c, t, g, unknown or other
  misc_feature (755)..(758): n is a, c, g, or t
  modified_base (760)..(760): a, c, t, g, unknown or other
  misc_feature (760)..(760): n is a, c, g, or t
  modified_base (762)..(762): a, c, t, g, unknown or other
  misc_feature (762)..(762): n is a, c, g, or t
tcagtacacgtgatcacgaccggtgctcgatttagcacacgatagttgggtttggggccgttcctgggcccagtctgtgctgactcagccaccctcagcgtctgggacccccgggnagagggtcaccatctcttgttctggaagcagctccgaacatcggaagtaaattatgtatattggcaccagcagttcccaaggaccgccccaaaactcctacatctataagtaataatcgtgcgccctgacggggtccctagaccgtatttccgtcgtcggtcctaccgaaacgttccgttcgggaccctaacccttccgacggtcccctcccgttcgggacccctaacgtccgtacgggttcggggcccttacccgggtccggaggtacgtcggtagggtcttacggtattttacgttaccgtgtcggtacacggtaccgagttacggggaacttggaaacccgtcgggtccgttaacggggtggttttagggggtttaccggggttaggtttcccgggggacgggtacgggtaaacccgtaaccgggtcgtacccggtaacccggtttccgtaacgggttcccgaacggtaccccggtaaaggcccgttacccggcccccgttcggttaacccgtcctttccggttccccgttccccggtccccttcccggtacctaacgttacccgtacggtacgttaccgacggaccggtccggcgtacggacgtacggccgaancgtaggntcgatncgtacncnnnngngng

SEQ ID NO: 228635 - DNA, 1060 bp, Homo sapiens
  misc_feature: GYAE6OF01DNHEI.34.35.D02.1.454.CMB.1.raw
  modified_base (116)..(116): a, c, t, g, unknown or other
  misc_feature (116)..(116): n is a, c, g, or t
  modified_base (1051)..(1051): a, c, t, g, unknown or other
  misc_feature (1051)..(1051): n is a, c, g, or t
  modified_base (1054)..(1054): a, c, t, g, unknown or other
  misc_feature (1054)..(1054): n is a, c, g, or t
tcagtacacgtgatcacgaccggtgctcgatttagcacacgatagttgggtttgggggccgttcctgggcccagtctgtgctgactcagccaccctcagcgtctcgggaccccggnaggaggtcaccatctcttgtctggaagcagcctaccaacatacggaagtaaattatgtatattggacaccagcacgttacccgaagggaacccgacccccctaaactcctactatcgtaatacgtaaataacgtctcggaccgccctacggacgggttccctacgaccgtattccgtacgtcggtaccttacccgtaagttccgtcgggccctacccgtaccgtaccgtccccgtttaccccggcggtaccccgtaacggttccccggttaacgggtccggggggtttacccccggttcccggggggtaccccgggtaaaggggttaaccggttacggggaaccgggtttacgtttaacggttaaaatttttacccgttttaaacgggtttcggtacgggaccggtaaaccggtaacggtaagggtttaccggggtaaactttacccggggaaacgttacccggggttaccgggtttacgggggtaacggggggtttttttaccggggggtttcgggggggttttacggggtttacccgggggggggaacccgggggtaaaccgggggttaaaaccccggttaagggtccccgggttaacccgggttacccccgggtttaacccgggttaacgggggttaaccccggtaaccccgggtaacccccggggtaaccgggttacccccggttaccccccgggtcccccccggggtttacccgggtttaaccccgttaccccgggtttaaccccccgttttccccgggtacccccccctttaccccgtttccccggtaaccggtacccttacccgggtttacggttcccggttaacccggtacggggtacccgggttaaccggggtccgaaccgggttaacccggtaccggggtacccggtagtaacgggtcaccgtagccgccgtaggcgtcgcgtancgngtcgcg

SEQ ID NO: 228636 - DNA, 495 bp, Homo sapiens
  misc_feature: GYAE6OF02GLU8S.34.35.D02.1.454.CMB.1.raw
  modified_base (484)..(495): a, c, t, g, unknown or other
  misc_feature (484)..(495): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatgctaacaccaatcggccctcaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtctaggtcagcccaaggccaaccccactgtccactctcgttcccgccctcctcatcacgtgtactgagcggctggcaaggcgcatagnnnnnnnnnnnn

SEQ ID NO: 228637 - DNA, 535 bp, Homo sapiens
  misc_feature: GYAE6OF02JQ0J3.34.35.D02.1.454.CMB.1.raw
  modified_base (338)..(338): a, c, t, g, unknown or other
  misc_feature (338)..(338): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
  modified_base (532)..(533): a, c, t, g, unknown or other
  misc_feature (532)..(533): n is a, c, g, or t
tcagtacacgtgatcacgaccggtgctcgatttagcacacgataggttgggtttggggccgttcctggcccagtctgtgctgactcagccacctcagcgtctggaccccgggcagaggtcaccatctcttgtcgtggaagcagctccaacatcggaagaaattatgtatattggcaccagcagttcccaggaacggcccccaaagtccgtcatctatagtaagtaatctgcggccctcaggggtccctgaccgattcctctggcctccaagtcctggcacctcagcctcctggccatcagtggctccggtcgaggatgagctgattatactgtcagtnacatgaacacacctgggcggtactcggcgaggaccaagctgaccgtctcgagtcacgccgaaggcctagcccctcggtcctacgtcgttacgttcccacccgtccgtacacgtcctaacgtcgtacgtcgacgccgggactcggacgaacggtcgctaacgtgacncgacgtcncgtgacgntcgctcgctgcnncg

SEQ ID NO: 228638 - DNA, 263 bp, Homo sapiens
  misc_feature: GYAE6OF02GM72W.34.35.D02.1.454.CMB.1.raw
  modified_base (255)..(263): a, c, t, g, unknown or other
  misc_feature (255)..(263): n is a, c, g, or t
tcagtacacgtgatcacgaccggtgctcgatttagcacacgatagttgggtgtgggggagtggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatcacgtgtactgagcgggctggcaaggcgcatagnnnnnnnnn

SEQ ID NO: 228639 - DNA, 493 bp, Homo sapiens
  misc_feature: GYAE6OF02HIKR5.34.35.D02.1.454.CMB.1.raw
  modified_base (474)..(474): a, c, t, g, unknown or other
  misc_feature (474)..(474): n is a, c, g, or t
  modified_base (481)..(493): a, c, t, g, unknown or other
  misc_feature (481)..(493): n is a, c, g, or t
tcagtacacgtgatcacgaccggtgctcgatttagcacacgatagttgggtttggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatagtaataatctgcggccctcaggggtccctgaccgattctctggctccaagtctggcacctcagcctccctggccatcagtgggctccggtccgaggatgaggctgattatactgtgcagcatgggatgacagcctgagtggttgggtgttcgggcggagggaccaagctgaccgtctaggtcagccaaggctcgcccctggtcactctcgttcccgccctcctcactcacgtgtactgagcggctggcaggcncagtagnnnnnnnnnnnnn

SEQ ID NO: 228640 - DNA, 516 bp, Homo sapiens
  misc_feature: GYAE6OF02GWTX0.34.35.D02.1.454.CMB.1.raw
  modified_base (504)..(506): a, c, t, g, unknown or other
  misc_feature (504)..(506): n is a, c, g, or t
  modified_base (508)..(516): a, c, t, g, unknown or other
  misc_feature (508)..(516): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaaactcctcatctatagtaataatctgcggccctcaggggtcccctgaccgattctctggctccaagtctggcacctcagcctccctggccatcagtgggctccggtccgaggatggaggctgattattactgtgcagcagtgggatgacagcctgagtgggttgggtgttcgggcggagggaccaagctgaccgtctaggtcagcccgaaggcctcgcccctcggtccacttctcgttcccaccctcctcactccacgtgtactgacgccgggtctcgggcgaggcgacgagtagnnncnnnnnnnnn

SEQ ID NO: 228641 - DNA, 533 bp, Homo sapiens
  misc_feature: GYAE6OF02IYNKQ.34.35.D02.1.454.CMB.1.raw
  modified_base (519)..(519): a, c, t, g, unknown or other
  misc_feature (519)..(519): n is a, c, g, or t
  modified_base (521)..(523): a, c, t, g, unknown or other
  misc_feature (521)..(523): n is a, c, g, or t
  modified_base (525)..(533): a, c, t, g, unknown or other
  misc_feature (525)..(533): n is a, c, g, or t
tcagtacacgtgatcacgaccggtgctcgatttagcacacgatagttgggtttgggggccgttcctgggcccagtctgtgctgactcagccaccctcagcgtctcgggacccccgggcagagggtcaccatctcttgttctggaagcagctccaacatcggaagaaattatgtatattggcaccagcagttcccaggaaccgcccccaaactcctcatctatagtaataatctgcggccctcaggggtcccctgaccgattctctggcctccaagtctggcacctcacgcctccctggccatcagtggctccggtccgagatgaggctgattattactgtgcagcagtgggatgacagcctgagtggttgggtgttcgggcggagggaccaagctgaccgtctacggtcaggcccaaggctccggcccccttcgggtccaccgttcgttcgttcccccgccctccttacacttccacgtcgtacgtcgaggccgggctcgggacaggccggctaacggngnnncnnnnnnnnn

SEQ ID NO: 228642 - DNA, 726 bp, Homo sapiens
  misc_feature: GYAE6OF02JC68T.34.35.D02.1.454.CMB.1.raw
  modified_base (721)..(721): a, c, t, g, unknown or other
  misc_feature (721)..(721): n is a, c, g, or t
tcagtacacgtgatcacgaccggtgctcgatttagcacacgatagttgggtttgggggccgttcctgggcccagttctgtgctgactcagccgaccctcagcgtctgggaccccggggcacgagggtcaccgattcgtccttgttctggaaggtccagctccaactaatcggaagaattatcgtatattggcaccagcgagtttcccgaggacggccccaacgtccggtccatctatacgtataatctcgcggccctacacggggttccctgaccgattactcgtggcctccaagtcgtcggccaaccgtccacgccgtaccccgtggcccattccaggttcggctccggtccgacggactgaggacctggacttacttacgtgtgcgtagcctagtcggggattggacagtccctagtacgttcggtttaggggtcgttacgggacggtacgggaacccaaaggtcccgttaggtaaccccgttacgtaaagggttccgaacggtaccccgaaagggtaccttacgggtacccccccgttaggggttacccaaacccggtttccgttaccgggtttacccccctaaccccgtttccgttaccgacgttcccgaacgttcgttaaaccgtgaaacggttccgggacgtttgggaccgtaacgggtccgtacgtaaccgtacggtcttacgcgtacgtacgtcgaccgtcgtactcgtacgngtccg

SEQ ID NO: 228643 - DNA, 493 bp, Homo sapiens
  misc_feature: GYAE6OF02G797A.34.35.D02.1.454.CMB.1.raw
  modified_base (483)..(493): a, c, t, g, unknown or other
  misc_feature (483)..(493): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatagtaataatctgcggccctcaggggtccctgacccgattctctggctccaagtctggcacctcagcctccctggccatccagtgggctccggtccgaggatgaggctgattattactgtgcagcatgggatgacagcctgagtggtgggtgttcggcggagggaccaagctgaccgtctaggtcagccaggctcgcccctggtcactctcgtcccgccctcctcatccacgtgtactgacgcggctcggcaggcgcagtagnnnnnnnnnnn

SEQ ID NO: 228644 - DNA, 526 bp, Homo sapiens
  misc_feature: GYAE6OF02FGVDC.34.35.D02.1.454.CMB.1.raw
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
  modified_base (488)..(488): a, c, t, g, unknown or other
  misc_feature (488)..(488): n is a, c, g, or t
  modified_base (512)..(512): a, c, t, g, unknown or other
  misc_feature (512)..(512): n is a, c, g, or t
  modified_base (517)..(526): a, c, t, g, unknown or other
  misc_feature (517)..(526): n is a, c, g, or t
tcagtacacgtgatcacgaccggtgctcgatttagcacacgatagttgggtttgggggccgttcctgggcccagtctgttggctgacgtcagccgacccgtccaggcgtctcgggacccccggggcagaggtcaccatctcttgttctggaagcgagcgtccaaacgatcggaagtaaattatgtatattggcaccagcagttcccaggaacggcccccaaactcctcatctatagtaataatcagcggcccctcgacggggtccctgaccgattcctctggctccaagtctggcacctcagcctccctggccatcagtcgggctccggntgaggntggaggctgactattactgtncagcagtgggatgacngcctgaatggctcctatcgtcttcggaactgggaccaggtccacgtctaggtcacgaccaaggcccaaacccnctcgtccacttccncgttccccgccctacctcactcacgttntcctagcgcggctcggcaagggcnatagnnnnnnnnnn

SEQ ID NO: 228645 - DNA, 497 bp, Homo sapiens
  misc_feature: GYAE6OF02GXQIA.34.35.D02.1.454.CMB.1.raw
  modified_base (376)..(376): a, c, t, g, unknown or other
  misc_feature (376)..(376): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (486)..(489): a, c, t, g, unknown or other
  misc_feature (486)..(489): n is a, c, g, or t
  modified_base (491)..(497): a, c, t, g, unknown or other
  misc_feature (491)..(497): n is a, c, g, or t
tcagtacacgtgatcacgaccggtgctcgatttagcacacgatagttgggtttgggtgccgttcctgggcccagtctgtgctgactcagccaccctcagcgtctgggacccccgggcagagggtcaccatctcttgttctggaagcagctccaacatcggaagaaattatgtatattggcaccagcagttcccaggacggcccccaaactcctcatctatagtaataatctgcggccctcaggggtccctgaccgattctctggctccaagtctggcacctcagcctcctggcccatcagtgggcctccggtccgaggatgaggctgattattactgtgcagcatggggatgacagcctgagtggtggtgttcggnggagggaccaagcgtgaccgtctaggtcagcccgaaggcctcgcccctcggtcactctcgtccccncctcnccatcacgtgtctgcgcgggctggcgtaggcgcagtagnnnngnnnnnnn

SEQ ID NO: 228646 - DNA, 627 bp, Homo sapiens
  misc_feature: GYAE6OF02I8Y48.34.35.D02.1.454.CMB.1.raw
  modified_base (407)..(407): a, c, t, g, unknown or other
  misc_feature (407)..(407): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtttgggtaaaggccggggggtcccttaggactttccgtgtggagcctctggattcagtctcagtaacgcctggatgagctgggtcccgccgaggctccgaggggaaggggctgggaggttggggttcggccgtaagttaaaaggcaaaaacgtgagtgggtagggaacaacgagactacgctgcaccgngaaacgcagattcaccgtctacaagagatagaacttaacaaaaacacgactagtaatactaacaaatacgaaacacgacaagtacgaaaaccgaggaacacgacgacgtagttattagttaggtagggtgaagtagtagtaggtttacttacccgtacgtcgggtaccggacggtacccgtggttaccaccggttacctccgtacctaccgtcctacccg

SEQ ID NO: 228647 - DNA, 179 bp, Homo sapiens
  misc_feature: GYAE6OF02ILH7H.34.35.D02.1.454.CMB.1.raw
  modified_base (174)..(179): a, c, t, g, unknown or other
  misc_feature (174)..(179): n is a, c, g, or t
tcagtacacgtgatcacgaccggtgctcgatttagcacacgatagttgggtttgggggaagaggaagactgacggtccccccaggagttcaggtgctgggcacagcggccctgggctgcctggtcaaggactacttccatcacgtgtactgagcgggctggcaaggcgcatagnnnnnn

SEQ ID NO: 228648 - DNA, 546 bp, Homo sapiens
  misc_feature: GYAE6OF02I4TII.34.35.D02.1.454.CMB.1.raw
  modified_base (532)..(532): a, c, t, g, unknown or other
  misc_feature (532)..(532): n is a, c, g, or t
  modified_base (534)..(535): a, c, t, g, unknown or other
  misc_feature (534)..(535): n is a, c, g, or t
  modified_base (537)..(538): a, c, t, g, unknown or other
  misc_feature (537)..(538): n is a, c, g, or t
  modified_base (541)..(546): a, c, t, g, unknown or other
  misc_feature (541)..(546): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatagtaataatctgcggccctcaggggtccctgaccgattctctggctccaagtctggcacctcagcctccctggccatcagtgggcctccggtccgaggatgaggctgatttattctgtgcagcagtggggatgacagcctgaggtgggttgggtggttcgggcgggagggaccaggcgtcggaccgtcgtaggtcagacccgaaggcctccgcccccgtcggtccaccttccgtccgttccccgccctccctcgactccgacgtcgtacgtgacggccgggctcgggacgtaacgggccgagacgtaggcngnngnngcnnnnnn

SEQ ID NO: 228649 - DNA, 215 bp, Homo sapiens
  misc_feature: GYAE6OF02HUO3C.34.35.D02.1.454.CMB.1.raw
  modified_base (178)..(215): a, c, t, g, unknown or other
  misc_feature (178)..(215): n is a, c, g, or t
tcagtacacgtgatcacgaccggtgctcgatttagcacacgatagttgggtttgggggaagaggaagactgacggtcccccaggagttcaggtgctgggcacagcggccctagggcctgcctgggtcaaggacttacttccatcacgtgtactgagcgggctggcaaggtcgcatagnnnnnnnnnnnnnnnnnnnnnnnnnnnnnnnnnnnnnn

SEQ ID NO: 228650 - DNA, 648 bp, Homo sapiens
  misc_feature: GYAE6OF02J2GKU.34.35.D02.1.454.CMB.1.raw
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagtacacgtgatcacgaccggtgctcgatttagcacacgatagttgggtttgggggggtaggaggagcccagccttgggattcccaagtgttttctattcagtgatcaggactgaacacagaggactcaccatggagtttgggctgagctggattttccttgctgctattttaaaggtgtccagtgtgaggtgcagctggtggagtctgggggaggttttgggtaaacggccgggggggtcccttaggactttcctggtggagcctctggattcagtctcagtaacgcctggatgagctgggtccgcgaggctccgaggggaggggctggagtgggttggccgtattaaaaggctaaaacgtgagtggtagggacaacaggactacgctcgacacccgtagaaaggcagatttcaccgtactcaagagactgattacaaaaacgcgctagtatctanaaacngtaacngactagacgtaaaacgacggaacacgacgaccgtataattaacgtttagggaagggttacaagtaagttagggtacgtttaacgttaccccgtaggttaccgggccgtaacgggtaaccccgttggtaccggtacccggttaccttacccggtaccgaccggtaccccttaaccccgg

SEQ ID NO: 228651 - DNA, 502 bp, Homo sapiens
  misc_feature: GYAE6OF02G8GTF.34.35.D02.1.454.CMB.1.raw
  modified_base (489)..(490): a, c, t, g, unknown or other
  misc_feature (489)..(490): n is a, c, g, or t
  modified_base (492)..(502): a, c, t, g, unknown or other
  misc_feature (492)..(502): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatagtaataatctgcggccctcaggggtccctgaccgattctctggctccaagtctggcacctcagcctccctggccatcagtgggctccggtcgaggatggaggctgattattactgtgcagcagtgggatgacagcctggagttgggtggtgttcggcggagggaccaagcgtgaccgtctaggtcacgcccaggctcgcccctcggtcacgtctcgttcccgcctcctcactcacgtgtactgacgcggctggcaggcgacagtagnngnnnnnnnnnnn

SEQ ID NO: 228652 - DNA, 607 bp, Homo sapiens
  misc_feature: GYAE6OF02HHZ9L.34.35.D02.1.454.CMB.1.raw
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (463)..(463): a, c, t, g, unknown or other
  misc_feature (463)..(463): n is a, c, g, or t
  modified_base (601)..(601): a, c, t, g, unknown or other
  misc_feature (601)..(601): n is a, c, g, or t
tcagtacacgtgatcacgaccggtgctcgatttagcacacgatagttgggtttggggggagaggagccccagccttgggattcccaagtgtttcattcagtgatcaggactggaacacagacggactcgaccatcggagtttgggctggagcggcgtagttccgtaaggcgtntactagttaagtntcagtgagaggncgagctggngagttcgngggtagttcggtaacgtccgggtctagacttcgtgtgcnctgngngttcnggtccagacgaacgtcggaatcgagaacgtgtcgggcctccgaggcctagacggtagggtcttggaggtcggttacggcctaaagttaacacgtaaagtgattgggacanaagnggacctgcaagccgcgaagaacgcgagtntcgacnctacganaagtcacgtaactaaacaaacgtctacgtactactaactaanaacaacgacgacgacgaacgtaacgaacgaacgacgacgacgtacgtacgtacgttacgtagtaggtacgagtagtacgtacgtacgtaccgtacggtacggacggacggtacgtacgtcgtccgtctccgaccgacnccgacg

SEQ ID NO: 228653 - DNA, 671 bp, Homo sapiens
  misc_feature: GYAE6OF02I3KDE.34.35.D02.1.454.CMB.1.raw
  modified_base (388)..(388): a, c, t, g, unknown or other
  misc_feature (388)..(388): n is a, c, g, or t
  modified_base (442)..(442): a, c, t, g, unknown or other
  misc_feature (442)..(442): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtggggaggtttggtaaaggccggggggtcccttaggactttccgtggtggagcctcttggattcagtctcagtaacgctggatgagctggtccgcaggctccgagggaagggctggagtggttggccgtaattaaaagcaaaaactgaatggaggacaacgagactacgctcgcaccgtnaaaaggcagtattcgaccgtatccgaagtagacgtagaaattacgaaaaaaacncgtacgtacgtaacgtacttaaaccaaaagttacgaaaacgtaacggactaacgtaacgaaaaaccggaaggaaccaacgacgtaccgtagtaacgttaacgttagtacgggtagaacgtagtacggttagttaacgttaacccgttaacgttacgggaccgtaacgggtaacccgttacgggtacctaaccgggttaccttacccgtacgtaccgcccgtaaccccgg

SEQ ID NO: 228654 - DNA, 610 bp, Homo sapiens
  misc_feature: GYAE6OF02IVSCW.34.35.D02.1.454.CMB.1.raw
  modified_base (546)..(546): a, c, t, g, unknown or other
  misc_feature (546)..(546): n is a, c, g, or t
  modified_base (596)..(596): a, c, t, g, unknown or other
  misc_feature (596)..(596): n is a, c, g, or t
  modified_base (603)..(603): a, c, t, g, unknown or other
  misc_feature (603)..(603): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtttggtaaaggtccggggggtcccttagacgtttcctggtggagcctctggattcagtctcagtaacgcctggatgagcgtgggtccgccgaggcctccgaggggaaggggctgggaggtgggtggaccgtaagttaaaagcaaaacgtggatgggtagggaacaacgagacgtacgctcgaccacccggtagaaacggcgagtactccgaccggtctagaagagactgtaattaacaaaaacgcgacttacgtaatactaaacgaaatacgaaacgagaacataacgaaaccgaaggacacgtagccgtagtagttagtgtagggtnagtagtagtgttacttacccgtaggcggacgacggaccgtgtccacgtcnctcgacncctaccg

SEQ ID NO: 228655 - DNA, 858 bp, Homo sapiens
  misc_feature: GYAE6OF02H1DPU.34.35.D02.1.454.CMB.1.raw
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttgggctgagctggatttccttgctgctattttaaaggtgtccagtgtgaggtgcagctggtggagtcgtgggggtaggtttgggtaaagggcccggggggggttccttaggtaccgtttccgtggtgggtacgccttcgtaggtattcgaggttcctacgtaggtaaccgccgtagggtattggacgtcggttcggggtcccgaccgacggtcctacccggaagggggaacggggccttaggggtacgggttaggggtttcggggtaaccggttaacgttaaaaaaggtccgaaaaaaccggttggaaggttacgggggtaacggaacctaaaacggacggtaacttaaccggccgttacggcccgtaacccggtagtaaaacgggcgaacgtagtttacccgaccgtactaccgaaagacggtaacgtagtaaacgttaaacgaaaaaaccgtaccgtaacgttaacgtaacgttaaacgttaaccgtaaaacgtaacgtaaaccgaagtaaaccgtaaggtaaaaccggtaaaacccgggaaccggaaaccaaccggaacgttaaccgtacgttaaagttaacgttaggggttagggtacgtaacggttaggtaacggttacggtttaacgttaccccggttaacgttccggggtaccggaaccggttaacccggttacccgggtacccgttacccggtaccttaccccgg

SEQ ID NO: 228656 - DNA, 647 bp, Homo sapiens
  misc_feature: GYAE6OF02HT41O.34.35.D02.1.454.CMB.1.raw
  modified_base (536)..(536): a, c, t, g, unknown or other
  misc_feature (536)..(536): n is a, c, g, or t
tcagtacacgtgatcacgaccggtgctcgatttagcacacgatagttgggtttggggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtttgggtaaaggtccgggggggttcccttaggacttttccgtgtggagcctctggattcagtctcagtaacgcctggatgagctgggtccgccaggctccgagggaaggggctggagtgggttggccgtattaaaggcaaaactgatggtgggacaacgagactacgctgcaccgtagaacgcagattcacgtctacaagagatgaattacaaaaacgacgactagtaatactaactaaatagaactagactaagtaacgaaaaccggaacggaacaacgaacgtaccgttagtaactttagttagttaagggggtntaacgtagttagtaggttttacttaaccccgttaacggtacgggtaccgaacggggtaacccgtcggtaccgtacccggtaccttcccggtacctaccgtccctaaccccg

SEQ ID NO: 228657 - DNA, 175 bp, Homo sapiens
  misc_feature: GYAE6OF02GD21U.34.35.D02.1.454.CMB.1.raw
  modified_base (174)..(175): a, c, t, g, unknown or other
  misc_feature (174)..(175): n is a, c, g, or t
tcagtacacgtgatcacgaccggtgctcgatttagcacacgatagttgggtttgggggaagaggaagactgacggtccccccaggagttcaggtgctgggcacagcggccctgggctgcctggtcaaggactacttccatcacgtgtactgagcgggctggcaaggcgcatagnn

SEQ ID NO: 228658 - DNA, 884 bp, Homo sapiens
  misc_feature: GYAE6OF02G90RT.34.35.D02.1.454.CMB.1.raw
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttgggctgagctggattttcctgctgctatttaaaggtgtccagtgtgaggtgcagctggtggagtcgtgggggtaggtttagggtaaaggtcccgggggggttcccttaggtaccgttttcccgtggtcggacgcccgttcgtacgggtatttcctaggttcctacaaggttaaccgtccgtggaattggaacgtcgttcggggccccgccgtaacggccgttaccggaagggggaacgggggtccgttacggggaaggggtttcgggggttacgggtacccggttaaaaggtttaaaaacgaccgtaaaaaaccgttggaaggttacggggtaagggaaaccgtaaacgaacgggtaaaccgtaccggtaccgttcggacccgtaacccgggtaacggaaaaacgggcctaaacgggtacctttaacccgtaaccccggtaccgtaaccgaaaagggtacgtaaagttaacggtaaactttaaaaccgaaaaaaccgtaccgtaccgttaacgttaaacttaaccgttaaaactaaacgttaacgaaaacgacggaaccaaagtaaccgggaaaaaccggtaacgaaccgtaaccgaacgtaccgttaagttaagttaagttacggttaaggggtacgtacgttaagggttaacggttacggttaaccgttaacccgtacggttaccgggaccggtaaccgggtacccgttacggtaccctacccggttactaccccg

SEQ ID NO: 228659 - DNA, 643 bp, Homo sapiens
  misc_feature: GYAE6OF02IKHEB.34.35.D02.1.454.CMB.1.raw
  modified_base (462)..(462): a, c, t, g, unknown or other
  misc_feature (462)..(462): n is a, c, g, or t
tcagtacacgtgatcacgaccggtgctcgatttagcacacgatagttggggtttggggggggagaggagccccagccttgggattcccaagtgttttcattcagtgatcaggactgaacacagaggactcaccatggagtttgggttgagctggattttccttgctgctattttaaaggtgtccagtgtgaggtgcagctggtggagtcgtgggggaggtttggtaaaggccgggggggtcccttagactttcctgtggagcctctggattcagtctcagtaacgcctggatgagcgtgggtccgccaggcctccgaggggaaggggctgggaggtggggttgggccgttaagttaaaagcaaaacgtgaagtgggtagggaacaacgagactacgctgaccacccggtgaaaggcgaagtattccaccgtctacaaggagatagtaacttaacaaaaaacncgtactagtactactaacaaatagaacagacagtaacgaaaccgaggaaccaacgacgaccgttagtagttagttacggtagggtagacgtaagttagtacggttacttacccgttacggtcgggaccgtacgggacctcggttaccgaccgtctcccgcgaccgtccctaccgaacccgg

SEQ ID NO: 228660 - DNA, 732 bp, Homo sapiens
  misc_feature: GYAE6OF02GS05B.34.35.D02.1.454.CMB.1.raw
  modified_base (695)..(695): a, c, t, g, unknown or other
  misc_feature (695)..(695): n is a, c, g, or t
  modified_base (701)..(701): a, c, t, g, unknown or other
  misc_feature (701)..(701): n is a, c, g, or t
  modified_base (717)..(717): a, c, t, g, unknown or other
  misc_feature (717)..(717): n is a, c, g, or t
  modified_base (720)..(720): a, c, t, g, unknown or other
  misc_feature (720)..(720): n is a, c, g, or t
  modified_base (722)..(722): a, c, t, g, unknown or other
  misc_feature (722)..(722): n is a, c, g, or t
  modified_base (728)..(728): a, c, t, g, unknown or other
  misc_feature (728)..(728): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaaccggcccccaaactcctcatctatagtaataatctgccgcctcgacgggtccctgaccgtattctcgtcggtacctacgtaacgtctcggccacctcaccgtccctcccgtggcctacgtcgtacgggttcgggtccgtccgggtccggaagggtacgtcgggacggtacgtacgttactttacgttaccgttcgttacgttacgttccgtttacgaaccgacgtcgtaccgtcgtagtacggttcgttactttagtccgttacggtaccggttaacggtaccgggtaaccgtacggtacccgtaccgtaccggttacggacccgtaccgaaccccggtaacccgtaccccctaacccgtacgttaccgccctttaccccgttccgttacccccgtacccctcccgtacctacgtacccgtaccggttaaccgttcggacggttaccgggccggtaccgggtcgtaaccgggacgtaccggacacggttagtaccgngtaccncgtacgactcgtacgngtncncgtcgngtcg

SEQ ID NO: 228661 - DNA, 860 bp, Homo sapiens
  misc_feature: GYAE6OF02FV1IB.34.35.D02.1.454.CMB.1.raw
  modified_base (253)..(253): a, c, t, g, unknown or other
  misc_feature (253)..(253): n is a, c, g, or t
tcagtacacgtgatcacgaccggtgctcgatttagcacacgatagttgggtttggggccgttcctgggcccagtctgtgctgactcagccaccctcagcgtctgggacccccgggcagagggtcaccatctcttgttctggaagcagcctccaacatcggaagaaattatgtatattggcaccagcacgttcccaggaaccggccccaaactcctcatctatagtaataatctgccgtcctcgacgggtcccngaccgtattcctcgtcggcctccaagtcctggcctaacctcacggtcccctaccccgtgggaccctataccgtaggtcggggacccttcccgggtaccggaagggtacgttcgggaacgggtccttaggtattttaacgtttaccgtggttacgaccttagggcctaaggttcggggaaattcggaaccgaaggtcccgttaggtacgggtggggttttggggtcggtttaccggggacgggttaacggggaacccgtaaaggtcggttaccggtaacccggttacccggttaacgggttaccgtaaccgggtacccccgtaaaacggggtcccgttacccggacccccccgggtttaccggtacccgtaacccgttttccccggtttccccgggtttacccccgttccccccgtttacccgttaacccggttacccgttacccggtaacccgttttacgggttaacccgtttacgggtaacccgggttcccggggtaccccggtttacgggggaaccccggttaaccggggtacccgggttacccgtaaacggtttcgggtaactcggtaacgcgttaccggcagccggtttatacgtcgtcgtcg

SEQ ID NO: 228662 - DNA, 637 bp, Homo sapiens
  misc_feature: GYAE6OF02F13VM.34.35.D02.1.454.CMB.1.raw
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (428)..(428): a, c, t, g, unknown or other
  misc_feature (428)..(428): n is a, c, g, or t
tcagtacacgtgatcacgaccggtgctcgatttagcacacgatagttgggtttgggggggagaggagccccagccttgggattccccaagtgttttcattcagtgatcaggactgaacacagaggactcaccatggagtttgggctgagctggattttccttgctgctattttaaaaggtgtccagtgtgaggtgcagctggtggagtcgtgggggaggtttgggtaaaggccgggggggtcccttagactttcctgtggagcctctggattccagtctcagtaacgcctggatggagctgggtccgccaggcctccagggagggcnggagtgggtgccgtataaagcaaatgatggtggacaanagactacgctgcaccgtgaaacggnagtntcaccgtctacgaagagatagacttacaaaaacncgactagtatactaacaaatgaacagacaatacgaaaaccgaggaaccaacacggtccgtaagttacgtttaattcgggtaagggtacgaacggtagttaggttacgggttaactttacccccgttaaggtacggggtcccggtaaacggggtaacccctaggggtccctacccggttccttcccgtaccgtacgtccccctaacccgg

SEQ ID NO: 228663 - DNA, 545 bp, Homo sapiens
  misc_feature: GYAE6OF02H7ZKS.34.35.D02.1.454.CMB.1.raw
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (467)..(467): a, c, t, g, unknown or other
  misc_feature (467)..(467): n is a, c, g, or t
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (538)..(545): a, c, t, g, unknown or other
  misc_feature (538)..(545): n is a, c, g, or t
tcagtacacgtgatcacgaccggtgctcgatttagcacacgatagttgggtttgggggccgttcctgggcccagtctgtgctgactcagccacccctcagcgtctgggacccccgggcagagggtcaccatctcctgttctggaagcagctccaacatcggaagaaattatgtatattggcaccagcagttcccaggaaccggcccccaaactcctcatctatagtaataatctgccggccctcgacggggtccctgaccgattctctggctccaagtctggcactcagcctccctggccatcagtggcctccggtccgaggatgacgntagtattatactgngcagcagtgggatgacagccgtggaggttggttgggttcggtcgggcgggagggaccgagcgtacggtcccgtacgtaggtcacgccgaaggcctcgccccgtcgtctactcgttccgttcccnccctacctctactccgtaccgtcgttacgtgacggccggtcgtcggacgtacggcgnaccgtgcngctngnnnnnnnn

SEQ ID NO: 228664 - DNA, 664 bp, Homo sapiens
  misc_feature: GYAE6OF02GM9OV.34.35.D02.1.454.CMB.1.raw
  modified_base (117)..(117): a, c, t, g, unknown or other
  misc_feature (117)..(117): n is a, c, g, or t
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
tcagtacacgtgatcacgaccggtgctcgatttagcacacgatagttgggtttgggggccgttcctgggcccagtctgtgctgactcagccaccctcagcgtctgggacccccgggnagagggtcaccatctcttgttctggaagcagctccaacatcggaagaaattatgtatattggcaccagcagttcccaggaacggcccccaaatcctcatccatagtaataatcagtcggccctcaggggtccctgaccgattctctggctccaagtctggcacctcancctccctggccatcagtgggctccggtctgaggatgaggctgactattacngtncagcagtgggatgacagcctagaactggactccgtaatcggttacttacgggaacgttacgggaaccctaaagggtccctaccggtaccttaagggtaccacggtaccccgaaacgggacccctaaaccccgaacgttccgtacctacccgttaccgtttccgttcccccgtaccccttcccgttaccaaccgttcccgtaaccgtttcgttaaacccgtcggtaaacgggtccgggtaccgttcggggaaccgtaacggggtcccgtaaccgtaacgttaaacccgggtacgtaccgtacgacgtactacgactacgtagtacg

SEQ ID NO: 228665 - DNA, 602 bp, Homo sapiens
  misc_feature: GYAE6OF02IL4GG.34.35.D02.1.454.CMB.1.raw
  modified_base (434)..(434): a, c, t, g, unknown or other
  misc_feature (434)..(434): n is a, c, g, or t
  modified_base (467)..(467): a, c, t, g, unknown or other
  misc_feature (467)..(467): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggtttggtaaaggccgggggtccttagactttcctggtggagcctcgtggattcagtctcagtaacgctggatgagcgtggtccgcgaggctccgagggaggggctgggaggtgggtcggccgtaagttaaaacgcaaaaacgtgaagttgggtacggaacaacgagaccgtacgctgaccgaaccgtagaaacggcagtacttcaccgtctacaaganatagaataacaaaaacacgatagtactactaanaagtacgaaacagactaagaacgaaacgagacaacgagaccgtatagttagttgtagggtgagtagtagtacgttaactacccgtagtacgggacgtacggtaccgtgtaccgaccgtctccactccgcctaccg

SEQ ID NO: 228666 - DNA, 595 bp, Homo sapiens
  misc_feature: GYAE6OF02GLXET.34.35.D02.1.454.CMB.1.raw
  modified_base (263)..(263): a, c, t, g, unknown or other
  misc_feature (263)..(263): n is a, c, g, or t
  modified_base (522)..(522): a, c, t, g, unknown or other
  misc_feature (522)..(522): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
  modified_base (593)..(594): a, c, t, g, unknown or other
  misc_feature (593)..(594): n is a, c, g, or t
tcagtacacgtgatcacgaccggtgctcgatttagcacacgatagttgggtttgggggccgttcctggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcactctatagtaataatctgcggcccctgacggggtccctgaccgattcnctggctcaagtctggcaccgtcacgcctccccgtggccatccaggtgggccttccgggttccgaggtacttggacggtcgttgtaattacttactcggtgcagctagtgggatcggactaggccctaggacggttgggttcggggttaggttcgggcgggacgggtaccaagtcgttcggacccgttcgtacggtcgacgaccccgaacggtcctccggaccccctcggttccaccgttccgtccgttcccaccctccnctactctacgtcgtactgacgcggtcgtgccgacggcgtcgtacgtacggtcacncncgncgcncnncncnnc

SEQ ID NO: 228667 - DNA, 756 bp, Homo sapiens
  misc_feature: GYAE6OF02HHVE8.34.35.D02.1.454.CMB.1.raw
  modified_base (151)..(151): a, c, t, g, unknown or other
  misc_feature (151)..(151): n is a, c, g, or t
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
  modified_base (728)..(728): a, c, t, g, unknown or other
  misc_feature (728)..(728): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagcgnggtagtttcctaggctgactaagtttaaagtgtaccagtntgagtgcagctaggtggngtcgtgggggaggtttggaaaggccgggggttacccttaggactttcctggtagagcctcgtggagttaccagtctacgagtaaaccgcctaggtaatggacgtcgtcgggtcccgaccgtacggacgtacccgaaggggtaacgggggtcgtagggaacggttgggtcggtaacccgtaagtttaaaacgactaaaaacgtgagttacgggaggtaaccaaagacgtacctagactagacctacccggtaagaacggactaagcttaccacgtactaacgaagacgaactagtaacttaaacgaaaaaacgtacgtaacttagtaactaacctaacggtaaaatacggtaaacacgacaaagtaaaccgaaaaccggtaacggaacaaacgtaacctacggtaacttaagttaagtttacgggtaagggttagagttaaacgtaggttacgtttaacgtacccgttaaggtaccgggaaccggtaacggaacccgttcggtaccggtacccgttaccncccggtacaccccggttacgtaaccccg

SEQ ID NO: 228668 - DNA, 648 bp, Homo sapiens
  misc_feature: GYAE6OF02HEXFW.34.35.D02.1.454.CMB.1.raw
  modified_base (265)..(265): a, c, t, g, unknown or other
  misc_feature (265)..(265): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (624)..(624): a, c, t, g, unknown or other
  misc_feature (624)..(624): n is a, c, g, or t
  modified_base (632)..(632): a, c, t, g, unknown or other
  misc_feature (632)..(632): n is a, c, g, or t
  modified_base (635)..(635): a, c, t, g, unknown or other
  misc_feature (635)..(635): n is a, c, g, or t
  modified_base (640)..(640): a, c, t, g, unknown or other
  misc_feature (640)..(640): n is a, c, g, or t
  modified_base (642)..(644): a, c, t, g, unknown or other
  misc_feature (642)..(644): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
tcagtacacgtgatcacgaccggtgctcgatttagcacacgatagttgggtttgggggccgttcctgggcccagtctgtgctgactcagccaccctcagcgtctgggacccccgggcagaggtcaccatctcttgttctggaagcagctccaacatcggaagaaattatgtatattggcacagcagttccaggaaccggccccaaactcctacatctaatagtaactaatctagccgccctgacggggtccctgaccgtattccnctcggcctccgaaagttcctaggccaccgtcacgcctcccgtggccactcgagtcgggctccggtcgagganggagctgattattacgngtagtacagcagtcggggattacggaactgaccgttggtagttggggttggggtcgttcgggaacggggtacgggaaccgaacgtcgtagtacccggtcgttaacggcgaacccggtaccgaacggtacctaccccggtcccccgttaaggttccctaaccgtttccgttaaccgttccccccgttacccgtcccttcgtacgttacccgtacggtacgtacgtacggtcgggtaccgggcgttaacgaacgtaggtaccgtagacggtnacgacgtncgngacgngnnncngn

SEQ ID NO: 228669 - DNA, 795 bp, Homo sapiens
  misc_feature: GYAE6OF02HS6XC.34.35.D02.1.454.CMB.1.raw
  modified_base (793)..(795): a, c, t, g, unknown or other
  misc_feature (793)..(795): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacagtcggggcaggttatgatgtacacgtggtacaagcagcttccgaggaacacgacccccaaactcctcatctatgactaacaccaacgtccgccctacgacgggtccctgaccgtattctctaggcctaccaacgtcgttggccacctccgacgtcccctccgtcggcctacttccgacggttcgggacccgtcccgggtctacgggaggtacgttacggaacggtcgttacgttaacgttttaacgtttaaccgtcggttaccttaccggttttcctttaggaacccgtaaggtcgacggttcccagggtacgttacggttaccttacgtttcggttacccggtttacgggaaccgttacccgggggaaccttaaacggggttaccccggtaccccgggttaaccggttacgggttaccgaaacccggaccccgggaaaaccccggtaccccgaaacccccggttcgttacccgttaaccgtacccggtttacctttcccccgggttaccccccgttaccccttaccgttacctaacccgttcctacggtttttaaccgccgttaacggggccggtccggggtaccgcggggtaaccccgaggggtcctaaaccgtgaacgcgtaagcctgctagcnnn

SEQ ID NO: 228670 - DNA, 721 bp, Homo sapiens
  misc_feature: GYAE6OF02ILEZ9.34.35.D02.1.454.CMB.1.raw
  modified_base (448)..(448): a, c, t, g, unknown or other
  misc_feature (448)..(448): n is a, c, g, or t
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttgggctgagctggtattttccttgctgtcttaatttttaaaaggtgtcctagtgtgaggtgcagcgtggtggagtcgtgggggtaggtttgggtaaacgggcccggggggttcccttaggtacgtttccgtggttcggacgtccttcgtggtattcgtagttctacgaagtaaccgcctggatggagtcgtcgggtcccgccgaggcctaccggaacgggggaaggggccgtgggtaggttggggttcggtaccgttaaagttaaaacgacctaaaacgtggaagtagggtcggaacaaacgngacctacgctagccgtaacccggagaaacggcaacgtacttccgaccgtcacgaacgagaactagtaataaacaaaaacgacgtactacgtaatactaaactaataacgaacagaccaagtaaccgaaaccgacgaacacgacgtacgtagtacgttaagtggtaaggtacgtaagtaggttacggttacggtttaacccgttaacccgttagtacccgggggtaccgtaacccgggtaccgtttacgggacccttaccggtcccttacccgg

SEQ ID NO: 228671 - DNA, 687 bp, Homo sapiens
  misc_feature: GYAE6OF02JPKJB.34.35.D02.1.454.CMB.1.raw
  modified_base (154)..(154): a, c, t, g, unknown or other
  misc_feature (154)..(154): n is a, c, g, or t
  modified_base (168)..(168): a, c, t, g, unknown or other
  misc_feature (168)..(168): n is a, c, g, or t
  modified_base (215)..(215): a, c, t, g, unknown or other
  misc_feature (215)..(215): n is a, c, g, or t
  modified_base (274)..(274): a, c, t, g, unknown or other
  misc_feature (274)..(274): n is a, c, g, or t
  modified_base (403)..(403): a, c, t, g, unknown or other
  misc_feature (403)..(403): n is a, c, g, or t
  modified_base (665)..(665): a, c, t, g, unknown or other
  misc_feature (665)..(665): n is a, c, g, or t
  modified_base (669)..(669): a, c, t, g, unknown or other
  misc_feature (669)..(669): n is a, c, g, or t
  modified_base (675)..(675): a, c, t, g, unknown or other
  misc_feature (675)..(675): n is a, c, g, or t
  modified_base (678)..(678): a, c, t, g, unknown or other
  misc_feature (678)..(678): n is a, c, g, or t
  modified_base (681)..(682): a, c, t, g, unknown or other
  misc_feature (681)..(682): n is a, c, g, or t
  modified_base (686)..(686): a, c, t, g, unknown or other
  misc_feature (686)..(686): n is a, c, g, or t
tcagtacacgtgatcacgaccggtgctcgatttagcacacgatagttgggtttggggccgttcctggcccagtctgtgctgactcagccaccctcagcgtctcgggacccccggcaggaggtcaccatctcttgtctggaagcagctccaacgntacggaagaaattngtatattggcaccagcagttccccaggaaccgccccccaaagtcctnagtccaatagttaataagtctggccgcccctgacggggttcccctggacccgtattccngtcggcctccaagttccgtgggaccacccttacgacgtcccccttccccgtacggccctaactccgtaaggtcggggtcctcccgggttccggaaagtcggtggacggtctagtaatttaacctttcgnggtccgacctggactagtggggactttagacgtacgtcgtggacgggttggttggggttcgttcgggggcggaacgggtaaccacggacgtccgacgttccgtaacggtcgacgtaccgaggtccgtcccggtacccccgcggttcccgacccttaccgttccggtaccccttaccccgtacctttcccaaccttaccggaacgttccgtaccggtggtaccggtccggtcgtccgggacgtaaccgggcgtacgacgtagngtcngtcgcnganccnnctgnc

SEQ ID NO: 228672 - DNA, 781 bp, Homo sapiens
  misc_feature: GYAE6OF02H63J2.34.35.D02.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
tcagtacacgtgatcacgaccggtgctcgatttagcacacgatagttgggtttggggagctctgggagaggagccccagccttgggattcccaagtgttttcattcagtgatcaggactgaacacagaggactcaccatggagttgggctgagctaggtattttccgtgtctgacttaagtttaaaggtgtccgtagtgtgaggngcagngtggtggagttcggtgggggtaggtttagggtaaacggggtccggggggttaccttaggtaccgtttcgtggtggacggtctcgtaggtacgtcgtacgtactacgtagtaaccgcgtgagtgagtcggtggaccgcgacgccgtacggagggacgggtgaggtaggtggtacggtacgtaagtaaacgaactaaagtggtaagtaggggtaacgacaaacgacgtaacgtaacgtcgtacgaaccggacggtaaaggaaacggcgtaaaggtacgtttacccgtaacggttaccaacgtaaacggtaagtaaccgtaagtaaaaccttaaaacgaaaacctaacgtaaccgtaagttaacgtaaacgttaaacgtaaacgtaacgtaaacaaagtaaccgaaacgttaaaaccggaaaaacgacccggtaaaactaacggaaccggttaaccgttaggttaaacgtaagggttagttaaggggactaaaggttaagtaacggttaacgttaacgtaaccggtaacggttacggacgtacgggtacctacggtacctaccgtcgtaacccg

SEQ ID NO: 228673 - DNA, 714 bp, Homo sapiens
  misc_feature: GYAE6OF02JHTX2.34.35.D02.1.454.CMB.1.raw
  modified_base (533)..(533): a, c, t, g, unknown or other
  misc_feature (533)..(533): n is a, c, g, or t
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttgggctgagctggattttccttgctgcttattttaaaggtgtccagtgtgaggtgcagcgtggtggagtcgtgggggtaggtttagggtaaacgggcccgggggggttaccccttaggtaccgttttccgtaggttcgggtacggtcccttcgtagggtactttccgaggttcctcgaacgttaaaccggcccgtaggatggaggccgttggggtcccgccgagggtcctccgaaggggaacggggcgtagggacggttggggttacggaccggtaattaaaacggacctaaaacgtgaagtgggtaggaacaagagacgtacgctcgaccgaccgtagaaacggcagtactaccgaccgtacacaagagagtagaataacaaaaacncgtactagtactacaactaacgtagaacagacaataacggaaacgaacgaacaacgacgtaccgttagtaactttagtaggtacgggtacgaacgtaggttaacggttaacggttacttaacccgttacggtaccgggaccgttaacgggacccgttaggtcccgtaccgttccgtacccg

SEQ ID NO: 228674 - DNA, 1092 bp, Homo sapiens
  misc_feature: GYAE6OF02IPL42.34.35.D02.1.454.CMB.1.raw
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctatttaaaaggtgtccagtgtgaggtgcagcgtggtggtagtcgtgggggtagggtttagggtaaaagggtcccgggggggttacccttaggtaaccgttttcccgttaggtgggtaacggtcccgtcgttgggtacttacgtacggttccttacgaacggttaaaccggcccgttagggtacgttacggtaacggtccggttaccggggggttcccgtacccggtaacggggtcctttaccccggggaaggggggggtaaaacggggggtccgtttagggggtaagggtttacgggggggttttacgggtaacccgggttttaaaaacggtttaaaaaaacgggtacccgttaaaaaaaaccgttggggtaaacggttttacggggggttaaccggggggaaaaaacctaaaccgggttaaaaccggaaacccggttaacccggttaaccggttaccgggtaaaccccggtaaacccccgggtttaaagggaaaaaaaccgggtccgttaaaacgggttaacccgtttacccggtaaaccccgggttaccgttaaaacccgtaaacgggttaaacggtaaaccgttaacggttaaaaccgtttaaaacccgtaaaaaaaaaccgtacccggttaaccgttaacggttaaaaccgttaaccttaaaacgtaaaacgtaacgttaaaacgacgaaacgttaaacgttaaaaccgggaaaaacccgggtaacgtaaacccggaaaccgtaaccggttaacccggtagtttaaaccgtttaaggtttaacgggtacgggggtaaataccggttaaaggttacggttacggtttaaacccgtacccgttaagggtccgggtaaccgtaaccgggtaaccgttacggtacctacccggttcccgtccggtacgaccggtcccgtaacccgg

SEQ ID NO: 228675 - DNA, 738 bp, Homo sapiens
  misc_feature: GYAE6OF02I58XY.34.35.D02.1.454.CMB.1.raw
  modified_base (118)..(118): a, c, t, g, unknown or other
  misc_feature (118)..(118): n is a, c, g, or t
  modified_base (141)..(141): a, c, t, g, unknown or other
  misc_feature (141)..(141): n is a, c, g, or t
  modified_base (146)..(146): a, c, t, g, unknown or other
  misc_feature (146)..(146): n is a, c, g, or t
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
  modified_base (717)..(717): a, c, t, g, unknown or other
  misc_feature (717)..(717): n is a, c, g, or t
tcagtacacgtgatcacgaccggtgctcgatttagcacacgatagtttgggtttgggggccgttcctgggcccagtctgtgctgactcagccaccctcagcgtctgggacccccgggnaggaggtcaccatctcttgttcnggaancagctcacatcggaagaattatgtatattggcacngcacgttccaggaaccgtccccaaactcctnatcagtagtaatatctgcgccctagacggggtcccctgaccgtattccgtctcggtctccctaagtcgtcggacctaccgtcacgcccctcccttacgggccctacgtacacggttcggggtccgtcccgggttccggaagggtacttcggacggtccgttagtacttttacgttacgttgtacgcgtaacgctaggtacgggattccggaaccgtaggtccgttagggacggtttgggttcggggtttacgttcgggaccgggtagggtaaccgaggccgtacggtacccgtacggttacccggtacgtacccggtccgtaacggtcccggtacccgttaccccggtcgttaccgttacccgttcccgttcccgtacccccgttacccgtcccgtttaacgtccctaccgttacgtttaccggtacggttcggtacgggtaaccgggttccgtaccgggaccgtaacgggtccgtccgtaacggtcgtaccggtgtaacgtcgngtacacgcctagcgacgtcgc

SEQ ID NO: 228676 - DNA, 751 bp, Homo sapiens
  misc_feature: GYAE6OF02FOH59.34.35.D02.1.454.CMB.1.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
tcagtacacgtgatcacgaccggtgctcgatttagcacacgatagttgggtttggggagctctgggagaggagccccagccttgggattcccaagtgttttcattcagtgatcaggactgaacacagaggactcgaccatggagtttggctgagctggtattttcctgctgcttatttaaagtgtccagtgtgagtgcagctggtgagtctggggngtttggtaaggccggggtacctagcttctgtgancctgtgattcagtctgagtaacnctggatgagcgtcggcncgaggtcctcgaggacgggtctaggacgtgggtgaccgtaataaagctaaaacgtgagtacggtaggaactaacgagactacgacgtacaccgtacccgtagaaacgtcgaacgtacgtttaccgacccgtacgtaacgaacgtacggtaactagtaaccgttaaaccgaaaaacgtcgttaccgtacggttaaacttaccgttaaaacgtaaaccttaacgaaaccgtaacggtaacgtaaacgttaaccggaaaacccggtaggtaaccctaaaggtaccgttaaccgtttaaggttaaactttaacggttaccggggttaaggttacgtaccggttaaggtttaaccggttacggtttaaaccccgtttaaccggttaaccggttaaccgggtaaccgttaacccggggtttaaaccccgtggttaacccccggttaccgttacccgtttaaccccgg

SEQ ID NO: 228677 - DNA, 774 bp, Homo sapiens
  misc_feature: GYAE6OF02GFWO2.34.35.D02.1.454.CMB.1.raw
  modified_base (556)..(556): a, c, t, g, unknown or other
  misc_feature (556)..(556): n is a, c, g, or t
tcagtacacgtgatcacgaccggtgctcgatttagcacacgatagttgggtttggggagctctgggagaggagccccagccttgggattcccaagtgttttcattcagtgatcaggactgaacacagaggactcaccatggagtttggctgagctggtatttcctgctgctatttaaagtgtcagtgtgaggtgcagtcgtggtgtagtcggtgggggtaggtttagggtaacgggtcccggggggttaccttaggtacctttccgtggtacggtagtccgtttggacttcgaggttctacgagtaaccgctcggatgacgtcgtacgggccgaccgaggccgtaccggaacgggggtaacgggtccgtaggggtacgggttcggggttacggtacccggttaaattaaaaacggaccgtaaaaacgtggtaacgtgggtaacggactaaacgacgtactaacgcttcgaccgtaccgtaagaacgcaacgtacttccgacgtcaacgaagagtatacgtaactaaacgaaaacgtcgtactagtactacgtaaanaagttacgaacaagtactaaagtaaccggaaacgtacgaacctaccgagtaccggttaagttaacgttaggttacgggtacggtaacgtagtaaggtttacggtaaccggtttaaccttaaccccggttacgggtaaccgggtaaccccgtaaaccggggttacccgtttaccgggttaaccccggtacccgtttaccccggtacgttaacccccggg

SEQ ID NO: 228678 - DNA, 595 bp, Homo sapiens
  misc_feature: GYAE6OF02HNKHE.34.35.D02.1.454.CMB.1.raw
  modified_base (389)..(389): a, c, t, g, unknown or other
  misc_feature (389)..(389): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
tcagtacacgtgatcacgaccggtgctcgatttagcacacgatagttgggtttggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctgtggcctgggtcccgtcacgcccccaggaaaagggcctggagttcctagcgctcgtttattggggttgcgtgagtgagcgctacagtccatactctgaagaccaggctcaccatccagaccggaccaaccccgaaaaaccnggtacgactcctagaaccactagaaccgaagttcggaccctgtcggacacgagcccactattnttgtcncacgaccaaaccgngtcccgnggccgggacttacgtttgaacctagtcgggaccgtacgggccctcggtcgacccgttcctccgtcacgcccgtaccaccggaaccggccctaagtccggttcccttcccccgtcgg

SEQ ID NO: 228679 - DNA, 705 bp, Homo sapiens
  misc_feature: GYAE6OF02G5BMG.34.35.D02.1.454.CMB.1.raw
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctgggtggagtcgtggggggtaggtttgggtaaaggtccgggggggttcccttaggtactttccgtggtggacgtcctctggattcagtctcagtaacgcctggatgagcgtcgggtcccgccgagcgtccgaaggggaacggggctgggtaggtggggttggaccgttaaagttaaaacggactaaaaaacgttggaagtggggtacgggaaaccgaaacgaacgtaaccgtacggctacgcccgacccggttaaggaaacggacgaggtactttccgaaccttcgtacaaaggtagtaacttacgtaaacttaaaccgaaaaaacgtaccgtataacgttactacctaaactaaatacgaaacagacaagtaacgaaaaccgacgaacgaacgacgtacgtagttagttagttacggtagggtagaacgtagtacgttacgttacgttacccgtacggtcggaccgacggtaccgtgtaccgaccgttcctccgtcgcgcctaccg

SEQ ID NO: 228680 - DNA, 958 bp, Homo sapiens
  misc_feature: GYAE6OF02FXTZZ.34.35.D02.1.454.CMB.1.raw
  modified_base (171)..(171): a, c, t, g, unknown or other
  misc_feature (171)..(171): n is a, c, g, or t
  modified_base (639)..(639): a, c, t, g, unknown or other
  misc_feature (639)..(639): n is a, c, g, or t
tcagtacacgtgatcacgaccggtgctcgatttagcacacgatagttgggtttgggggggagaggagccccagccttgggattcccaagtgttttcattcagtgatcaggactagacacgagacgactcacagtaggttaggttggctagacgtcgtagttactttcgtgngtcgtactttaaagtttaaaggtcgtaccgtaggttggaggtacggtacgacgtacggtcggttaggggtacggttcggtacgggggttaggggggtttaagggtttaacgggggtaaaccggggggttccccggggggtttaacccgtttaacgttacccgttttccggtggggtacggtaccgttccgttacggttacggttacttaccgtacgttacctaccggttaaaccggttaccggtccggttaggtaggttacggaccggttcggggtcccgggtaccccgacggtcggtacccggtaccggggaacggggggtacggtcgggtaggggttacggggtttcgggtaccgggttaacgttaaaaggtaaaacaaccggttaaacggttaggtagggttacgggaacggaaacaacggtacggtaccgtacgtcgtaccgaccgtaaccgggaggtaaacgngtaacgttacgtactaacccgtgaacggaagtacgtaagtaacgtaaacctaaaacgaaccgtcgttaactacgttaataaaccgaaataacccgtaagtaacgaacggtaactacgggtaaaaccgaaaccggtaccggaaccgtaaccggacggttcgtttaaaggttagtttacggggttaaggtacgggtaactagggtttacgtaaccgggttttaccgttacccgaacggttcgggaacccgggtacggtaacccggttaccgtttcgtcccgtacccgttcgtaccgacggttacccctccctaaacccggg

SEQ ID NO: 228681 - DNA, 805 bp, Homo sapiens
  misc_feature: GYAE6OF02H9FQD.34.35.D02.1.454.CMB.1.raw
  modified_base (117)..(117): a, c, t, g, unknown or other
  misc_feature (117)..(117): n is a, c, g, or t
  modified_base (330)..(330): a, c, t, g, unknown or other
  misc_feature (330)..(330): n is a, c, g, or t
  modified_base (780)..(780): a, c, t, g, unknown or other
  misc_feature (780)..(780): n is a, c, g, or t
  modified_base (785)..(785): a, c, t, g, unknown or other
  misc_feature (785)..(785): n is a, c, g, or t
  modified_base (803)..(803): a, c, t, g, unknown or other
  misc_feature (803)..(803): n is a, c, g, or t
tcagtacacgtgatcacgaccggtgctcgatttagcacacgatagttgggtttgggggccgttcctgggcccagtctgtgctgactcagccaccctcagcgtctgggacccccgggnagagggtcaccatctcttgtctggaagcagctccaactatcggaaagtaattatgtattattggcaccgagtctacgttcccgaaggaaccgacccccaaactcctacatctatagtaatatctgccgtcctacggacgggtccctagaccgtacttctacgtggccttacaagttccgtacggcctacctaccgacgtcccccgttacccgngggtaccctacgtacgtacggttccggggtccgttacccggggtacccggaaggtacggtacgggacgttacgtcggttaaactttacgtttcgagttcggaacgtaacgtccgtaggtttacggggactacggtaaaccggtcgtaccgggttaggtacggggtttggggtttacggggttccgggttacggggaaccggggtaacgggtaaaccgtcgggtaacccggtccgggttaaccgtaccgggttaacggccggtaaccgggacccgtacggtcccggtcccccggttacccgtccggttaacccgtccgttaaccccgttcccggttaccccccgttacctacccgttacgtaccgtacccggttacggtaccgttaccggtggacccggggtccggttaccgcgggacgtaaccggtccgtaggttaacctggcccgttanccganccgtgcgtcgcgcgcgcncg

SEQ ID NO: 228682 - DNA, 827 bp, Homo sapiens
  misc_feature: GYAE6OF02GXMQ5.34.35.D02.1.454.CMB.1.raw
  modified_base (808)..(808): a, c, t, g, unknown or other
  misc_feature (808)..(808): n is a, c, g, or t
  modified_base (813)..(813): a, c, t, g, unknown or other
  misc_feature (813)..(813): n is a, c, g, or t
  modified_base (824)..(825): a, c, t, g, unknown or other
  misc_feature (824)..(825): n is a, c, g, or t
tcagtacacgtgatcacgaccggtgctcgatttagcacacgatagttgggtttgggggccgttcctgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatcctatagtaataatctgccggccctcgacggggtcccctaggacccgtattctcgtcggacctccgaagtctacggccacctcacgtcccctcccgtggccatcgacggtcgggcctccggtaccgaggactcggacggtctaggtactttacgtttacgtcggttgaccgtagtcgtaagtttcggggacttacggaacgacggtacccgttggtaacggggtttgggggttttcgggggttacgggtttaccgggggaccgggggtaaaccgggggtaaacccctaacggggttccggttacccgggttaaaccccgggtttaccccggggttacgggttacccggtaaacccggggtaacccccggtaaacggggtccccgtttaccccgggtaccccccggttaccgggttaacccgtaccccgtttcccggttaccccggtttacccccctacccccgttaccccgttaccggttacccttaccggttacccggtttccgttaaccggttaccgggtaccgggtccgggtaccggttaaccgggtaccgaacgggtccgtacggtaacgttcggacgtcgagtcgnggacncgcgcgcgtcnncg

SEQ ID NO: 228683 - DNA, 682 bp, Homo sapiens
  misc_feature: GYAE6OF02GFYES.34.35.D02.1.454.CMB.1.raw
  modified_base (308)..(308): a, c, t, g, unknown or other
  misc_feature (308)..(308): n is a, c, g, or t
  modified_base (487)..(487): a, c, t, g, unknown or other
  misc_feature (487)..(487): n is a, c, g, or t
  modified_base (510)..(510): a, c, t, g, unknown or other
  misc_feature (510)..(510): n is a, c, g, or t
  modified_base (545)..(545): a, c, t, g, unknown or other
  misc_feature (545)..(545): n is a, c, g, or t
  modified_base (588)..(588): a, c, t, g, unknown or other
  misc_feature (588)..(588): n is a, c, g, or t
  modified_base (676)..(676): a, c, t, g, unknown or other
  misc_feature (676)..(676): n is a, c, g, or t
tcagtacacgtgatcacgaccggtgctcgatttagcacacgatagttgggtttggggagctctgggagaggagccccagccttgggattcccaagtgtttttcattcagtgatcaggactgaacacagaggactcaccatggagtttgggctgagctggtatttttccttgctgtcttaattttaaaaggtgtacagtgtgaggtgcagcgtggtggagttcggtagggggtagggtttaggtaacgggtccggggggttacccttaggtaccgtttccgtggtggacgcctgtggtattcgagtctnacgtaccgtcgtggatggagtccgtcggggtcccaccgagggcctaccggaaggggtacggggcgtaggggtaggttggggttcggaccgttaaagttaaaacgactaaaacgtgagtgggtaggacacgagactagctcgacaccgtagaacgtcagtactacgtacgtcaacgaganactagtaaactaaaccgaaaacnccgtagtacgtactaactaaactaacgtaacgaanacggaacaagtaaccggaaaagacggaaccacgtagtaccgtnttaaacgttgtagggttacggagtagtaggttagtacgttaacgttaccggacggtcggtacgaccggtaccgttcgacttacccgtntacccg

SEQ ID NO: 228684 - DNA, 855 bp, Homo sapiens
  misc_feature: GYAE6OF02I1HUA.34.35.D02.1.454.CMB.1.raw
  modified_base (373)..(373): a, c, t, g, unknown or other
  misc_feature (373)..(373): n is a, c, g, or t
  modified_base (600)..(600): a, c, t, g, unknown or other
  misc_feature (600)..(600): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggtattttccttgctgcttattttaaaaggtgtaccagtgtgaggtgcagcgtggtaggagtcgtgggggtaggtttagggtaaacgggtccggggggttaccttaggtaccttttccgtggtcggacgtccttcgtggtattcgacgttctcgtaacgtaaccgccgtggtacgtgacgtcgtcgggtcccgccgaggcctaccggaggggaacggggtcgngggtacgggttggggtcggtaccgtttaaagtaaaacggtaaccgtaaaacgtggtagttacggggtacggaactaaacgaagtaccgtaacgccgtacggacccgaaccggtaggaaacgacaacggtaacttcccgtacccgttactacggaaacgtaggtaaacgtaggttaaacgttaaaaccgaaaaaactcggtaacttaaggttaacttaaccgtaaaanaaacgtttaacgaaaacgtacgaacgtaacgtaaaacggaaaacccgggtaacgaaacgtaacccgtaacggttacccggtttaagtttaaccgttaagggtttacgggtaacggggttacaacgttaagggtttaacgggttaccgtttaaccgtttacccccggtaacggttccgggtaaacccgggaaccggttacccgttaccggtacgtaccccgttctacccggtacgtacccgttacccgaaccccgg

SEQ ID NO: 228685 - DNA, 576 bp, Homo sapiens
  misc_feature: GYAE6OF02IIRKV.34.35.D02.1.454.CMB.1.raw
  modified_base (205)..(205): a, c, t, g, unknown or other
  misc_feature (205)..(205): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (460)..(460): a, c, t, g, unknown or other
  misc_feature (460)..(460): n is a, c, g, or t
  modified_base (497)..(497): a, c, t, g, unknown or other
  misc_feature (497)..(497): n is a, c, g, or t
  modified_base (528)..(528): a, c, t, g, unknown or other
  misc_feature (528)..(528): n is a, c, g, or t
tcagtacacgtgatcacgaccggtgctcgatttagcacacgatagttgggtttgggggggagaggagccccagccttgggattcccaagtgttttcattcagtgatcaggactgaacacagaggactcaccatggagttgggctgagctggatttccttgctgctatttaaaaggtgtccagtgtgaggtgcagctggtggagtntggggagttggtaaagcgggggtcctaggactttctgtgagctctggattcagtntcagtaacgcctggatgagctggtccncagctccaggaagggctggagtggttgccgtataaagcgaaaactgaatgtaggacaaacnggactacgctgacacccgtgaaaaggcanagttcaccttcgcaagtanactgaactnaaaaaaacnccgntcgtaatcgtaacaaaattggaaacagacatagaaaaaccgnggtaaacacagtaccgtagtataattgacggggttanaacgtagtagtacgttaactacccgtaacgnggaccgaacggtaaccgtcgcgtaccgtctacctacgacaccctaccg

SEQ ID NO: 228686 - DNA, 831 bp, Homo sapiens
  misc_feature: GYAE6OF02JKQUO.34.35.D02.1.454.CMB.1.raw
  modified_base (134)..(134): a, c, t, g, unknown or other
  misc_feature (134)..(134): n is a, c, g, or t
tcagtacacgtgatcacgaccggtgctcgatttagcacacgatagttgggtttggggagctctgggagaggagccccagccttgggattcccaagtgttttcattcagtgatcaggactgaacacagaggactnaccatggagtttgggctgagctggtattttcctgctgctagtttaaagtgtccagtgtgagtgcagctggtgagtcgtaggggtaggtttaggtaaacgggtcccggggggttaccttaggtacctttccgtggtacggtacgccgttcgtaggtaacttcgacgttctacgaggtaaacctccgtaggtataggacgtcgtggggttcccaccgagggcctaccgagggggtaacgggcgtagggtggtcgggttcggaccgttaattaaaaggccaaaacgttggtaacttggggtagggtaaccaacgtaggacctacggacgtcggaccgacccggtaaggaaacgggacctaacggtactttccggaaccgttcctaaccggaaagtagtaacgtagtaaacgttaaccgaaaaaacggtacctacgttagtaaccgttaactaaccgtaaaacgtacggaaactacggtaaccgtaactaacggggaaaaccgtacgggtaaccgaccgtaaccgggtacgttaaccgtttaaagttacgggttaaccggaagggggttaccttaacgtacgggttaaacggtttaaccggtttaacgttaaccccggttaaccggtaccgggggtaaccccggtaaccgggtttaacccggaccgggttttaaccgaccccggtttacccgtaaccccgg

SEQ ID NO: 228687 - DNA, 868 bp, Homo sapiens
  misc_feature: GYAE6OF02HLXSO.34.35.D02.1.454.CMB.1.raw
tcagtacacgtgatcacgaccggtgctcgatttagcacacgatagttgggtttgggggggagaggagccccagccttgggattcccaagtgttttcattcagtgatcaggactgaacacagaggactcaccatggagtttgggctgagctggattttcctgctgctatttaaaggtgtccagtgtgaggtgcagcgtggtggagtcgtgggggtaggtttagggtaaacgggccgggggggttccttaggtacgttttaccgtggttggacgtcccgtacgtggtattcagtctacgacgtaaccgccgtaggatggacgcgtacgggtcccgccgagggtcctaccgggaaggggaacggggcgttaggggtacgggttgggggttcggtaccgttaaaggttaaaacggaactaaaaacgttggtaacggttacggggtaacgggaaccaaaacgtaacggtaaccgtacggacctacggaaccgtaacccgggtaaggaaaacggactaagtaccttaccgaaccgttctaacgaacgtagtagtacgtaaacttaaaccgaaaaactacgtacgttacgttaactaactaaacaaagtaacgaaacgtaagtaactaaacgtaaacggaaaaccgacgtaaccgaacgtaacgtacccggtaagtttaaacgttagttacgggttaacgggtacgtaacgttaaggtttacggtttaaccggtttaacccgtttaaccccgggttaaccgggtacccgggggtaacccggtaacccggggttaaccccggttaccgggttacccgttacccgggttaccccttaacccggttacccgtacccggtacccccgttaaaccccggg

SEQ ID NO: 228688 - DNA, 503 bp, Homo sapiens
  misc_feature: GYAE6OF01E2RVQ.33.85.H08.1.454.CMB.1.raw
  modified_base (198)..(198): a, c, t, g, unknown or other
  misc_feature (198)..(198): n is a, c, g, or t
  modified_base (481)..(481): a, c, t, g, unknown or other
  misc_feature (481)..(481): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggtcttggacgttcggccaagggaccaaggtgaaatcaaacgactgtggctgcacntctgtcttcatcttcccgcatc

SEQ ID NO: 228689 - DNA, 496 bp, Homo sapiens
  misc_feature: GYAE6OF01EC9G6.33.85.H08.1.454.CMB.1.raw
  modified_base (493)..(496): a, c, t, g, unknown or other
  misc_feature (493)..(496): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctggggacagacttcactctcaccatcagcagcctagagcctgaagattttgcagtttattactgtcagcagcgtagcaactggtcttggacgtttcggccaagggaccaaggtggaaatcaaacgactgtggctgcacatctgtcttcatcttcccgccatctgaagtgtgtgtactgagcgggctggcaaggcgcatagnnnn

SEQ ID NO: 228690 - DNA, 767 bp, Homo sapiens
  misc_feature: GYAE6OF01B6URM.33.85.H08.1.454.CMB.1.raw
  modified_base (237)..(237): a, c, t, g, unknown or other
  misc_feature (237)..(237): n is a, c, g, or t
tcagtacacacactcacgaccggtgctcgatttagtatcactcagtcgcgggggggaggaactgctcagttaggacccagagggaaccatggaagccccagctcagcttctcttcctcctgctacctcgtcggcctaccagactaccggaacgggtaattgtgtagacactgtccacacgccctaccgtgtttcttcgtcctacggaaaggggaaacgcgaccctaccctcctccgngacggacgggcctagtacgaaggtaggtcgcggtggacagtacctaaacgttcgccgttaacggtaaaaccaaaaaccgtaaaaccggtcggaaccaacggtaccctaccggaacggtcccttccactaacttcctagtaggactcgactaccacccaaccggacggacccaggtcggacctaccgacccgacgccgtaggtacagggtcggacgtaggggtcggtcggacggacacgtcctacacctcaccaactatacgacgacaccgtacgtaaggaccgtaccgtaaaggtaaacgtttcgttttacggaaacgttttaaggttttaacttacgttcggttaccgtgaccgtacgggttacgtaacgtaacctaaccggtccgtaacccttaaaccgtcccgtaccgggaaacggaacggaaccaaccggtagacgggtaaacttaaaacggtaaaccgtcgtagggtacgccgtacgaaccttaaccgtcttaccggttacgttcctttaccgcgtttccccccg

SEQ ID NO: 228691 - DNA, 494 bp, Homo sapiens
  misc_feature: GYAE6OF01EEAJZ.33.85.H08.1.454.CMB.1.raw
  modified_base (201)..(201): a, c, t, g, unknown or other
  misc_feature (201)..(201): n is a, c, g, or t
  modified_base (490)..(490): a, c, t, g, unknown or other
  misc_feature (490)..(490): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgctggcagcaacttagcctggtaccagcagacacctggccagactcccaggctcctcatctatgatgcatccaccagggccactggcatcccagccaggttcagtggcagtgggtctgggacagacttcactctcaccatcagcagcctagacgcctagaagtattttgctagtttattactgtctgcagcgtagcaactggacctaacaccttcggcaagggcacgacgtggagattaaacgactgtcgctgacaccntctg

SEQ ID NO: 228692 - DNA, 508 bp, Homo sapiens
  misc_feature: GYAE6OF01D5NRG.33.85.H08.1.454.CMB.1.raw
  modified_base (485)..(485): a, c, t, g, unknown or other
  misc_feature (485)..(485): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaagagccaccctctcctgcagggccagtcagagtgttagcgggtacctagcctggtaccaacagagacctggccaggctcccaggctcctctctatgatgcatccaacagggccactggcatcccagccaggttcagtggcggtgggtctgggacagacttcactctcaccatcagcagccctagagcctgaagtattttgctagtttattactgtcagcagcgtagcaactggtcttggacgttcggccaagggaccaaggtggaaatcgaaacgactgtggctgcacntctgtcttcatccttcccgcatc

SEQ ID NO: 228693 - DNA, 489 bp, Homo sapiens
  misc_feature: GYAE6OF01B0PYD.33.85.H08.1.454.CMB.1.raw
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggtcttggacgttcggccaagggaccaaggtggaaatcaaagactgtggctgcacatctgtctcatcttcccgctatctgaagtgtgtgtactgagcgggctggcaaggcgcatagcngn

SEQ ID NO: 228694 - DNA, 569 bp, Homo sapiens
  misc_feature: GYAE6OF01B1H7Q.33.85.H08.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccaccggagaaattgtgttgacacagtctccggccaccctgtctttgtctccgaggggaaangccaccctctcctgcagggccagtcagagtgttagcgggtacctagcctggaccaanagagacctggccaggctccaggctcctctctatgatgcatccaacgngggccacgtggcactcccagccaggttcaggtggcggtggtctgggacagacttcactctcacatcagcagcctagacgctagaagtattttgactagtttattactgtacagtcagtcgtagactaacgtggtcgttggtacggttcggaccgtaagggacctaaagggtacggaaacgtaccgaaaacgtacgtaggtacggacgtcgaccacctagttccgttacgttacctttacgtacttacccgttccccgcctacgttcg

SEQ ID NO: 228695 - DNA, 508 bp, Homo sapiens
  misc_feature: GYAE6OF01AGNQS.33.85.H08.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (483)..(483): a, c, t, g, unknown or other
  misc_feature (483)..(483): n is a, c, g, or t
  modified_base (505)..(505): a, c, t, g, unknown or other
  misc_feature (505)..(505): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcgggtacctagcctggtaccaacngagacctggccaggctcccaggctcctcttctatgatgcatccaacaggccactggcatcccagccaggttcagtggcggtggtctgggacagacttcactctcaccatcagcagcctagagcctgaatatttgctagtttatactgtcagcagcgtagcaactggtcttggacgttcggaccgaagggaccaagggtagaatacgaaacgactgtggctgcacntctgtcttcactcttcccgctntcg

SEQ ID NO: 228696 - DNA, 504 bp, Homo sapiens
  misc_feature: GYAE6OF01AIV48.33.85.H08.1.454.CMB.1.raw
  modified_base (340)..(340): a, c, t, g, unknown or other
  misc_feature (340)..(340): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (501)..(502): a, c, t, g, unknown or other
  misc_feature (501)..(502): n is a, c, g, or t
  modified_base (504)..(504): a, c, t, g, unknown or other
  misc_feature (504)..(504): n is a, c, g, or t
tcagtacacacactcacgaccggtgctcgatttagtatcactcagtcgcgggggggagggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcatccatggtgcatccaccagggcccactggcatcccagacaggttcagtggcagtgggtctgggacagacttcattctcaccatcagcagactggagcctagaagtntttgcagtgtattactgtcagcgagtagtagttcatctcgacgttcggctaagggacaaggtagaaatacgaaacgacgtgtcgcgtgcacntcgtntctcatcctccgctatctgacgtgtgtgtacgtgaggcggtctggacaagggcgtacaagtggnngn

SEQ ID NO: 228697 - DNA, 524 bp, Homo sapiens
  misc_feature: GYAE6OF01DPJQO.33.85.H08.1.454.CMB.1.raw
  modified_base (255)..(255): a, c, t, g, unknown or other
  misc_feature (255)..(255): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
  modified_base (520)..(524): a, c, t, g, unknown or other
  misc_feature (520)..(524): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacagagacctggccaggcctcccaggcctcctcttctatgatgcatccaanaggggccactggcactcccagccaggttcaggtggcggtgggtctgggacagacttcactctcaccatcagcagcctagagcctagaagtattttgactagtttattactgtcagcagtacggtagttcatctccgtacgttcggaccaagggaccaaggtaggaaatacgaaaacgaatgtggctagacaccatctgtcttcactccttcccgcattctagaagtgtgtntacgtggaggtcgggntggcaagggcncgatagnnnnn

SEQ ID NO: 228698 - DNA, 565 bp, Homo sapiens
  misc_feature: GYAE6OF01A35KV.33.85.H08.1.454.CMB.1.raw
  modified_base (199)..(199): a, c, t, g, unknown or other
  misc_feature (199)..(199): n is a, c, g, or t
  modified_base (517)..(517): a, c, t, g, unknown or other
  misc_feature (517)..(517): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaagngccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctagaagtattttgctagtttattactgtacagcagcgtagcaactggtcttggacgttcggaccgtaagggacctaagggtacggaaataccggaaaacgtaacgttggtacgggacgtcggaccaacccgtnttaccgtggttacctttaccactttaccccttccccgcctagttaccg

SEQ ID NO: 228699 - DNA, 524 bp, Homo sapiens
  misc_feature: GYAE6OF01B5JC7.33.85.H08.1.454.CMB.1.raw
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccatggcatcccagccaggttcagtggcggtgggtctgggacagacttcactctcaccatcagcagcctagagcctgaagtatttgctagtttatactgtcagcagtcgtagcaacgtggtcttggacgtttcggaccgaagggacctaagggtacggaaatacgaaaacgaactggtaggctgaccaccatccgtgtccttacacttccttcccgctatctagaagtgtgtgtactgagcgggctggacgaaggcgtacagtagcntgn

SEQ ID NO: 228700 - DNA, 491 bp, Homo sapiens
  misc_feature: GYAE6OF01DWP13.33.85.H08.1.454.CMB.1.raw
  modified_base (473)..(473): a, c, t, g, unknown or other
  misc_feature (473)..(473): n is a, c, g, or t
  modified_base (489)..(491): a, c, t, g, unknown or other
  misc_feature (489)..(491): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtggtctgggacagacttcactctcaccatcagcagcctagagcctgaagattttgctagtttattactgtctgcagcgtagcaactggcctaacaccttcggaccaagggacacgactaggagattaacgactgtggctgcacatctgtctcatcttcccgcatctgaagtgtgtgtactgagcgggntggcaaggcacatagnnn

SEQ ID NO: 228701 - DNA, 511 bp, Homo sapiens
  misc_feature: GYAE6OF01AV5XY.33.85.H08.1.454.CMB.1.raw
  modified_base (368)..(368): a, c, t, g, unknown or other
  misc_feature (368)..(368): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (503)..(503): a, c, t, g, unknown or other
  misc_feature (503)..(503): n is a, c, g, or t
  modified_base (509)..(511): a, c, t, g, unknown or other
  misc_feature (509)..(511): n is a, c, g, or t
tcagtacacacactcacgaccggtgctcgatttagtatcactcagtcggcgggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacaggacttcgactctcaccatcagcagcctagagcctgaagtattttgctagtttattactgtctgcagcgtanctaacgtggacctaactccgttcggaccaagggacacgacgtaggagtaactaacgactgngtctgctacntntgtcttacattccgtccgctatctagagttcgtgtagtactggacgcggtctggacaggtcncagtcnnn

SEQ ID NO: 228702 - DNA, 504 bp, Homo sapiens
  misc_feature: GYAE6OF01D4FSN.33.85.H08.1.454.CMB.1.raw
  modified_base (501)..(504): a, c, t, g, unknown or other
  misc_feature (501)..(504): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacaggggccactggcatcccagccaggttcagtggcggtgggtctgggacagacttcactctcaccatcagcagcctagagcctgaagtattttgctagtttattactgtcagcagcgtagcaactggtcttggaccgttcggaccaagggaccaagggtggaaactcgaaacgactgtgctgcacatctgtcttcactcctcccgccatctgaagtgtgtgtactggagcgggctggacaggcgcagtagnnnn

SEQ ID NO: 228703 - DNA, 598 bp, Homo sapiens
  misc_feature: GYAE6OF01CNZJ3.33.85.H08.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
  modified_base (513)..(513): a, c, t, g, unknown or other
  misc_feature (513)..(513): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccaccggagaaattgtgttgacacagtctccggccaccctgtctttgtctccaggggaaangccacctctcctgcagggccagtcagagtgttagcgggtacctagcctggtaccaacngacgacctggccaggctcccgaggctcctcttctatgatgccatccaacgngggtccactcggcactcccaagtcccgtaggttccgaggtcgggcgggtggtcgtaggggactaggtactttcgacctctacacatcagcacgcctagacgccgtagaagttatttgacttaagttttaattacgtgtactaggctagtcgtagactaacgttcggtcgttcggtacggttcggaccgaagggtaaccaaggggtanaaacgtacgaaacgtacgtggtaggacgtcgaccaactcgttacgttcgttaccttacgtacttcccgttacccgctacgttacg

SEQ ID NO: 228704 - DNA, 540 bp, Homo sapiens
  misc_feature: GYAE6OF01CQ42H.33.85.H08.1.454.CMB.1.raw
  modified_base (206)..(206): a, c, t, g, unknown or other
  misc_feature (206)..(206): n is a, c, g, or t
  modified_base (453)..(453): a, c, t, g, unknown or other
  misc_feature (453)..(453): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaanagagacctggccaggcctcccaggctcctcttctatgatgcatccaacgaggggccactggcactcccagccaggttcagtggcggtgggtcgtgggacagacttcactctcaccatcagcagcctagacgcctagaagtattttgacttagtttattactgtcagcagcgtagcaacgtggtctggacgttcggaccgtaagggacctaaggtagaaatacgaaatagaactggtcgctgacactntctcgtcttactacttccttcccgctagtctagtaagttgtgttgtacgtggacggcgggtctcggacgaacggtcactagngnngn

SEQ ID NO: 228705 - DNA, 497 bp, Homo sapiens
  misc_feature: GYAE6OF01DCMHB.33.85.H08.1.454.CMB.1.raw
  modified_base (253)..(253): a, c, t, g, unknown or other
  misc_feature (253)..(253): n is a, c, g, or t
  modified_base (491)..(491): a, c, t, g, unknown or other
  misc_feature (491)..(491): n is a, c, g, or t
  modified_base (495)..(497): a, c, t, g, unknown or other
  misc_feature (495)..(497): n is a, c, g, or t
tcagtacacacactcacgaccggtgctcgatttagtatcactcagtcgcgggggggaggaactgctcagttaggacccagagggaaccatggaatccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaaacngggccatggcatcccagccaggttcagtggcggtgggtctgggacagacttcactctcaccatcagcagcctagacgcctgaagtattttgctagtttattactgtcagcagcgtagcaactggttcttggacgttcggaccgaagggaccaagggtgaaatacaaacgactgtggctgcacatctgtctcatcttccgctatctgaagtgtgtgtatgaggcgggctggcaaggcgnatgnnn

SEQ ID NO: 228706 - DNA, 747 bp, Homo sapiens
  misc_feature: GYAE6OF01BYY0Z.33.85.H08.1.454.CMB.1.raw
  modified_base (423)..(423): a, c, t, g, unknown or other
  misc_feature (423)..(423): n is a, c, g, or t
  modified_base (741)..(742): a, c, t, g, unknown or other
  misc_feature (741)..(742): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
tcagtacacacactcacgaccggtgctcgatttagtatcactcagtcgcgggggggaggaactgctcagttaggacccagagggaaccagtggaacgccccagctcagtcttctcttcctcctgctactcgtggcctaccggaaggggaaagacgcccaccctctcctgcgacgggccagtcagtagttgttaggcgggtacctagccgtaggtaaccaacgagacgaccgtcggaccaggcctcccgaggtccttccttcttactagtgatcgactactacccgaaacgcgggaccctacgtcggacctacctcccgaacgccgtaacggttccaggtcgggcgggttcgggtcgtggggacaagtaccttccacgtcctaccacctactcacgcacgccgtaagacgtccgtagaacgttnttttcgacttaagtttacttacgtgtacagcgagtacgtagacgtaacgttcggttcgttaggtaccggtttccggaaccggtaaacgggtaacccgtaaagggtaacgtaaaacgtaaccgaaaaaccggtacgtaggtacggtccgttacgaccctaaccgtaatttccgttacggtttacctttacctaaccgtttccccgttacccccgtaccttaacgttccgttagtaacggttcggttacggttacgttaccggtagggtacgggtccgggtacgttcgggaccgtaaacgggccgtaacgtaagttaggnngngng

SEQ ID NO: 228707 - DNA, 610 bp, Homo sapiens
  misc_feature: GYAE6OF01ANDAW.33.85.H08.1.454.CMB.1.raw
  modified_base (256)..(256): a, c, t, g, unknown or other
  misc_feature (256)..(256): n is a, c, g, or t
  modified_base (320)..(320): a, c, t, g, unknown or other
  misc_feature (320)..(320): n is a, c, g, or t
  modified_base (606)..(606): a, c, t, g, unknown or other
  misc_feature (606)..(606): n is a, c, g, or t
tcagtacacacactcacgaccggtgctcgatttagtatcactcagtcgcggggggggagggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggcctcctcttctatgatgcatccaacgngggcccatggcactcccagccaggttcaggtggcggtgggtctggggacagtacttcacttccncaccatccagcagcctagacgtcctagaagtattttggacttaggtttacttacgttgtctagcagtcgtatacctaacgtcggaccctaacgtacccgttcggaccgaacgggaccacggtacgtagggtaacgtaaacgttaaaccgaacgttggtacggacctcgaccaacctagttccgtgttaccttaccactttcccttccccgactattcgtagtagttcggttgtcgtacgtggtacggccgggtctcgggaaccgtaagggtccgtacgtaagtggntgag

SEQ ID NO: 228708 - DNA, 691 bp, Homo sapiens
  misc_feature: GYAE6OF01DU3TM.33.85.H08.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgctggcagcaacttagcctggtaccaanatagacctgaccaggctccgaggcctcctcatctacgatcggccgtaccaacgacgggcccacgtcgggaccacgtccccagcccagggttcaggttcggactaggttcgggtctaggggactaggtacctttcaccttcgtaccaacctattaccgaacgaccctaaacccgtaaggtaaacctttaggtaaaacgtttactttttttaaccaagtttttttaactttaaccgttgttaacctaaactaacgtttaccgaaaccgggtctaacggtccgttacgggtccccttacgttacccgttaaccggttttccgggacgggttaacgggtaacccgtaagggtcggacgtaccgtaccgaaaacgtacgtcggtaggaccttggaccacctagttccgttacgttaccttactacttcccgttaccccg

SEQ ID NO: 228709 - DNA, 516 bp, Homo sapiens
  misc_feature: GYAE6OF01EWBYC.33.85.H08.1.454.CMB.1.raw
  modified_base (247)..(247): a, c, t, g, unknown or other
  misc_feature (247)..(247): n is a, c, g, or t
  modified_base (472)..(472): a, c, t, g, unknown or other
  misc_feature (472)..(472): n is a, c, g, or t
  modified_base (497)..(497): a, c, t, g, unknown or other
  misc_feature (497)..(497): n is a, c, g, or t
  modified_base (511)..(512): a, c, t, g, unknown or other
  misc_feature (511)..(512): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcagcaactacttagcctggtaccagcagacacctggccaggcctcccaggcctcctcatccatggtncatccaccagggccactggcatcccagacaggttcagtggcagtgggtctggggacagacttcactctcaccatcagcaacctagaacttgaagtatttttcatttttattactgtactaaactatcaacggcaagtctggcccttctcctacgtttcgggcggtagggaccaagggtgagctacaaacgactggtagctgcaccatctgtcttcattcttcccnctatctgaagtgtgtgtactgacgnggtctggacaggcnngtag

SEQ ID NO: 228710 - DNA, 593 bp, Homo sapiens
  misc_feature: GYAE6OF01EN8X1.33.85.H08.1.454.CMB.1.raw
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtacaaacagagacctggccaggcctcccaggcctcctcttctatgatgcatccaacgagggccactggcactcccagccaggttcagtggcggtggtctgggacagacttcactctcacatcagcagcctagacgcctagaagtatttgactagtttatactgtcagcagcgtagctaacgtggttcttggacgttccggacgaacgggaccgtaaaggtaggaaatacgaaaacgacgtggtacgctacgaccactactctcgtctttacgactttcccgttccccgtacctacttccgtaggtaacgttcggttacgttagtaaccgttgggtaacgggtcccggggtacttacggggaccgtaaagggcccggtactaagttaaggnngngn

SEQ ID NO: 228711 - DNA, 580 bp, Homo sapiens
  misc_feature: GYAE6OF01A388S.33.85.H08.1.454.CMB.1.raw
  modified_base (199)..(199): a, c, t, g, unknown or other
  misc_feature (199)..(199): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaaangccaccctctcctgcagggccagtcagagtgttagcggtacctagcctggtaccaacagagacctggccaggctcccaggctcctcttctatgatgcatccaacacgggccacgtggcactcccagccaggttcagtggcggtggtctgggacagacttcactctcacatcagcagccctagacgcctagaagtattttgactaagttttacttactgtacagtccagtcgtacgctaacgttggttcgttggaccggtttccggaccgtaaacggggtaacctaagggtacggaaacttacgaaaacgtaacgtcggtaggtaccgtggaccaccgtacttcgtacgttacttcacttacccttcccgtcctcgttaccg

SEQ ID NO: 228712 - DNA, 669 bp, Homo sapiens
  misc_feature: GYAE6OF01AGWEG.33.85.H08.1.454.CMB.1.raw
  modified_base (205)..(205): a, c, t, g, unknown or other
  misc_feature (205)..(205): n is a, c, g, or t
  modified_base (257)..(257): a, c, t, g, unknown or other
  misc_feature (257)..(257): n is a, c, g, or t
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
tcagtacacacactcacgaccggtgctcgatttagtatcactcagtcgcgggggggagggaacgtgctcagttaggacccagagggaaccatggaagccccagctcagcttctcttcctcctgctactctggctccaggggaaagagcccaccctctcctgccagggccagtcagagtgtagcgggtacctagcctggtaccaangagaccctggccaggcctcccaggctcctcttctatgatgcatcccaaacgnggcccatggcatcccagccaggttccagtggcggtggtcgtggacagaccttcactctcacctatcagcgagcctaagacgccctaggaagtacgttttgacttaaggttttacttaacgttgtaccaaggtcctaggtcgttaacggcctaaacggttcgggtttccgtttagggtaccggtttccggaccccgtaaaggggtaacccgtaaggggtaacggtaaactaacggtaaaacgtacgttagggnggtaccgtagcctaaaccgtnttaccgtggtttccttaccgtacttccctttacccccggaccttacgttaccgtaggtaacggttgtaacggtttcgtaacgtcgggtacggtccgggacggttggacccgaacgggtcggtactagaggctagtgtcg

SEQ ID NO: 228713 - DNA, 606 bp, Homo sapiens
  misc_feature: GYAE6OF01CHD5F.33.85.H08.1.454.CMB.1.raw
  modified_base (199)..(199): a, c, t, g, unknown or other
  misc_feature (199)..(199): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaaanagccaccctctcctgcagggccagtcagagtgttagcgggtacctagcctggtaccaacagagacctggccagactccaggctcctcatctatgatgcactccaccgagggcccacgtcggcactcccagcctaggttcaggtggcaggtgggtcgtagggacacgtactcactctacacctatcagcagcctagacgccgtagtaagtagttttacgacttaagttttattacgttgtcgtgctagcgtagaccaacgtcggacctaaccgtaccgttaccggaccgtaacgggaccaaccggtacgtagggaacgtaaacgttaaaccgaacgttcggtacggaccgttacgacccgtaaccgtacgttacctacgttaccttccgtacgttccccgttaccccg

SEQ ID NO: 228714 - DNA, 580 bp, Homo sapiens
  misc_feature: GYAE6OF01C60VW.33.85.H08.1.454.CMB.1.raw
  modified_base (327)..(327): a, c, t, g, unknown or other
  misc_feature (327)..(327): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctggggacagacttcactctcaccatcagcagcctagancctagaagtattttgactagtttattactgtcagcagcgtagcaactgggtcttggacgtttcggaccgaaaggggtaacccaaagggtacggaaaatacgaaaaacggaacttaggtgggacgtgaccgaacctagttcctgttcttccacttacccgtttccccgacctacttcctaggtaagttcggtgttagtaaccgttggtaacggccggggtctggggacaaaggggccgacgtaataggnngngn

SEQ ID NO: 228715 - DNA, 522 bp, Homo sapiens
  misc_feature: GYAE6OF01DKVHL.33.85.H08.1.454.CMB.1.raw
  modified_base (199)..(199): a, c, t, g, unknown or other
  misc_feature (199)..(199): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaaanccaccctctcctgcagggccagtcagagtgttagcgggtacctagcctggtaccaacagagacctggccaggctcccaggcctcctcttctatgatgcatccaacagggccactggcatcccagccaggttcagtggcggtggtctgggacagacttcactctcaccatcagcagctggacgcctagaagtatttgctagtgtattactgtcagtcagtatacgtgggagacgttcggaccgaagggaccgaagggtaggaaatacgaaacgacgtgtggctgacacgtatctgtcttcatccttcccgactatctgtaagtg

SEQ ID NO: 228716 - DNA, 484 bp, Homo sapiens
  misc_feature: GYAE6OF01ALEKE.33.85.H08.1.454.CMB.1.raw
  modified_base (242)..(242): a, c, t, g, unknown or other
  misc_feature (242)..(242): n is a, c, g, or t
  modified_base (478)..(478): a, c, t, g, unknown or other
  misc_feature (478)..(478): n is a, c, g, or t
  modified_base (482)..(484): a, c, t, g, unknown or other
  misc_feature (482)..(484): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcatccatggtncatccaccagggccactggcatcccagacaggttcagtggcagtgggtctgggacagacttcattctcaccatcagcagactggagcctgaagattttgcagtgtattactgtcagcagtacgtagttcatctcgacgttcggccaagggaccaaggtgaaatcaacgactgtgctgcacatctgtctcatcttcccgctatctgaatgtgtgtacgtgagcgggctggcaaggcnatgnnn

SEQ ID NO: 228717 - DNA, 649 bp, Homo sapiens
  misc_feature: GYAE6OF01DGIMX.33.85.H08.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (396)..(396): a, c, t, g, unknown or other
  misc_feature (396)..(396): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccaccggagaaattgtgttgacacagtctccggccaccctgtctttgctccgaggggaaangccaccctntcctgcagggccagtcagagtgttagcgggtacctagcctggtaccaacagagacctggccaggcctccgaggcctcctcttctatgatgcatccaacgcggccatggcactcccagccaggttcaggtcggcggtgggtctgggacagacttcactctcacatcagcagtcctagacgcctagtaagtnttttacggacttaagttttaacttacgttagtactaggtactacggtacgttaagaccgtaacgttcgggttaccgttttggggtaacccggtttaccgggaacccgtaaacggggtaaccgtaaacggggttaaggtaaaccgtaacgaaaacggtaacgttacgggtacggtacgtacgacggtaaccctagttccgtacggtttaccttacccgtacttaccccggtttaccccgaccctacgttaccgg

SEQ ID NO: 228718 - DNA, 551 bp, Homo sapiens
  misc_feature: GYAE6OF01BLFI7.33.85.H08.1.454.CMB.1.raw
  modified_base (198)..(198): a, c, t, g, unknown or other
  misc_feature (198)..(198): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagtacacacactcacgaccggtgctcgatttagtatcactcagtcgcggggaggaactgctcagttaggacccagagggaaccatggaagccccagcgcagcttctcttcctcctgctactctggctcccagataccaccggagaaattgtgttgacacagtctccggccaccctgtctttgctccgaggggaaangccaccctctcctgcaggccagtcagagtgttagcgggtacctagcctggtaccaacgagagacctggccaggctcccgaggtctcctcttctatgatgcatccaagcggccacgtggcactcccagcctaggttcagtggcggtggtctgggacngacttcactctcactncagcagcctagacgctagaacgtntttgcttagtttactacgtntacagcagcgtagctaagtggtacttggacgttcggacgtaaggaccgtaaggtacgaaatacgaaacgtacgtgtacggcgtggaccacgtattccgtacgttaccgttacacgttccttaccccggctgttaccg

SEQ ID NO: 228719 - DNA, 606 bp, Homo sapiens
  misc_feature: GYAE6OF01BQJKN.33.85.H08.1.454.CMB.1.raw
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacagagacctggccaggcctcccaggcctcctcttctatgatgcatccaacgacggggccactggcactcccagccaggttcaggtggcggtgggtctgggacaggtacttcactctcaccatcagcagcctagacgcctagaagtattttgacttagtttactacgtgtcagcagtcgtagactaacgtggttcgttgggtacggttcggaccgtaacgggaccgtaaagggtaacggaaactaaccgaaacgtacgtggtacggcgtagaccacctatccgtcgttccttacctacgttcccttaccccgtacctacgttccgtagtaacgttggttacgttacggttacgtggacgggtcgggtacgttcgggacgtaacgggcgtacgagtagcnngng

SEQ ID NO: 228720 - DNA, 511 bp, Homo sapiens
  misc_feature: GYAE6OF01CPV0A.33.85.H08.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
  modified_base (508)..(508): a, c, t, g, unknown or other
  misc_feature (508)..(508): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcgggtactagcctggtaccaangagacctggccaggctcccaggctcctcttcatgatgcatccaacagggccactggcatcccagccaggttcagtggcggtggtctgggacagacttcactcncacntcagcagcctagngcctagaagtatttgctagtttattactgtcagcagcgtagctaacgtggtcttggacgttcggactaagggaccaaggtaggaatacgaaacgtactgnggctgacactntctgtcttcatccttccgctntcg

SEQ ID NO: 228721 - DNA, 668 bp, Homo sapiens
  misc_feature: GYAE6OF01DILT7.33.85.H08.1.454.CMB.1.raw
  modified_base (663)..(664): a, c, t, g, unknown or other
  misc_feature (663)..(664): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagtacacacactcacgaccggtgctcgatttagtatcactcagtcgcggggggggaggaactgctcagttaggacccagagggaccatggaagccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaagacgggccactggcactcccagccaggttcaggtggcggtgggtctggggacgagttctctactccaccgactacgacgacacgacgtacgagtaccgtacgtaagtaagtttagttacgtaagtttacgttttaacgtacgttcgtacgacgacgtaggtacgtacgacgttaacggtcggttacggtacggtaccggtaccggtaacggacgggtaaacggtaaggtaaacgtaacgtaacgtaaacggtacgtggtacgtcgtacacctacgttacgtcgttcttaccgtacttaccttcccgtacccgacttacgttacgtaaggttaggttacggttcgttacggtacggttacggggaaccgggtgggtccggttaaacgggaacggtaccggacgtacgtaagtgnngngn

SEQ ID NO: 228722 - DNA, 568 bp, Homo sapiens
  misc_feature: GYAE6OF01A6MMW.33.85.H08.1.454.CMB.1.raw
  modified_base (197)..(197): a, c, t, g, unknown or other
  misc_feature (197)..(197): n is a, c, g, or t
  modified_base (530)..(530): a, c, t, g, unknown or other
  misc_feature (530)..(530): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaangccaccctctcctgcagggccagtcagagtgttagcgggtacctagcctggtaccaacagacgacctggccaggcctcccgaggcctcctcttctatgatgcatccaacgacgggccacgtggcactcccagccaggttcaggtggcggtgggtctgggacagtacttcactctcaccatcagcacgcctagacgcctagaagtatttgacttagtttattacgtgtcagcgagtcgtagctaacgtggtcgttggtaccggttcggaccgtaacgggaccgtaagggtaggaaacgtacgaaacggtacgtggtacggcgtcgaccaccgtnttcgttcgttacttactacttccctccccgtctagtcg

SEQ ID NO: 228723 - DNA, 515 bp, Homo sapiens
  misc_feature: GYAE6OF01CZL65.33.85.H08.1.454.CMB.1.raw
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (511)..(514): a, c, t, g, unknown or other
  misc_feature (511)..(514): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaaangggccatggcatcccagccaggttcagtggcggtggtctggacagacttcactctcacatcancagcctagagcctagaagtnttttgctagtttattactgttcagcagtcgtagcaacgtggtcttaggacgtttcggccaagggaccaaaggtggaaaatcgaaacgatgtaggctagccacatcgtgtcttcacttcctcccgctactctgaagttgtgtgttactggacgtcgggctggacgaggcgataagtnnnng

SEQ ID NO: 228724 - DNA, 516 bp, Homo sapiens
  misc_feature: GYAE6OF01BCQ97.33.85.H08.1.454.CMB.1.raw
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagtattttgctagtttattactgtcagcagcgtagcaacgtggtcttgggacgtttcgggaccgaagggacccaaagggtaggaaatacgaaaacggactggtgctagcacatctgtcttcatccttcccgctatctgtaagtgtgtgtactggcgtcggctggcgaggcgcatagnngngn

SEQ ID NO: 228725 - DNA, 609 bp, Homo sapiens
  misc_feature: GYAE6OF01D2BF5.33.85.H08.1.454.CMB.1.raw
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccacgtggcactcccagccaggttcaggtggcggtgggtctgggacagacttcactctcaccatcagcagcctagacgcctagaagtattttgctagtttattactgtcagcagcgtagctaacgttggttcttcgggacgtttccgggaccgtaaaggggacccgtaaagggtacggaaaacttacgaaaaccggtaacgtaggtacggcctgacccacctattccgtgttccttaccacttcccttaccccgcctacgttccgtaggtaacgttggttgttacgtacgtcgggacggtccggggtcgttacgggaccgaaacgggcccgtaacgtaagttaagggctgtgcg

SEQ ID NO: 228726 - DNA, 707 bp, Homo sapiens
  misc_feature: GYAE6OF01DKSU3.33.85.H08.1.454.CMB.1.raw
  modified_base (703)..(704): a, c, t, g, unknown or other
  misc_feature (703)..(704): n is a, c, g, or t
  modified_base (707)..(707): a, c, t, g, unknown or other
  misc_feature (707)..(707): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccaggggaaagagccaccctctcctgcagggccagtcagactgttagcagcggcttctagcctggtaccagcaagaacctggccaggcctcccgaggcctcctcctctagtggtcgctactcccacgacgggccacgtcgcacctccgagacgtaggtacaggtcggacgtagggttcgggtcgtacgggactaacgtacctttacgtacccttcctaccaacctagtaccgaacgacgtacgtagggaccgccgttaaggtaaagtttacgttttcgacgtaacgtttactttaacttaaccgtcgttacgagtcgtaaagttacgtacgggtaggggtacgtacgggtaccggaacggacgggaaaccgtaagggtaaacggtaaactaacgtaaaaccgacgttagggtacgtacggtcacccgaactttacgtcgttcgtttacctactttaccttccccgtaccccgacttacttagtaacggttacggttgttacggttacgtacggtacgggtccgggtacgggtcggttggaaccgggaggtaccgaagttaacggagtnntgn

SEQ ID NO: 228727 - DNA, 566 bp, Homo sapiens
  misc_feature: GYAE6OF01CIFEU.33.85.H08.1.454.CMB.1.raw
  modified_base (199)..(199): a, c, t, g, unknown or other
  misc_feature (199)..(199): n is a, c, g, or t
  modified_base (398)..(398): a, c, t, g, unknown or other
  misc_feature (398)..(398): n is a, c, g, or t
  modified_base (546)..(546): a, c, t, g, unknown or other
  misc_feature (546)..(546): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctcccggccaccctgtctttgtctccaggggaaangccaccctctcctgcagggccagtcagagtgttagcgggtacctagcctggtaccaacagagacctggccaggcctcccaggcctcctcatccatggtgcactccaccagggccacgtggcatcccagacaggttcagtggcaggtggtctgggacagacttcactctcaccatcagcagcctagcgcctgaggattcngtctagtttattactgtcagcacgtcgtctacacgtcggccttccgtcgacctacccgttccgggaccgtaaggggaccacggtattcgggaagtaagtttaacggaaccggtaacgttgggtcggtactcggtaccctaccccgttnttccgttctttccgtacccg

SEQ ID NO: 228728 - DNA, 541 bp, Homo sapiens
  misc_feature: GYAE6OF01B3UFV.33.85.H08.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaagngccaccctctcctgcagggccagtcagagtgttagcgggtacctagcctggtaccaanagagacctggccaggctcccaggctcctcttctatgatgcatccaacngggccacgtggcatcccagccaggttcagtggcggtgggtctgggacaggacttcactctcaccatcagcagcctagacgcctagaagtattttgctaagtttattactgtcagcagcgtagctaacgtggtcttggaccgttcggaccgtaagggacctaagggtagaaactacgaaacgtacgtgtaggcgtggacacctagtcgtgttaccttcacttcccttcccgctatcg

SEQ ID NO: 228729 - DNA, 767 bp, Homo sapiens
  misc_feature: GYAE6OF01D61ZM.33.85.H08.1.454.CMB.1.raw
tcagtacacacactcacgaccggtgctcgatttagtatcactcagtcgcggggaggaactgctcagttaggacccagagggaaccatggaagccccagctcagcttctcttcctcctgctactctggctcccagataccaccggggaattgtgttgacacagtctccagcccaccctgttctttgtcctccgaggggaaagacgcccaccctctcctgcgagggccagtcagagtgctggcagcaacttagcctaggaaccaaacaaaacctggaccagacctcccgaggcctcctcatctatgatgacactcccaccgagggcccacgtcggccactccccgagcccgtaagggttcaggtggacgtaggttcggggtcgtaggggacacggtacctttcaccttctaccaacctatccagccaacggtccctaaggaccgtcccttaggtaaacgtttactttttacggacctttaaggttttttaactttaaccgtttcgggttccttacgggtacccttaagggttacccggttaacgacccgttaaaccgggttccgggtaaacccccttaaacccgttaccccggttttacccggggaaccccgtaaacgggggaccctaaccgggtaaccggttacggggaaacgttaaaaccgttttaaaaacccgggaacgtttacggggacgggtaccttaccgggtaacccctaaccccttagttacccgtttaggtttacccctttacgtaccgtttaccccccg

SEQ ID NO: 228730 - DNA, 504 bp, Homo sapiens
  misc_feature: GYAE6OF01BSYF6.33.85.H08.1.454.CMB.1.raw
  modified_base (477)..(477): a, c, t, g, unknown or other
  misc_feature (477)..(477): n is a, c, g, or t
  modified_base (500)..(501): a, c, t, g, unknown or other
  misc_feature (500)..(501): n is a, c, g, or t
  modified_base (503)..(504): a, c, t, g, unknown or other
  misc_feature (503)..(504): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagatttgcagtgtattactgtcagcagtacggtagttcatcctccgacgttccggccgaagggaccaaggtggaaatacaaacgaactgtggctgcacatctgtcttcatccttccgcctactctgaagtgtgtgtacgtgagngggctggcgaagggcgacatagnngnn

SEQ ID NO: 228731 - DNA, 600 bp, Homo sapiens
  misc_feature: GYAE6OF01BX86J.33.85.H08.1.454.CMB.1.raw
  modified_base (338)..(338): a, c, t, g, unknown or other
  misc_feature (338)..(338): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggcctcccgaggggaaagagcccaccctctcatgcagggccagtcagagtatagcatcttcttggcctggtaccaacagaaacctggccaggcctcccaggctcctcatccagaatgcattcaacgaggccactggcactccagccaggtcagtggcaggtgggtctgggacagacttcactctcacatcagcagctagcgctgagtntcgtgcttagtttactactgacagctaggtctctacgacgtcggcctccgtgccctaccggttcgaccgtaaggaccacgtagttacggagtacgtacgtaacgtaacgtggtacggtacgtcgacccgtacccgttcgttacgttcccgttacttcccttcccgttacccccgaccttacttacccggtaggttaaggttcggttacggtcgttacgttcgggtaccggtcgggtacggtcgggaacccggtagggtaccg

SEQ ID NO: 228732 - DNA, 556 bp, Homo sapiens
  misc_feature: GYAE6OF01C4CWG.33.85.H08.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (550)..(550): a, c, t, g, unknown or other
  misc_feature (550)..(550): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtactagcctggtaccaacngagacctggccaggctcccaggctcctcttctatgatgcatccaagnggccactggcatccccagcccaggttcaggtggcggtggtctggggacagacttcactcncaccntcagcagcctagacgtcctgaagtattttcgacttagtttattactgtcagcagtcgtagcaacgtggttcttgggaccgttcggaccgtaagggacccaagggttaggaactacgaaaacgtacgtaggtcggactcgaccacctaagttcctgttacttcgtaacttccttaccccgctnttaccg

SEQ ID NO: 228733 - DNA, 721 bp, Homo sapiens
  misc_feature: GYAE6OF01DKNFR.33.85.H08.1.454.CMB.1.raw
  modified_base (146)..(146): a, c, t, g, unknown or other
  misc_feature (146)..(146): n is a, c, g, or t
  modified_base (717)..(718): a, c, t, g, unknown or other
  misc_feature (717)..(718): n is a, c, g, or t
  modified_base (720)..(721): a, c, t, g, unknown or other
  misc_feature (720)..(721): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagngcccacccctctcctgcgacgggccagtcaggtagttggttaggccgggtacctacgccgtaggtaacccaagagacgtaccgtcggccgaggccctcccgaggtccttccttctttactatggtatcgacctactacccaaacggcggggaccctaagtcggaccaacctcccgagccgtaaggttcaggtgggtcgggttggtcgtagggacaggtaccttcacctctaccacctatcgaacgcgaacggtcctaaggaccgtaccttaaggaaacgtttacgtttttcggaacctttttaaggtttaactttacgtacgtacgacgtacgtacggtcgtaacgaccttaacggttcgggttacgttacgggtaccgttaccgggaaccggaacgggtaacgtaagggtaagaaacgtaacgaaaacgtacgttaggtcggactacgacctacgtattcgtacgttccttactcgttccctcccgactcgttacgtaggtaacgttgttcgtacgttacggtaggacgggtcgggtacgtacgggaccggtaacggcgtactagtaggnngnn

SEQ ID NO: 228734 - DNA, 512 bp, Homo sapiens
  misc_feature: GYAE6OF01ECCXE.33.85.H08.1.454.CMB.1.raw
  modified_base (456)..(456): a, c, t, g, unknown or other
  misc_feature (456)..(456): n is a, c, g, or t
  modified_base (503)..(503): a, c, t, g, unknown or other
  misc_feature (503)..(503): n is a, c, g, or t
  modified_base (508)..(509): a, c, t, g, unknown or other
  misc_feature (508)..(509): n is a, c, g, or t
  modified_base (511)..(512): a, c, t, g, unknown or other
  misc_feature (511)..(512): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctagaagtattttgctagtttatactgtcagcagcgtagcaacgtggtcgttggacgttcggacaagggaccaaggtaggaaatacgaaacgactgtgctgccacatctgtcttcacttcctcccnctactctagtaacgtgtgttgtactggaggcgggtctggacgaggcnatagnngnn

SEQ ID NO: 228735 - DNA, 534 bp, Homo sapiens
  misc_feature: GYAE6OF01B6G25.33.85.H08.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcggtacctagcctggtaccaacagagacctggccaggctcccaggctcctcttctatgatgcatccaacngggccatggcatcccagccaggttcagtggcggtgggtctgggacagacttcactctcacatcagcagcctagacgcctagaagtattttgctagtttattactgtcagcagtcgtagcaactggtcttggacgttcggaccgtaagggaccaagggtacggaaactacgaaacgtaacgtggtggctcgaccacctatctgttcttcacttccttccccgcctagttcg

SEQ ID NO: 228736 - DNA, 523 bp, Homo sapiens
  misc_feature: GYAE6OF01D4XTT.33.85.H08.1.454.CMB.1.raw
  modified_base (345)..(345): a, c, t, g, unknown or other
  misc_feature (345)..(345): n is a, c, g, or t
  modified_base (516)..(516): a, c, t, g, unknown or other
  misc_feature (516)..(516): n is a, c, g, or t
  modified_base (521)..(522): a, c, t, g, unknown or other
  misc_feature (521)..(522): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacagagacctggccaggcctcccaggcctcctcttctatgatgcatccaccgagggccactggcactcccagccaggttcagtggcagtgggtctgggacagacttcactctcaccatcagcacgcctagacgcctgaagtnttttgctagtttattactgtctgcagcgtagcaactcggacctaacaccttcggaccgaagggacacgactggaagattaaacgactgtgctgcaccatctgtcttctacttccttcccgactactctgtaagtgtgtagtacgtgacggcggcgtgggacgaacggcganagtgnng

SEQ ID NO: 228737 - DNA, 571 bp, Homo sapiens
  misc_feature: GYAE6OF01BKWCX.33.85.H08.1.454.CMB.1.raw
  modified_base (566)..(566): a, c, t, g, unknown or other
  misc_feature (566)..(566): n is a, c, g, or t
  modified_base (569)..(569): a, c, t, g, unknown or other
  misc_feature (569)..(569): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctgggccaggctcccaggctcctcttctatgatgcatccaacaggggccactggcactcccagccaggttccagtggcggtgggtctgggacagacttcactctcaccatcgagcagcctagacgcctagaagtattttgactagtttatacgtgtcagtcagcgtagactacgtggtcgttggacgttcggaccgtaacgggaccgtaagggtacggaaactacgaaaacgtaacgtaggtacggtctacgactaccgattcgttgtaccttctacttccttcccgacctatccgtagtagttgttcgtgttacgtggacggtcgggcgtcgggaccgtaaggccgactaagagntgncg

SEQ ID NO: 228738 - DNA, 657 bp, Homo sapiens
  misc_feature: GYAE6OF01AVM1W.33.85.H08.1.454.CMB.1.raw
tcagtacacacactcacgaccggtgctcgatttagtatcactcagtcgcggggaggaactgctcagttaggacccagagggaaccatggaagccccagctcagcttctcttcctcctgctactctggctaccaggggaaagagccaccctctcctgcagggccagtcagagtgttagcgggtacctagcctggtaccaacagagacctggccaggcctcccaggctcctcttctatgatgcatccaccagggccactggcatcccagccaggttcagtggcaggtgggtctgggacagtacttcactctcaccatcagcagcctagacgcctgaagtatttgactagtttatactgtctgcagtcgtacactacgtcgacctaaccgtaccgttccggaaccgaagggtacccaccgggtacgtagggaaacgttaacgttaaaccggacgttggtacggaccgtacgacccaaccttacgtcgttacgttaccctacgtacctttccccgttacccgtaccttacgttccggttaacggttaacggtttcggttaaccggttacggtttaaccggttagggtaaccggggttcccggggttaccggtacggggtaacccggtaacgggggacccttaaggtaacgttgggcgtacg

SEQ ID NO: 228739 - DNA, 654 bp, Homo sapiens
  misc_feature: GYAE6OF01DVECX.33.85.H08.1.454.CMB.1.raw
  modified_base (448)..(448): a, c, t, g, unknown or other
  misc_feature (448)..(448): n is a, c, g, or t
tcagtacacacactcacgaccggtgctcgatttagtatcactcagtcgcgggggaggaactgctcagttaggacccagagggaaccatggaacgccccagctcagcttctcttcctcctgctactctggcctcccagactaccgaccggaagtaaattgtgttgacacagttcctccggcccaccctgttctttgtcctccgaaggggaaagacgcccacccttctccgtgcgacgggccagtcagtagttgttacggcgggtacctagcctaggtaaccaacagacgaccgtggccgaggcctcccgaggtccttcctcttctatgatcgcactaccaacgacgggccacgtcggacactcccagcctaggttcgaggtggcgggtgggtcgtgggacagtacttcactctccaccatcagcacgacctagacgtcctagtaagttnttttgacttagtttacttacgttgtactagacgagtcgtagacgtaacgtcggttcgttacggtaccggttccggaccgtaacgggtaaccgtaagggtaacggtaactaacgtaaaaccggtacgtggtacggacgtacggacctaacccgtacttcgttacgttacccttactaccttccctttaccccgacctacgttaccgg

SEQ ID NO: 228740 - DNA, 584 bp, Homo sapiens
  misc_feature: GYAE6OF01C8VV3.33.85.H08.1.454.CMB.1.raw
  modified_base (238)..(238): a, c, t, g, unknown or other
  misc_feature (238)..(238): n is a, c, g, or t
  modified_base (580)..(580): a, c, t, g, unknown or other
  misc_feature (580)..(580): n is a, c, g, or t
  modified_base (584)..(584): a, c, t, g, unknown or other
  misc_feature (584)..(584): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctcccgaggggaaagacgcccaccctctcctgcagggccagtcagagtgttagcggtacctagcctggtaccaacagagacctggccaggcctcccgaggctcctnttctatgatgcatccaacgcggccagtcggcactcccagccgaggttcaggtggcggtggtcgtgggacagtacttcactctacactatcagcacgcctagacgcctagaacgttattttgacgttaagtttacttactgttctgctagcgtagctaacgtcggtacctaacaccgttacggaccgaaggacacgacgtaggaagtaataacgtacgtagtcgtctacgacctactacttcgtacgtcttactacttccttacccgctacgtcgtagtacgttgttacgtacgtacgtggtacggtcgggtcgtacgggacgtaacgggccaacgtagtagngagn

SEQ ID NO: 228741 - DNA, 765 bp, Homo sapiens
  misc_feature: GYAE6OF01BS06E.33.85.H08.1.454.CMB.1.raw
  modified_base (164)..(164): a, c, t, g, unknown or other
  misc_feature (164)..(164): n is a, c, g, or t
  modified_base (188)..(188): a, c, t, g, unknown or other
  misc_feature (188)..(188): n is a, c, g, or t
  modified_base (369)..(369): a, c, t, g, unknown or other
  misc_feature (369)..(369): n is a, c, g, or t
  modified_base (693)..(693): a, c, t, g, unknown or other
  misc_feature (693)..(693): n is a, c, g, or t
  modified_base (760)..(760): a, c, t, g, unknown or other
  misc_feature (760)..(760): n is a, c, g, or t
tcagtacacacactcacgaccggtgctcgatttagtatcactcagttcggtcggggggggaggaactgctctagttaggacccaggaggggaaccataggaaggccccagctcagcgttactacttcctccctgctactcgtcggctcccacggtagaacgccnccacctctccgtcgcgacgactancagtaggttcgtacgacctaagttacgttgtcgtacgtaaccaacgtactacgtacccgaccgtaaccgaggtcccgtaccggtacgggtccctacgtactacgtacgtaccgacgtcgtcccgtaccgacggaccgaccgtagggacacctaccgaccctaccgaaccgtcggttacggngttacggtagtagggttcgtaccggtacggtaacgttaacggttactaaccgtccttactaccctaacgaacggtaccaacccgaaccccctaaacgttaaccgtacgttaataacgttttacttttacttaactttaacctacgtagtaaccccacttacggtaccggccgtacgaccgttcgttaccgtccttacgtacgtttacccggtcggggaacggacgtaacccgtaggacgaccttaccgtaaccgaacgtcgttaggccgtacgcgtaccctaggtcgtatcggttactacgacgtttcccgattactcggttanataccggttgttcgtaacacggtacgccgggcggttcaagggactacgtccttaagtacgtacggtngtacg

SEQ ID NO: 228742 - DNA, 541 bp, Homo sapiens
  misc_feature: GYAE6OF01B58B2.33.85.H08.1.454.CMB.1.raw
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
tcagtacacacactcacgaccggtgctcgatttagtatcactcagtcgcggggggggaggaacgtgactcagttaggacccagagggaaccatggaagccccagctcagcttctcttcctcctgctactctggctcccaggggaaagagccaccctctcctgcaggccagtcagagtgttagcgggtacctagcctggtaccaacagagacctgggccagggcctcccgaggcctcctcttctatgatgcatccaacagggccactggcatcccagccaggttcagtggcggtgggtctgggacagacttcactctcaccatcagcagcctagacgacctgaagtattttgactagtttattactgtcagcagctagctaactggtcttagggacgttcggaccgaagggaccaaagggtacggaaactacaaacgaactgtaggctgcacatctgtcttcattcctcccgctatcgtgaagtgtagttgtacttggacggtcgggtcgtcgggactaagggccgtacgagtagntgngac

SEQ ID NO: 228743 - DNA, 770 bp, Homo sapiens
  misc_feature: GYAE6OF01EM9L8.33.85.H08.1.454.CMB.1.raw
  modified_base (196)..(196): a, c, t, g, unknown or other
  misc_feature (196)..(196): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccacctgtctttgctccaggggaaangccaccctctcctgcgagggccagtcagagtgttagcggtacctagcctggtaccaacagagacctggccaggcctcccaggcctcctcttctatcgatgcactaccaacgacgggcccaagtcggaccaacgtccccgaagcccgtagggtttccaagggtcgggtaccgggttggggtcctagggggaacctaggtacccgtttacaccgttcctacctaaccctaagttcccgaaaggtccaaacgggtaccccttaaagggtaaccggtacccgtttaaggaaacgtttacgttttttacgggaacccgttttaaaggtttttaaacgttttaaccgttacggtttaccgaacggtacgtacggtaccggttaacgtaccgtaaaccggttgggttaccgtttacgggtaccggtttaccggaaccggtaaacgggtaacccgtaagggtaacggtaaacgtaccgaaaacggtaccggttaggtacgggtacgtacggacctaaccgtagttaccgttacgttacccgttactaccgtttaccccgttccccgtacctaacgttaccgg

SEQ ID NO: 228744 - DNA, 619 bp, Homo sapiens
  misc_feature: GYAE6OF01DRIGB.33.85.H08.1.454.CMB.1.raw
  modified_base (615)..(616): a, c, t, g, unknown or other
  misc_feature (615)..(616): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacagagacctggccaggcctcccaggcctcctcatccagtggtgccatcccaccgaggggcccacgtcggaccactcccgaagaccgtaggttccaggtggctaggtgggtcgtgggaacagtactttcattcctacaccatcagcagacgtggacgactagaagttatttggactagttagttaacttactgtacagtcgtaaggttacggttattactacttccgtccgtacggttccggaacgaacgggaccgtaaaggtacgaaactaacgaaacgtacgtggtacgactcgacactatcgttacgtaccttactacttccccgttacccgacttacttcgtaggtaagtcgttagtcgttacgtcggtcgggtccggggctacgggacggaacggtcgacaagtcgnngcg

SEQ ID NO: 228745 - DNA, 667 bp, Homo sapiens
  misc_feature: GYAE6OF01C636K.33.85.H08.1.454.CMB.1.raw
  modified_base (661)..(662): a, c, t, g, unknown or other
  misc_feature (661)..(662): n is a, c, g, or t
  modified_base (664)..(664): a, c, t, g, unknown or other
  misc_feature (664)..(664): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaggggaaagacgcccaccctctcctgcagggccagtcagagtgttagcgggtacctagcctggtaaccaacagacgacctggccaggcctcccgaggcctcctcttctatgatgcactccaaacgacggggccacgtggaccactcccgacgcccgtaggttccaggtcgggcgggttcgggtcgtaggggaccagtacttcactcctacaccatcagcacgcctaggacgcctaggtaagttattttcgacttagtttattactgtcagtcgagtcgtaagctaacgttggttacgttacggtacggttacggaccgtaagggacccgtaaaggggtacgaaaacgtaccgaaaacggtaacgtggtacggtccgtacgacctaaccttagtccgttacgttccttacctaccgtttcccgttcccgaccttacttcgtaggtaacgttggtagttacgtacgtcgggaacgggtccggggtacgttacgggaccgtaacgggcccgtacgtaagttacggnngngtg

SEQ ID NO: 228746 - DNA, 518 bp, Homo sapiens
  misc_feature: GYAE6OF01EHX8S.33.85.H08.1.454.CMB.1.raw
  modified_base (197)..(197): a, c, t, g, unknown or other
  misc_feature (197)..(197): n is a, c, g, or t
  modified_base (515)..(515): a, c, t, g, unknown or other
  misc_feature (515)..(515): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaanagccaccctctcctgcagggccagtcagagtgttagcgggtacctagcctggtaccaacagagacctggccaggctcccaggctcctcttctatgatgcatccaacagggccactggcactcccagccaggttcagtggcggtggtctgggacagacttcactctcaccatcagcagcctagacgcctgaagtattttgctagtttattactgtcagtcagcgtagctaacgtggtcttgggacgttcggaccgaaagggccaaggtgaaatacgaaagactgtaggctgacacatctgtcttcattccttcccgctntcg

SEQ ID NO: 228747 - DNA, 692 bp, Homo sapiens
  misc_feature: GYAE6OF01BNSV4.33.85.H08.1.454.CMB.1.raw
  modified_base (687)..(688): a, c, t, g, unknown or other
  misc_feature (687)..(688): n is a, c, g, or t
  modified_base (690)..(690): a, c, t, g, unknown or other
  misc_feature (690)..(690): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggcctcccgaggggaaagacgcccaccctctcctgcagggccagtcagagtgttagcggtacctagcctggtaccaacagacgaccgtggccaggcctcccgaggcctccttcttctatgatgctatcccaaacgagggccacgtggccactcccgagcctaggttcaggtgggcggtgggtcgtgggacacggtacttcacttcacacctaatcagcgacgcctaagacgcctaggtaacgttagttttcgaacgttaagttttaactacgttggttaccaacggctaggtacgttaaggaccgtaacgtttgggttaccgttacgggtacccggttaccgggaaccgtaaacggggaaccgtaaagggttaggaaaacgtacgaaaacgtacgtaggtacggtaccgtacgaccctaacgtagttccttacgttacctttactaccgttacccgttcccccgacttacgttcgttaggacggtttcgtaggttagttaacggtggtaacgggtcgggtaccggtggaacccggtaagggtccgacgtaagtaggnngngc

SEQ ID NO: 228748 - DNA, 532 bp, Homo sapiens
  misc_feature: GYAE6OF01C94EP.33.85.H08.1.454.CMB.1.raw
  modified_base (507)..(507): a, c, t, g, unknown or other
  misc_feature (507)..(507): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaacagggccatggcatcccagccaggttcagtggcggtgggtcgtgggacaggacttcactctcaccatcagcagcctagagcctagaagtattttgacttagtttattactgtcagcagcgtagactaacgttggttcttggaccgttcggaccaagggaccaagggtagaaactacgaaacgaactggtaggctgcaccatctgtctctacttccttcccgctattctagtagtcgtgtcgtatggacggcgggtntgggacaagggcgtcgaatgnnngn

SEQ ID NO: 228749 - DNA, 576 bp, Homo sapiens
  misc_feature: GYAE6OF01A23QG.33.85.H08.1.454.CMB.1.raw
  modified_base (575)..(575): a, c, t, g, unknown or other
  misc_feature (575)..(575): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccaatcagagtgttagcagtaacttagtctggtaccaacatagacctgaccaggctcccaggctcctcatctacgatcgcgtccaacgaggggccacgtggcatcccagccaggttcagtggcaggtgggtctgggacagtacttcactctcaccatcagcaactagaacttgaagtattttacattttatactgtacaactatcacggcagctggccctctctacgtttcgggacggtagggacctaagggtcgagtcctaacgaaacgtaacgtggtcggctacgaccaccgtatccgttgttccttactacttcccgttccccgacttactccgttagaagttggtagttcgtacgtggacggtcgggtacgtgggaccgtaagggccgtacgtaagtaggctggtng

SEQ ID NO: 228750 - DNA, 690 bp, Homo sapiens
  misc_feature: GYAE6OF01C9KMR.33.85.H08.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccagataccaccggagaaattgtgttgacacagtctccggccaccctgtcttgtctccgaggggaaangccaccctctcctgcgagggccagtcagngtgttagcgggtacctagcctggtaccaacgagacgacctggccaggcctccaggcctcctcttctatgatgcactccaccgacggccacgtcggcactcccgagcccgaggttcaggttcgcgtacggtgggtctaggggacacggtaccttcgactcctacaaccataccgagccgaacgacccgtacggacgtcgtacgtaagttacgttttacgtacgtttaagtttacttacgttcgttacgtcggtacgtacggtaccggttacgtacgtaaccgtacggtacccgttaaccgttacccggttacccgggtaaccggaaccggggaaccgtaaccggtaaccgtaacgggtaaacgtaacggtaaaaccgtaacggttacggtacgggtacgtacgtaccctaccgtacttcttacggtttacttaccgtaccttccccgttcccggttaccc

SEQ ID NO: 228751 - DNA, 594 bp, Homo sapiens
  misc_feature: GYAE6OF01EYYHN.33.85.H08.1.454.CMB.1.raw
  modified_base (146)..(146): a, c, t, g, unknown or other
  misc_feature (146)..(146): n is a, c, g, or t
  modified_base (205)..(205): a, c, t, g, unknown or other
  misc_feature (205)..(205): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (590)..(590): a, c, t, g, unknown or other
  misc_feature (590)..(590): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaanagccaccctctcctgcagggccagtcagagtgttagcgggtacctagcctggtaccaanagagacctggccaggcctcccaggctcctcttctatgatgcatccaacgacgggccacgtggccaatcccagccaggttcagtggcggtggtctggggacagacttcactctcaccatcagcagcctagngcctagaagtntttgctagtttatactgtcagcagcgtagctaacgtgttcttggaccgtttcggaccgtaagggaccgtaaagggtaggaaactaccgtaaaacggaacttggtacggtactcggaccaccgtattcgtcgttcttacctacgttcccgttacccgccttattccgtaggtaacgttggttacgtacgttacgtggtaacgggtcgggtcgttagggaccgtaagggccgtacgtataggctgntacg

SEQ ID NO: 228752 - DNA, 634 bp, Homo sapiens
  misc_feature: GYAE6OF01CNUK1.33.85.H08.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaangagacctggccaggctcccaggctcctcttctatgatgcatccaacagggccactggcactcccagccaggttcaggtggcggtgggtctggggacagacttcgactctccaccatccagcagcctagacgcctagaagtattttagcttagttttacttaactgttacagcacgtcgttaacgctaacgttgggttacgtttagggtaccggtttccgggaacccgtaaacggggaacccgtaaaggggtacgggtaaaactaccgaaaaccggtaaacgttcgggtacggtaccgttcggacccgacccgtaaacgttccgttacgttacctttacccgactttcccccgtttacccccggacctacgttacccgg

SEQ ID NO: 228753 - DNA, 530 bp, Homo sapiens
  misc_feature: GYAE6OF01AEQEY.33.85.H08.1.454.CMB.1.raw
  modified_base (499)..(499): a, c, t, g, unknown or other
  misc_feature (499)..(499): n is a, c, g, or t
  modified_base (524)..(524): a, c, t, g, unknown or other
  misc_feature (524)..(524): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaagagccaccctctcctgcagggccagtcagagtgttagcgggtacctagcctggtaccaacagagacctggccaggctcccaggctcctcttctatgatgcatccaacagggccactggcatcccagcccaggttcagtggcggtgggtctggggacagacttcactctcaccatcagcagcctagagcctgaagtattttgctagtttattactgtcagcagcgtagcaacgtggtcttggacgttcggaccgaagggacctaagggtaggaaactcgaaacgactaggtggcgtgacaccntctgttcttcacttccttcccgctnttaccg

SEQ ID NO: 228754 - DNA, 523 bp, Homo sapiens
  misc_feature: GYAE6OF01BCSB6.33.85.H08.1.454.CMB.1.raw
  modified_base (521)..(521): a, c, t, g, unknown or other
  misc_feature (521)..(521): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcatctatgatgcatccaccagggccactggcatcccagccaggttcagtggcagtgggtctgggacagacttcactctcaccatcagcagcctagacgcctagaagtattttgctagtgtattactgtcagcagtacggtagttcatctccgtacgttcggaccgaaggaccgaaggtaggaaactacaaacgactgtggctgccaccatctgtcttctacttccttcccgctactctagagttgtgtgtacgtgacggcgggtctgggaccgaagggccgatacgtgntg

SEQ ID NO: 228755 - DNA, 601 bp, Homo sapiens
  misc_feature: GYAE6OF01DWS16.33.85.H08.1.454.CMB.1.raw
  modified_base (198)..(198): a, c, t, g, unknown or other
  misc_feature (198)..(198): n is a, c, g, or t
  modified_base (352)..(352): a, c, t, g, unknown or other
  misc_feature (352)..(352): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagcccaccctctcctgcagggccagtcagagtgttagcggtacctagcctggtaccaacagacgacctggccaggcctcccaggcctcctcatccatggtgcactccacgacgggccacgtcggcactcccagacaggttcagtgcaggtggtntgggacagtacttctattctacacctatcagcagtacgtggacgccgtagtaagtattttgcgtagttagttacttacgtgtacgagtacgtaggttacggttacgttctattccgtaccgtacggtttaccgggaccgaaacgggtaccgaagggtacggtaaacgtaccgaaaacggtacgttaggtacggtacgtacgactacctacgttcgttacgttccttactacttcccgttcccgcctacg

SEQ ID NO: 228756 - DNA, 577 bp, Homo sapiens
  misc_feature: GYAE6OF01A6J5J.33.85.H08.1.454.CMB.1.raw
  modified_base (573)..(574): a, c, t, g, unknown or other
  misc_feature (573)..(574): n is a, c, g, or t
  modified_base (576)..(577): a, c, t, g, unknown or other
  misc_feature (576)..(577): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtactagcctggtaccaacagagacctggccaggcctcccaggcctcctcttctatgatgcatccaacgagggccatggcatcccagccaggttcagtggcggtgggtcgtgggacagacttcactctcaccatcagcagcctagacgcctagtaagtattttgactagtttatactgtcagcagacgtagctaacgttggttcgttggtacggttccggaccgaaggggaaccgtaaagggtacggaaaacgtaccgaaaacggaaccgttggtagggctacgtaccacctacttcgtgttcctttactacgttcccttccccgtacctatcgtagtaagttggtgtgtactgggcggcgggtgtcgggaccgaaggcgactagtagnngnn

SEQ ID NO: 228757 - DNA, 539 bp, Homo sapiens
  misc_feature: GYAE6OF01A2T4P.33.85.H08.1.454.CMB.1.raw
  modified_base (533)..(533): a, c, t, g, unknown or other
  misc_feature (533)..(533): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacaggacttcactctcaccatcagcagcctagagcctgaagtattttgctagtttattactgtcagcagcgtagcaactggtcttggacgttcggccaagggaccaaggtagaaatacaaacgatggtgctgcactatctgtcttcacttccttcccgactacttcgtagaagttggtgttcgttacgtggacggtccggggtcttcgggacgaacgggccgtacgtagttaaggcngtgacg

SEQ ID NO: 228758 - DNA, 645 bp, Homo sapiens
  misc_feature: GYAE6OF01DZ2JX.33.85.H08.1.454.CMB.1.raw
  modified_base (199)..(199): a, c, t, g, unknown or other
  misc_feature (199)..(199): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctcgaaggggaaangccaccctctcctgcagggccagtcagagtgttagcgggtacctagcctggtaccaacagagacctggccaggcctcccaggccttcctcttctatgatgcaatccaacgacgggccacgtggcactccccagccaggttcaggtgcgaggtggtctgggacagtacttcaactctacacctatcgaacgtaccaaacccgttagaaacctttagaaacgtttacttttttctaaattttttaacttacgttagttaaccaactactacgaccggtctaacgtccgtcggtcccttctccgtaacgtttccggggacggtacgggtaccgtaagggtcggacgacttaacgaaaaccgtaacgttcgtacggacttggacccacctaacgttccgttaggttacccttaccttaacccttccgtttacccccggctaaccgttcgg

SEQ ID NO: 228759 - DNA, 583 bp, Homo sapiens
  misc_feature: GYAE6OF01BIX1G.33.85.H08.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
  modified_base (580)..(580): a, c, t, g, unknown or other
  misc_feature (580)..(580): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacngagacctggccaggcctcccaggctcctcttctatgatgctatccaacgagggcccaactggacatcccagccaggttcaggtggcggtgggtctcggganacgacttcactctcaccatcgagcagcctagacgtcctagaagtattttgacagttgtattactgtcagtcagttacgtgttcatcgtccgacgttccggaccgaagggacctaaggtacgaaatacgaaacgtacgtaggtcggtactgccgtaactacgtccttggtccttactacttccgttccccgtcttagtccgtaggtaacgttgtcgttacgtaccgtgggtacggtcgggacgttgggaccgtaaggccgtacgagtaggctgntag

SEQ ID NO: 228760 - DNA, 569 bp, Homo sapiens
  misc_feature: GYAE6OF01DJK9C.33.85.H08.1.454.CMB.1.raw
  modified_base (258)..(258): a, c, t, g, unknown or other
  misc_feature (258)..(258): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctccgaggggaaagagccaccctctcctgcagggccagtcagagtgttagcgggtacctagcctggtaaccaagagagacctggccaggcctcccgaggcctcctcttctatgatgcatccaaacgngggccagtggcactcccgacgccgtaggttcaggtcggcgggttgggtcgtgggacagtacttcactctcaccatcagcagcctagagcctagaagtgtttgcttagtttattctgtctgacagtacgtatacgtacgtcgtacctaacctccgtacgaccgaaggacacgtacgtaggaagtaacgtaacgagtcggtacgctacgaccagtactctgttacttccgacttccctacccgctactcgtagtagttcgttgttagtacggtggtcggacggtcgaggaccgtacggtcgactagcgtgngn

SEQ ID NO: 228761 - DNA, 516 bp, Homo sapiens
  misc_feature: GYAE6OF01A3NW5.33.85.H08.1.454.CMB.1.raw
  modified_base (384)..(384): a, c, t, g, unknown or other
  misc_feature (384)..(384): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctagaagtattttgctagtttattactgtctgcagcgtagcactggacctaacnccttcggccaagggacacgacgtaggagaagttaaacgacgtggtgctcgcaccatcttcgtcttcgacttccttcccgctatctagtagttgtgtgtacgtggagcgggcgtggcaagggcgcagtgnngn

SEQ ID NO: 228762 - DNA, 529 bp, Homo sapiens
  misc_feature: GYAE6OF01DJ9IN.33.85.H08.1.454.CMB.1.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (507)..(507): a, c, t, g, unknown or other
  misc_feature (507)..(507): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaacagggccatggcatcccagccaggttcagtggcggtgggtctggganagtacttcacttctcaaccatcagcacgcctagacgcctgaagtnttttgctaagttttattactgtcagcagcgtagctaacgtggttcgtaggtacgttcggaccgaagggaacctaagggtgaaatacgaaacgtacgtgtggctgcactatctgtcttcacttccttcccgctactctagtaagtgtgtgtacgtgacggtcggngtggacgaggcgcaagtgnngn

SEQ ID NO: 228763 - DNA, 597 bp, Homo sapiens
  misc_feature: GYAE6OF01BCXLF.33.85.H08.1.454.CMB.1.raw
  modified_base (146)..(146): a, c, t, g, unknown or other
  misc_feature (146)..(146): n is a, c, g, or t
  modified_base (236)..(236): a, c, t, g, unknown or other
  misc_feature (236)..(236): n is a, c, g, or t
  modified_base (492)..(492): a, c, t, g, unknown or other
  misc_feature (492)..(492): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaancgcccaccctctcctgcagggccagtcagagtgttagcgggtacctagcctggtaccaacagagacctggccaggcctcccaggctcctnatctatgatgcatcccaccgagggcccacgtggcactccccagcctaggttcagtggcgaggtgggtctgggacagtacttcactctcaccatcagcagcctaagcgcctagtaagtattttgcttaagttttacttacgtgtcgtgcaggtcgtagacctaacgtcggtaccctaaccgtacccgttcggaccgaaacggacaacggtaacgtaggaagtaacgttaaacgacgtgtacggctacgacctaccgnttccgttcgtccttactacttcccttcccgtacctactcgtaggtagttgttcgtagttaccgtggacggcgggtacgtcgggaccgaacgggccacgtagtggc

SEQ ID NO: 228764 - DNA, 623 bp, Homo sapiens
  misc_feature: GYAE6OF01D3GB8.33.85.H08.1.454.CMB.1.raw
  modified_base (201)..(201): a, c, t, g, unknown or other
  misc_feature (201)..(201): n is a, c, g, or t
  modified_base (613)..(613): a, c, t, g, unknown or other
  misc_feature (613)..(613): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccgaccggggaaattgtgttgacacagtctccagccaccctgtctttgtctccgaggggaaagngcccaccctctcctgcgagggccagtcagagtgctggcagcaacttgcctaggtaaccaaacaaaacctcggaccagacctcccgagcctcctcatctatgatgcactccaccgacgggccacgtcggcacgtcccgagcccgtaggttcaggtggcgtaggtcgggtcgtggggaactacggtaccttcaccttcctaccgaacctagtaccacgacgacgtccctaagaccgtcttaggtaaacgttcgttttacgactttaagttttacttacgttagtcgtgtaccgtagtacgtacgacctaacgtcgtaccctaaccgtccgttccggaaccgaacggccaacgtacgtaggaacgtaagtaaaccgagtggtacgctacgacctaacctcgttcgttatccttcnccgttccccg

SEQ ID NO: 228765 - DNA, 541 bp, Homo sapiens
  misc_feature: GYAE6OF01AGD9M.33.85.H08.1.454.CMB.1.raw
  modified_base (490)..(490): a, c, t, g, unknown or other
  misc_feature (490)..(490): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgctggcagcaacttagcctggtaaccaacaaaaacctggccagactcccaggctcctcatctatgatgcatccaccgagggcccacgtggcactccccagccaggttcagtggcagtgggtctgggacagacttcactctcaccatcagcagcctagacgcctagaagtatttgacttagtttattactgtctgcagtcgtagactacgtcggacctaacctacccgttacggaccgtaacgggaccacgtaacgtaggaagtaacgttaaacgaacgtggtgctcgactacactctgtcttctactcctaccncctatctagagtcgtgtgtacgtgacggtcggcgtcggacaggcngngtag

SEQ ID NO: 228766 - DNA, 573 bp, Homo sapiens
  misc_feature: GYAE6OF01CUBAC.33.85.H08.1.454.CMB.1.raw
  modified_base (263)..(263): a, c, t, g, unknown or other
  misc_feature (263)..(263): n is a, c, g, or t
  modified_base (353)..(353): a, c, t, g, unknown or other
  misc_feature (353)..(353): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggcctcccgaaggggaaagacgcccaccctctcctgcagggccagtcagagtgttagcggtacctagcctaggtaaccaacagacgacctgggccaggcctcccaggcttcctcttctatgatgcatccaagngggccacgtgcatccagccaggttcagtggcggtgggtcgtgggacaggacttcactctacaccatcagcagcctagacgcctgaacgtnttttagacttagttattactgtctagacagtcgtagactaacgtggttctcggtacgttcggacgacggacaaggtagaactacaaacgacgtgtcggctacgctaacgatcttcgttacttctacttccgtaccctacctagtctagtaacggttgttacgttcgttacgtcggtacgggcggtcggtcggacgaacgggcgtacgagtagntagngag

SEQ ID NO: 228767 - DNA, 537 bp, Homo sapiens
  misc_feature: GYAE6OF01AHP3N.33.85.H08.1.454.CMB.1.raw
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (535)..(536): a, c, t, g, unknown or other
  misc_feature (535)..(536): n is a, c, g, or t
tcagtacacacactcacgaccggtgctcgatttagtatcactcagtcgcgggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagacgacctggccaggcctcccaggcctcctcttctatgatgcatccaacgagggccactggcatcccagccaggttcagtggcggtgggtctgggacagtacttcactctcaccatcagcagcctagngcctgaagnttttgctagtttatactgtctgcagcgtagcaactggacctaacgaccttcggaccaagggaccacgtactaggaagtaattaaacgactggtacgctcgcaccattcctgttccttcacttccttcccgctactctgtaagtgtgttcgtacgtggacgggcgggtctgggccgaagggtccgacgatggnng

SEQ ID NO: 228768 - DNA, 595 bp, Homo sapiens
  misc_feature: GYAE6OF01DHLIZ.33.85.H08.1.454.CMB.1.raw
  modified_base (196)..(196): a, c, t, g, unknown or other
  misc_feature (196)..(196): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtcttgctccaggggaaangccaccctctcctgcagggccagtcagagtgttagcgggtacctagcctggtaccaacagagacctggccaggcctccaggctcctcttctatgatgcatccaacagggccacgtggcactcccagccaggttcagtggcgtggtctgggacagtactcactcncacntcagcagcctagagcctagaagtatttgactagtttatactgtcagactagtatacgtggggagtacggttcggaccgtaaggggaccgtaaagggtacggaaataccgaaaacggtaacgttggtacgggtactacggacctaaccgtagttccgttacggttccctttaccgtaactttccccgtttacccccggacccttaacgtttaccgtgggtaaacggttcggg

SEQ ID NO: 228769 - DNA, 655 bp, Homo sapiens
  misc_feature: GYAE6OF01CIE0V.33.85.H08.1.454.CMB.1.raw
  modified_base (203)..(203): a, c, t, g, unknown or other
  misc_feature (203)..(203): n is a, c, g, or t
  modified_base (649)..(649): a, c, t, g, unknown or other
  misc_feature (649)..(649): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcggtacctagcctggtaccaanagagacctggccaggcctcccgaggctcctcttctatgatgcactccaacgacgggccatggacactcccagcctaggttcaggtgggcggtgggtctgggacagtcttcactctacaccatcacgacacgctagcgtccgtagtaacgttattttgacttaagttttacttacgtcgtactagtacgtagtacgtagaccgtaacgttcgggttacgttacgggtaccggttacggaacccggtaacgggtaaccgtaaagggtaacgaaacgtaaccgtaaaacgtacgttaggtcggccgtacgaccaacgtataccttcgttccttacgtaccttaccccgttcccgtacctagttccgtaggtaacgtttcggttagttacgttaacgtcgggtacgggtccgggtacggtacgggacgtaacgggcgtacgtaaggtagntgtgac

SEQ ID NO: 228770 - DNA, 520 bp, Homo sapiens
  misc_feature: GYAE6OF01EM8MX.33.85.H08.1.454.CMB.1.raw
  modified_base (198)..(198): a, c, t, g, unknown or other
  misc_feature (198)..(198): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcggtacctagcctggtaccaacagagacctggccaggctcccgaggctcctcttctatgatgcatccaacaggggccacgtggacatcccagccaggttcagtggcggtgggtcgtggggacaggtacttcactcctcaccatcagcagcctagagcctgaagtattttgctagtttatactgtcagcagcgtagctaactggtctgggtacgttcggacgaagggacctaaggtaggaaatacgaaagacgtgtaggctgcacntcgtntctnatctccncntcg

SEQ ID NO: 228771 - DNA, 836 bp, Homo sapiens
  misc_feature: GYAE6OF01BSPYA.33.85.H08.1.454.CMB.1.raw
tcagtacacacactcacgaccggtgctcgatttagtatcactcagtcggcggggggggaggaactgctcagttaggacccagagggaaccatggaagccccagctcagcttctcttcctcctgctactctggcctcccgaaggggaaagacgcccaccctctccgtgcgacgggccagtcagagtgttagcggtactagcctaggaaccaagagacgaccgtggaccaggcctacccgaggtcctccttcttacgtagtgatcgacctaactacccgaaacgacgggcccagtcggaccaccgtcccgagacccgtagggttccagggtcggggtcgggttgggtacgtaggggaactaggtaccttctaccttcctaccaccctaagtccgacgacgacgtacctaaggacgaccgttagaagtttacgttttcgacgttttaagtttacttacgtcgtacgtagtacgtacgtccgttaccttaaccgaaccggttccggtaccccgttccggtacgtaccccgtttaacccggtacccggggaaacccgtaaacggggtaacctaacggggttaaacggttacgggtaacgttaaacgggtttaaaccgggaacccgggttaaacgtttcggggttaaccggtacggtttacccgtacccgttaaccccgtttcggtttaccgttttacccgttaccccgttaacctttacccccgtttacccccggacttaacgttccggttagggtaacggtttcggtttacggtacggttaccgggtacggtacggggtccgggttacggacggtaaccggtacggaccgagtagtagcg

SEQ ID NO: 228772 - DNA, 534 bp, Homo sapiens
  misc_feature: GYAE6OF01DD37W.33.85.H08.1.454.CMB.1.raw
  modified_base (254)..(254): a, c, t, g, unknown or other
  misc_feature (254)..(254): n is a, c, g, or t
  modified_base (339)..(339): a, c, t, g, unknown or other
  misc_feature (339)..(339): n is a, c, g, or t
  modified_base (531)..(532): a, c, t, g, unknown or other
  misc_feature (531)..(532): n is a, c, g, or t
  modified_base (534)..(534): a, c, t, g, unknown or other
  misc_feature (534)..(534): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaaacngggccatggcatcccagccaggttcagtggcggtggtctgggacagacttcactctcaccatcagcagcctagacgcctgaagtnttttgctagtttattactgtcagcagtcgtagcaacgtggtcttggacgttcggaccgaaggggacccaaggtaggaaactacgaaacgtacgtgtcggctgaccacattctcgtcttcattccttcccgctatcctagaacgttgtgtgtacgtggacgtcgggtcgtgggaccgaagggcgacagtagcnngn

SEQ ID NO: 228773 - DNA, 544 bp, Homo sapiens
  misc_feature: GYAE6OF01CWGAY.33.85.H08.1.454.CMB.1.raw
  modified_base (539)..(540): a, c, t, g, unknown or other
  misc_feature (539)..(540): n is a, c, g, or t
  modified_base (542)..(543): a, c, t, g, unknown or other
  misc_feature (542)..(543): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacaggggccactggcatcccagccaggttcagtggcggtgggtcgtgggacagacttcactctcaccatcagcagcctagacgcctgaagtattttgcttaagtttacttactgtactagacagcgtagctaactggtcttcggacggttcggaccgaagggaccgaagggtagaaactacgaaacgtagtgtggctgaccacatctgtcctctacttcccttcccgcctatcgtagtaagttgtgtcgtcttaggacggtcgggcttcgggaccaaggggctcgatagnngnng

SEQ ID NO: 228774 - DNA, 549 bp, Homo sapiens
  misc_feature: GYAE6OF01E019A.33.85.H08.1.454.CMB.1.raw
  modified_base (147)..(147): a, c, t, g, unknown or other
  misc_feature (147)..(147): n is a, c, g, or t
  modified_base (207)..(207): a, c, t, g, unknown or other
  misc_feature (207)..(207): n is a, c, g, or t
  modified_base (258)..(258): a, c, t, g, unknown or other
  misc_feature (258)..(258): n is a, c, g, or t
  modified_base (340)..(340): a, c, t, g, unknown or other
  misc_feature (340)..(340): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggcctcccaggggaaancgcccaccctctcctgcagggccagtcagagtgttagcgggtaccagcctggtaccaacngagacctggccagggcctcccgaggcctcctcttctatgatgcatccaagngggccagtggcactcccagccaggttcaggtggcggtggtctgggacagacttcactctacaccatcagccacgcctagacncctagaagtatttgactagtttactcgtgtcagcagtcgtagctaagttcggtcgttggtacgttcggaccgaaggaccgaaggtacgaactacgaaacgacgtagcgcgtcgacacatctcgtcttacacttccttccgctactcgtagtaacgtgtagtcgtacgtggacggtcgggcgtggaccgaggcgtacgagtacgngnngn

SEQ ID NO: 228775 - DNA, 618 bp, Homo sapiens
  misc_feature: GYAE6OF01BG1NL.33.85.H08.1.454.CMB.1.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
  modified_base (574)..(574): a, c, t, g, unknown or other
  misc_feature (574)..(574): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaaangccaccctctcctgcgagggccagtcagagtgttagcgggtacctaggcctggtaccaacagacgacctggccaggcctcccgaggctcctcttctatgntgcatccaagcgggccacgtggacactcccagccctagggttcaggtggcggtggtcgtggggacagtaccttcgacttcgtaccaccagtcacgcacggtctagaccaacgtagagttactttgaaccttaacttactcttacgtacaaactacgtacgtttaacacttcccgtaccgttaacctcgtttacggaccgtaacgggacctaacgggtcgtaggaacgtagaccgacgggtacgtaccggttggcgggccttcggcctaacccgtnttcccgtgtttacccctgtaacctttccccgtcccgtcttaccg

SEQ ID NO: 228776 - DNA, 680 bp, Homo sapiens
  misc_feature: GYAE6OF01CMHWA.33.85.H08.1.454.CMB.1.raw
  modified_base (202)..(202): a, c, t, g, unknown or other
  misc_feature (202)..(202): n is a, c, g, or t
  modified_base (256)..(256): a, c, t, g, unknown or other
  misc_feature (256)..(256): n is a, c, g, or t
  modified_base (292)..(292): a, c, t, g, unknown or other
  misc_feature (292)..(292): n is a, c, g, or t
tcagtacacacactcacgaccggtgctcgatttagtatcactcagtcgcggggggggaggaactgctcagttaggacccagagggaaccatggaagccccagcgcagcttctcttcctcctgcttctctggctcccagataccaccggagaaattgtgttgacgcagtctccaggcaccctgtcttgtctccgaggggaaangcccaccctctcctgcagggccagtcagagtgtagcggtactagccgtgaccanagagaccgtggccaggcctccgaggtcctcctcttntacgtgatcgcactaccaacgacggaccacgtcgacctactcccacgccgtaggttcgaggtcgggcggtggtcgtagggactacggtacttcaccttcacaccgatcgaacgtcaacgtccgtaacgacgtccgtaacgtaagttacgttttcgacgtttaacgtttacttacgtacgtacgtacgtacgtacgtacgtacgtacgtaacgttcggtttaccggttacgggttaccggttccgggaacccgggtaaacgggtaaccgtaaacggggtaacgtaaacggtaaaccgtaaaacggtaccgtaggtaccggtacgtccgtaacctaaccgtgtcccgttacttccgttacctaccgtttccccgttcccgtccgttaacg

SEQ ID NO: 228777 - DNA, 552 bp, Homo sapiens
  misc_feature: GYAE6OF01EM1JF.33.85.H08.1.454.CMB.1.raw
  modified_base (457)..(457): a, c, t, g, unknown or other
  misc_feature (457)..(457): n is a, c, g, or t
  modified_base (548)..(548): a, c, t, g, unknown or other
  misc_feature (548)..(548): n is a, c, g, or t
  modified_base (550)..(551): a, c, t, g, unknown or other
  misc_feature (550)..(551): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacgagggccacgtggcatcccagccaggttcagtgggcggtgggtcgtgggacagacttcactctcaccatcagcagcctagacgcctagaagtatttgctaaacgttacttctgtacaacactagttacaatcctacccgtataccttttcggccgtacgggaccaagcgtaggagagtcgaggacgaactggtggtctgaccaccntctcgttcttcctattccttccccgctacttctacggtagtgttcgtgttacgtcggtaggcgggtcgtcgggacgaacggcgcaagtagngnng

SEQ ID NO: 228778 - DNA, 728 bp, Homo sapiens
  misc_feature: GYAE6OF01CDGH6.33.85.H08.1.454.CMB.1.raw
  modified_base (193)..(193): a, c, t, g, unknown or other
  misc_feature (193)..(193): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccacggagaattgtgttgacacagtctccgccacctgtctttgtctcgagggaaacncgccaccctctccgtgcgaggccagtcaggtagtgttagcggtaccagcctaggaccaacgagacgacgtggccaggcctccgagtctcctcttctatgatgacactaccaaacggcggacccacgtcggacctacgtaccccgagacccgtagggtttaccgagggttccggggcgggtttacggggtcgttagggggactaacggtacctttaccgaacctccgtaccaacgtactacgacgaccacgtaccctaagcgtacccgtaagtaacgttattttaggacgtttagttttacttaagttcgtacgaacggttcgaacggtccgttaagtccgtaacggtttaccggttcggttcgggtaaccggttccggaaaccgggtaacgggtaaccggtaaaggtaacggtaaacgtaaccgaaacgtaaccggtacggttacggaccgttaccggacttaaccggtcgttaccgtttacgttacccgttaccttaacctttcccccgtttacccggtacctcgtttaaccgg

SEQ ID NO: 228779 - DNA, 741 bp, Homo sapiens
  misc_feature: GYAE6OF01CL4MS.33.85.H08.1.454.CMB.1.raw
tcagtacacacactcacgaccggtgctcgatttagtatcactcagtcgcggggaggaactgctcagttaggacccagagggaaccatggaagccccagcgcagcttctcttcctcctgcttctctggcctcccagatacccaccggagaattgtgttgacgcagtctccaggcctaccctgtctttgctccgaggggacagacgccctaccctctcctgcacgggccagtcagtactgttagcagcgtcttcgttagcctggtaccagacaacgtaaacctggaccacggcctacccgaggccctccctcttccgtagtcggtcacctactcccgaacgacgggcccacgtcggccacgtcccgaagtaccgtaggttccgaaggttcggacgtaggttcggggcgtagggactacggtactttaccgacttcctaccaacccgtagtacccgaacgtaccggacgttacgggaccgtacgtaagggttaaacttacgttttacgacgttacgttaacgtttaagttaccgttaggtacgtaagtaccgtaaggttaacgttaaccggtaggggggtaaccgttaccggggttacccgaaacgggtaaacgggtaaaccgtaagggtaacggtaaacgtaaccgaaaacgggtaaccgttcggtacgggacttaaccggactaaccccggttattccgttaccggttacttaaccgttaccgttccccgttcccgtaaccg

SEQ ID NO: 228780 - DNA, 519 bp, Homo sapiens
  misc_feature: GYAE6OF01E263D.33.85.H08.1.454.CMB.1.raw
  modified_base (515)..(516): a, c, t, g, unknown or other
  misc_feature (515)..(516): n is a, c, g, or t
  modified_base (518)..(519): a, c, t, g, unknown or other
  misc_feature (518)..(519): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagacgcctagaagtattttgctagtttattactgtcagcagcgtagctaacgtggtcttggacgtttcggccgaagggacccaagggtagaaatacaaacgaactggtgctgcaccatcgtgtcttcatccttcccgctatctgtaagtgtgtgtactggagcgggctggaccaagggccgtacagtagnngnn

SEQ ID NO: 228781 - DNA, 772 bp, Homo sapiens
  misc_feature: GYAE6OF01DLREY.33.85.H08.1.454.CMB.1.raw
  modified_base (200)..(200): a, c, t, g, unknown or other
  misc_feature (200)..(200): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
tcagtacacacactcacgaccggtgctcgatttagtatcactcagtcgcggggaggaactgctcagttaggacccagagggaaccatggaagccccagctcagcttctcttcctccttctactctggctcccagataccaccggagaaattgtgttgacacagtcctccggccaccctgtctttgtctccgaggggaaancgccaccctctcctgcgagggccagtcagtgtgttagcggtactagcctgacanagagcctggccagctccgagcctcctctntangatnacacgtaccaacgacgggccacgtcggcctaacctcccgaagtacccgtaggttaccgacggttggggcggttcgggtcgtagggaaccgacgttaacctttccgaaccgttccgtaacccaaacccgtctaccggtaacgtccgtaacggtaccccgttaaggaccggtacccgtaaggtaacggtttaactttttccgggtaactttaacgtttttaacgttaacgttacgttaccgtaacgacgttacggtaccggttacgacccgttaacgttcgggtttaccggttacggtaaccggttacccggaaacccggaaacggggtaaaccgtaaacgggttacggtaaaaccgtaccggtaaaaccggttacgtacggttacgggtacctacggtacctaaccgttacgttcccgttacgttacccttacgttacccgtttacccttcccccggttactaaaccggttcgttaaaccggg

SEQ ID NO: 228782 - DNA, 528 bp, Homo sapiens
  misc_feature: GYAE6OF01DWJK1.33.85.H08.1.454.CMB.1.raw
  modified_base (523)..(524): a, c, t, g, unknown or other
  misc_feature (523)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaacagggccatggcatcccagccaggttcagtggcggtgggtctgggacagacttcactctcaccatcagcagcctagacgcctagaagtattttgctaagtttacttactgttcagcagcgtagctaacgtggtcttggacgttcggaccgtaagggaccgtaagggtagaaatacgaaacgacgtggtgctgccacatctgtcttcactcttcccgcatctagtaagtgtgtgtacgtggacggcgggcgtgggcgaagggcgacgagtagnngngn

SEQ ID NO: 228783 - DNA, 651 bp, Homo sapiens
  misc_feature: GYAE6OF01ELSL5.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaangcccaccctctcctgcagggccagtcagagtgctggcagcaattacgctagaaccaacgaaaacctgaccagacctcccgagcctcctcatctatgatcgcactccgaccgacggtacccacgtggaccactccccgagcctaggttcgacggtcggcgtagggtcgggtcgtagggactaggtaccttccgacgtcctacgaccactaccgacgtacctacgacccgttagaccgtaccgttaaggtaagtttacgttttacgactttaagttttacttacgttcgtcctagaccgtaggtaccgtagtaccgtaaccgttacgggaacccttaacgtacccggttaccggaaccgtaacgggacctaacggtacgtaacgggtaactaaacgttaacggacgtaggtacgctacgtaccactacttcgttactaccttcgtccgttacccg

SEQ ID NO: 228784 - DNA, 623 bp, Homo sapiens
  misc_feature: GYAE6OF01BD2BM.33.85.H08.1.454.CMB.1.raw
  modified_base (145)..(145): a, c, t, g, unknown or other
  misc_feature (145)..(145): n is a, c, g, or t
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (569)..(569): a, c, t, g, unknown or other
  misc_feature (569)..(569): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaanagccaccctctcctgcagggccagtcagagtgttagcgggtactagcctggtaccaangagacctggccaggctcccaggctcctcttctatgatgcatccaanagggccatggcatccagcaggttcaggtggcggtgggtctgggacagcttcactctcacctatcagcagcctagancatagaagtnttttgactagtttattactgtctgacagtcgtacgctaacgtcgaaccctaactacccgttcggacctaaaggtcgaaccgtaacgaaccgtagggaactaaacgttaaaacggtaacgttggtacggtaccgttaggaccctaacgacttccgttacgttaccgttactaaccgttcccttccccgactaacgttaccgttacgtaacggtttgttacggtacgtttaaccgngggtaaccgggtcgggtaccgtgggtaacccgaagggtccgtactaaggtgacg

SEQ ID NO: 228785 - DNA, 761 bp, Homo sapiens
  misc_feature: GYAE6OF01CV5XD.33.85.H08.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccaccggagaaattgtgttgacacagtctccggccacctgtcttgctccgaaggggaangcccaccctctcctgcagggtccagtcagagtgttagcgggtacctagcctggtaccaanagagacctggccaggctccaggctcctnttctangatgcatccaaagcgggccacgtgacacgtcccagtccctaagggttccagggtgggtccgggttaggggtccgttagggggaccaaggttacccgtttcgaaccgttccgtaccaacccgtattcgaacggactaacggcccgttaaggtacgacccgtttaagggtaaacgtttacgtttttaacggacccgtttaaggttttttaaactttaaccgggttcggtttaaccgaacggtttacccgaacgtaccgggttaaacggaccttaaaccggtttgggttacccggtttaacggggtaccgggtttacccggaaccggtaaacggggaaccgtaaaggggttaacgtaaacgtaacccgtaaaaacggtaaccgttgggacgggaccttacggacctaaccccgtagttcccgttacgtttacttcccgtaacgtttccccgtttcccgccgttaacgttaccggg

SEQ ID NO: 228786 - DNA, 520 bp, Homo sapiens
  misc_feature: GYAE6OF01A52BW.33.85.H08.1.454.CMB.1.raw
  modified_base (361)..(361): a, c, t, g, unknown or other
  misc_feature (361)..(361): n is a, c, g, or t
  modified_base (516)..(520): a, c, t, g, unknown or other
  misc_feature (516)..(520): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcaacctagaacttgaatatttttcatttttatactgtcaacntcacggcagctggcctctcgtacgtttcggcggagggaccgaaggtggagctacgaaacgactgtgctgccacactctcgtcttcactcctcccgctatctagtagtgtagtgtacgtgacggcgggtctgggcgaagggtccgacgtatacggnnnnn

SEQ ID NO: 228787 - DNA, 546 bp, Homo sapiens
  misc_feature: GYAE6OF01ALA3T.33.85.H08.1.454.CMB.1.raw
  modified_base (199)..(199): a, c, t, g, unknown or other
  misc_feature (199)..(199): n is a, c, g, or t
  modified_base (313)..(313): a, c, t, g, unknown or other
  misc_feature (313)..(313): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccagataccaccggagaaattgtgttgacacagtctccagcccaccctgtctttgctccaggggaaangcccaccctctcctgcagggccagtcagagtgctggcagcaacttagcctaggtaccaacaaaaaccgtggaccagacctcccgaggcctcctcatctatgatgcatccaccgnggccacgtgcactcccagccaggttcaggtcgcgtagtgggtctgggacagtacttcacgtctacaccatccagcagcctagacgtctagaacgtatttgactagtttattactgtctcgactaggctagcctaacgtcgtacctaacgtaccgtcgaccgaaggccacgtacgtaggaactaagtaaccgagtggtacggcgtgacctacgtatccgttgtccgttctaccg

SEQ ID NO: 228788 - DNA, 513 bp, Homo sapiens
  misc_feature: GYAE6OF01BSB1V.33.85.H08.1.454.CMB.1.raw
  modified_base (252)..(252): a, c, t, g, unknown or other
  misc_feature (252)..(252): n is a, c, g, or t
  modified_base (511)..(513): a, c, t, g, unknown or other
  misc_feature (511)..(513): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacngggccactggcatcccagccaggttcagtggcggtgggtctgggacagacttcactctcaccatcagcagccctagacgcctgaagtattttgctagtttattactgtcagcagcgtagcaacgtggtcttggacgtttcggaccgaagggaccaagggtacggaaatacgaaacgactgtgctgcacatctgtctcatccttcccgcctatctagtagtgtgtgtacgtggagcgggctgggacaagggcgacatagnnn

SEQ ID NO: 228789 - DNA, 634 bp, Homo sapiens
  misc_feature: GYAE6OF01DJ8LO.33.85.H08.1.454.CMB.1.raw
  modified_base (204)..(204): a, c, t, g, unknown or other
  misc_feature (204)..(204): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccagatacccaccggagaagttgtgttgacgcagtctccaggcaccctgtctttgtctccgaggggaaancgcccaccctctcctgcgagggccaatcagagtgttagctagtaacttagtctaggtaccaacatagacctgaccaggcctcccaggtcctcctcatcctacgatcgccgtaccaacgacgggcccacgtggccactccccagccgtaggttcaggtggcgtaggtcggggtactggggactaggtacttcactctcaccatcagtaccaactagtaacttgtaattattttactatttttatactgtacaactactcgacgcagtcgtcgcccttctacctacggtttccgggacgggtacgggaccgtaagggtggacgtaccgtaaccgaaacggtaccgttggtacgggtcctaggtaccctaacccgttagttaccttccggtttaccgttaccttaccctttccccgttcccccgtccttaacg

SEQ ID NO: 228790 - DNA, 763 bp, Homo sapiens
  misc_feature: GYAE6OF01EQE57.33.85.H08.1.454.CMB.1.raw
  modified_base (148)..(148): a, c, t, g, unknown or other
  misc_feature (148)..(148): n is a, c, g, or t
  modified_base (761)..(761): a, c, t, g, unknown or other
  misc_feature (761)..(761): n is a, c, g, or t
tcagtacacacactcacgaccggtgctcgatttagtatcactcagtcggcgggggggggaggaactgctcagttaggacccagagggaaccatggaagccccagctcagcttctcttcctcctgctactctggctcccgaggggaaanacgccaccctctcctgcagggccagtcagagtgttagcggtactagcctggtaccaacagacgacctggccaggcctcccgaggccttcctcttctatgatgcactaccaacgacgggccagtggccactcccgacgccgtaggttcgaggttcgggcggttcggggtcgtacggggaactacgtaccgttcaccgttccacctaaccgtatccgacggcctaacgtacccgtaaggaccgtaccgtagtaagtttacttttcggtaatttaacgttttaacgtttcgtacggttaccgaagtacgtaacggtacccggttaagaaccttaacggtttcggttaccggttacgggtaccggtttaccgggaaccgtaacggggtaaccgaaagggttaacgtaaaaccgtacgtaaaacggtacgttacggtacggtacctacgtaccctaaccgtacttccgttcgttacccgttacctaaccccgtttccgtacccccgtactacgttaccggtaacgttcggtttacggttggtttaccggtaacgttggggtaccggtaccggggtacggtacgggtaacgaaccggtcgtaacgtaagtacgatcgancg

SEQ ID NO: 228791 - DNA, 645 bp, Homo sapiens
  misc_feature: GYAE6OF01C2E1F.33.85.H08.1.454.CMB.1.raw
  modified_base (254)..(254): a, c, t, g, unknown or other
  misc_feature (254)..(254): n is a, c, g, or t
  modified_base (640)..(640): a, c, t, g, unknown or other
  misc_feature (640)..(640): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccgaggctcctcttctatgatgcatccaacnggccagtgcactcccagccgagttcagtggcggtgggtctgggacagtcttcactctaccaccatcagcacgcctagaacgcctaggaagttacttttgacttaagttttacttacgttgttacgtgaccgagtcgtaacgactaaccgtcggtaccttaaaccgcccgtttacggaccgaaacgggtaccaacggtacgtagggaaactaacgttaaaccgaacgttggtacggcgtcgacctaaccgtattccgtagttaccttaccgtacgtttccccgttcccgtacccttacttccgttaagttaaacgttgttacgttacgttaccgtagggtacggggtctacgggtacggtaacggaacgggtccgtaactagtacgngtgag

SEQ ID NO: 228792 - DNA, 582 bp, Homo sapiens
  misc_feature: GYAE6OF01BQ6EP.33.85.H08.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcgggtacctagcctggtaccaacagagacctggccaggctcccaggctcctcttctatgatgcatccaacgngggccagtggcactccccagccaggttcagtcggcggtgggtctgggacagtacttcactctcacctatcagcagcctagacgcctagaagtatttgctagtcttattactgtacagactagtatacgtgggagtacggttcggaccgtaagggaccgtaagggtacggtaaacgtacgaaacgtaacgttggtacggtcgtacgaccgtacccgtagttaccttcggttccttacgtaccttcccttaccccgtacctacgttcgtaggtaacgg

SEQ ID NO: 228793 - DNA, 829 bp, Homo sapiens
  misc_feature: GYAE6OF01BDEYZ.33.85.H08.1.454.CMB.1.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgttctttgtctccgaggggaaagngccaccctctcctgcagggccagtcagagtgttaggcgggtacctagcctggtaccaanagagacctggccaggcctcccgaggcctcctcttcgtatgatgcactaccaacgcgggacccagtcggaccacgtccccgaagtcccgtaagggtttccaacgggttcgggtccgggttggggtccgttagggggaaacctacgggtaaccctttccgaaccgttcctaccgaaaccctacgttacccgaaggtaccaccgggtaccctaaggaccgtacccgttaagggtaaacgtttacgtttttacggaactttaacggttttttaacgtttaaccgttacggttaaccgtagggtaccgtaacggtaccgttaacggtacccgttaacggtttcgggtttaccggttttaacggggtaacccgggtttaccggggaaccccggttaaacgggggtaacccggtaaaggggttaacgggtaaaaccgttaacggaaaaacccgggtacgtttacgggtaacggtaccgttaccggaacctaaccgttaccgttccgtttaccggtttaccctttaccgtaaccgttttacccccgtttacccccggtaccgttaacgttacccggg

SEQ ID NO: 228794 - DNA, 505 bp, Homo sapiens
  misc_feature: GYAE6OF01D5W65.33.85.H08.1.454.CMB.1.raw
  modified_base (316)..(316): a, c, t, g, unknown or other
  misc_feature (316)..(316): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (501)..(505): a, c, t, g, unknown or other
  misc_feature (501)..(505): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccaatcagagtgttagcagtaacttagtctggtaccaacatagacctgaccaggctcccaggctcctcatctacgatgcgtccaacagggccactggcatcccagccaggttcagtggcaggtgggtctgggacagacttcactctcaccntcagcaacctagaacttgaatatttttcatttttactactgtacaacatccaggcagctggcctctctactttcgggcggagggaccaagggtggagctacaaacgactgtcgctacacatctgtcttcacttcctccgctatctagagtgtgtgtacnggagcgggntggcaaggnacgtatgnnnnn

SEQ ID NO: 228795 - DNA, 665 bp, Homo sapiens
  misc_feature: GYAE6OF01D011L.33.85.H08.1.454.CMB.1.raw
  modified_base (147)..(147): a, c, t, g, unknown or other
  misc_feature (147)..(147): n is a, c, g, or t
  modified_base (208)..(208): a, c, t, g, unknown or other
  misc_feature (208)..(208): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaggggaaanacgccaccctctcctgcagggccagtcagagtgttagcgggtacctagcctggtaaccaanagagacctggccaggcctcccaggcctcctcatccaagaatcgactattcaaacgacggggccacgtggcactcccagccgaggttcagtggacaggtgggtctgggaacagtacttcactctaccaacatcagcacgcctaagacgtccgtagacggtatttcgtgacttaagttttactaacgtgtacagcagtcgtctacgaacgtcggacccttcgtgcctacccgttacggacccgaaagggaccaacggtacgttagggaagtaagttaacggaacggtaacgttgggtacggtacttccggaaccctaccccggttcttaccggtttaccttacccgtaactttccccgttaaccccgaccttattccggttaaagtaacggtttggtttaggtcggttaacgtcgggacggtccggggtctacggggaaccgtaaacgggcaactaagg

SEQ ID NO: 228796 - DNA, 580 bp, Homo sapiens
  misc_feature: GYAE6OF01EHXWK.33.85.H08.1.454.CMB.1.raw
  modified_base (496)..(496): a, c, t, g, unknown or other
  misc_feature (496)..(496): n is a, c, g, or t
  modified_base (517)..(517): a, c, t, g, unknown or other
  misc_feature (517)..(517): n is a, c, g, or t
  modified_base (539)..(539): a, c, t, g, unknown or other
  misc_feature (539)..(539): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaggggaaagacgccaccctctcctgcagggccagtcagagtgttagcggtacctagcctggtaccaacagacgacctggccaggcctcccgaggtcctcctcttctagtgatcgcactccgaaacgcgggccacgtggaccactcccgagcctacggttcaggtgggcggttgggtcgtgggacagtaccttcgaccttctaccaccatccacgcacgcctagacgtcctagaagttatttgacgtagttagttattactgtcagacgtaggttacggtattctactccgtccgtaccggtcggaccgaagggaaccaaggtaacgaaactacgaaacgtacgtgtgactgactactntctgtcctctactccgtcccnctatcgtagtacgtgtcgttgngtacgcggtggcgtcggacgtacggcgtacagtagnngngn

SEQ ID NO: 228797 - DNA, 556 bp, Homo sapiens
  misc_feature: GYAE6OF01B75UD.33.85.H08.1.454.CMB.1.raw
  modified_base (255)..(255): a, c, t, g, unknown or other
  misc_feature (255)..(255): n is a, c, g, or t
  modified_base (474)..(474): a, c, t, g, unknown or other
  misc_feature (474)..(474): n is a, c, g, or t
  modified_base (552)..(553): a, c, t, g, unknown or other
  misc_feature (552)..(553): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggcctcctcttctatgatgcatccaacgngggccacgtggcactcccagccaggttcaggtggcgggtgggtcgtgggacagacttcactctcacatcagcacgcctagacgcctgaagttgttttgacttagtttattactgtacagcagtcgtagcgtaactggtcttcgggacgttcggaccgtaaggaccgtaaggtagaactacgaaacgtatggtcgcttagcctacgtatctgttccttancttcccttcccgactactcgtagtagttgtgtcgtacgtcggaggtccggtcgtcggacgaacgggcgactagtagcnngcg

SEQ ID NO: 228798 - DNA, 694 bp, Homo sapiens
  misc_feature: GYAE6OF01CBL08.33.85.H08.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccacggagaaattgtgttgacacagtcctccggccaccctgtctttgtctccgaaggggaaangcccaccctctcctgcgagggccagtcagagtgttagcggtacctagcctaggtaccaagngtacgacctggccaggcctccgaggcctcctcttcatgatgctactccgaacgcgggaccacgtcggacacgtcccagcccgtaggttccaaggttgggcggttcggtcgtagggactaggtacttcacgtcctacaccagtaccgagaccacgtacccgtaagaccgtaccgttaggtaacgtttacgttttcgactttaacgttttaacttacgttggtacacggtcgtaacgtccgttaagaccgtaacgtttcgggttacgttcgggttaacccggtttcccgggaaccgtaacggggtaacccgtaagggtaacggtaaactaaccgggaaacgtacggttcggttagggccgtacggtacctaaccggttcgttaccgttacgttcccttaactacccgtttaccccttacccgtctacgttaccgg

SEQ ID NO: 228799 - DNA, 589 bp, Homo sapiens
  misc_feature: GYAE6OF01DTG80.33.85.H08.1.454.CMB.1.raw
  modified_base (205)..(205): a, c, t, g, unknown or other
  misc_feature (205)..(205): n is a, c, g, or t
  modified_base (583)..(584): a, c, t, g, unknown or other
  misc_feature (583)..(584): n is a, c, g, or t
tcagtacacacactcacgaccggtgctcgatttagtatcactcagtcgcggggggggaggaactgctcagttaggacccagagggaaccatggaagcccccagctcagcttctcttcctcctgctactctggctcccaggggaaagagccaccctctcctgcagggccagtcagagtgttagcgggtacctagcctggtaccaanagagacctggccaggctcccaggctcctcttctatgatgcatccaaacagggccaactggcatcccagccaggtttcagtggcgggtgggtcgtgggacaggacttcgactcctcaccatcagcagcctagagcctgtaagtatttgctatttattactgtcagcagcgtagacaactggtcgttaggacgttcggaccgaagggaaccaagggtaggaaaatacgaaacgaacgtgtacggctcggacacctatcgttacgttcttaccgtattcccgttaccccgtacctacttcgtacgtaaggttcgtagttacggtacgttaggaccgggtcggggtacgtgggaacgttaacgggacggtacgtaacgtagnngtgac

SEQ ID NO: 228800 - DNA, 701 bp, Homo sapiens
  misc_feature: GYAE6OF01EX1LD.33.85.H08.1.454.CMB.1.raw
  modified_base (309)..(309): a, c, t, g, unknown or other
  misc_feature (309)..(309): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacgcagtctccaggcaccctgtctttgtctccgaggggacagagccaccctctcctgcagggccagtcagactgttagcagcggcttctagcctggtaccagcagaaacctggccaggctcccagggcctccctccttaccgtacgtcgtcnggccactaccgacccacggccgacctacggccgacgtacccacggtaccgaacggttcgacgtgggtcggtacgtcgggtcgtagggtacgtacgacttcgtacctacctaccaccgactacgaccgacggacgtacggtacgacgtacgtaagacttttcgtcgtaacgttacgttacgttaacgttacggtccgtaagtacgtacggttaacggtaacgttacggggttacgggtaaccggttaaccggggtacccggtaaacggggtaaccggaaacgggtaaccgggtaaaacgtaaccgtaaaaccgggtaaaccgttacggttacgggaccgttacgaccgtacccgtacgttaccgtttaccgtttacccgtttcccgttacccg

SEQ ID NO: 228801 - DNA, 791 bp, Homo sapiens
  misc_feature: GYAE6OF01EXQM7.33.85.H08.1.454.CMB.1.raw
  modified_base (148)..(148): a, c, t, g, unknown or other
  misc_feature (148)..(148): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
tcagtacacacactcacgaccggtgctcgattttagtatcactcagtcggcggggggggaggaactgctcagttaggacccagagggaaccatggaagccccagctcagcttctcttcctcctgctactctggctccgaaggggaaangccacctctcctgcaggccagtcagagtgttagcggtactagcctggtaccagcacgacaccgtggccaggccctcccgaggtcctccctnactccgatgggtnccactcccgaccgaggccacgtcgcactcccgagacgtaggttcaggtcggcgtagggtcgggtcgtgggactacggtaccgttcacgtttaccgtccaacctacgtacgaacgcaacggtacgtcgggaactccgttaagaaggtttacttttaggacgttaggtttacggttaacgttaccgttacgtaccgtagtaccggtaaggtttaacggtttacgttactaaccgttcccggttacccggtacgggtttacccgggaaccgtaaacggggtaaaccgtaaaggggtaagtaaaaccgttaaccgtaaaacggtaacgttacggggtaacgttccgtaacggtaacccgtaacccttaggttaccgtttacgttaccctttacgttacccttttccccgtaacccggttccttaacggtacgttaacggttaggtttaccggttacgttaaccgggttacggaggggttacccggtcggggttacccgggttaacgggaccgggaacgggtaccggacgtaacgtggccgtag

SEQ ID NO: 228802 - DNA, 767 bp, Homo sapiens
  misc_feature: GYAE6OF01A7Z93.33.85.H08.1.454.CMB.1.raw
  modified_base (521)..(521): a, c, t, g, unknown or other
  misc_feature (521)..(521): n is a, c, g, or t
tcagtacacacactcacgaccggtgctcgatttagtatcactcagtcggcggggaggaactgctcagttaggaccagagggaaccatggaagcccagctcagcttctcttcctcctgctactctggcctccgagactacccgacggagtaaacttggtcgttagactacgtagttccgtccggcctacccgttggttccttttcggtccgtaccggaagggggtaaacgcgccctacccgttcgtaccgtggccgtacgggcctaagtccgaaggtaggttacggttaacggccgggttaacctacggccgttaggtaaccaacgagacggtacctgggacccaggtcctacccgaggtcctccgttactttacgtagtcgtacgttcgacgtaacgttccgaaacggccgggaccctagttccggaccttaaccgtccgacggtacgtacgggtttcgaacggtcggggtcgggtacgttcggtacgggaacttcggtacttccgacttacgcaaccgtntacgacgctaacggtcctagacgtaccgtagtaacgttctttcgtacgtttacgttacgtactgtaccacgtacggtagtacgtacgtacgttaacggtcggtaacctaacggtacccttacggaccgtaacggtacgtacgtaacgtgggtaaaccttaacgtaaccgtagtaccgggtagtacgtacgtaaccgcgttacgtccgttaacgttccgttaccgtacgttcccgttcgccgttacg

SEQ ID NO: 228803 - DNA, 686 bp, Homo sapiens
  misc_feature: GYAE6OF01DLU8W.33.85.H08.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (372)..(372): a, c, t, g, unknown or other
  misc_feature (372)..(372): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtcttgtcctccgagggaaagacgcccaccctctcctgcgagggccagtcagngtgtagcggtaccngcctggtaccaagagacgaccgtggccaggcctcccgaggtcctcctcttctatgatgctatccaagacggccacgtcggaccactcccgagcccgtaggttcaggtcggacgtagggtcgggtacgnggggaacaggtaccttcgacctctaccaccgactcgaacgaccctaacgtaagtaacgttacgtaaagtttactttttactaattttttaacttacgttacgtaacctaaactacgttaccgaacggtcgtacgtccgttcggtacccttccgtaccgttacccggtttaccggggaccgggtaacgggtaacccggtaagggtaccggtacgtaccgtaaaccgaaacggttaccgtggtaccggtactaccggactaccgtacgttccgttagttcccttacgtccttaccccgttccccactcgttaccgg

SEQ ID NO: 228804 - DNA, 536 bp, Homo sapiens
  misc_feature: GYAE6OF01BKVD0.33.85.H08.1.454.CMB.1.raw
  modified_base (311)..(311): a, c, t, g, unknown or other
  misc_feature (311)..(311): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacgagggccactggcatcccagccaggttcagtggcggtgggtctgggacagacttcactcncaccatcagcagcctagagcctgaagtatttgctagtttatatgtcagcagcgtagcaacgtggtcttggacgttcggacgaagggaccaaaggtaggaaactacgaaaacgtaacgtggtcggctagaccactatctgtcttcacttcccttcccgactacttctagtaacgttgtagtgtacgtggacggtcgggcgtggacgacggcgacagtagctgngtn

SEQ ID NO: 228805 - DNA, 757 bp, Homo sapiens
  misc_feature: GYAE6OF01EZU9L.33.85.H08.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaaangccaccctctcctgcagggccagtcagagtgttagcgggtacctagcctgtaccaanagagacctggccaggcctccgaggcctcctcttctatggatcgactactaccgaacgacgggccctacgtcggacctaccgtaccccgacggtccccgtaagggttttccgacggggttcggggtccggggttgggggttaccgtacgggggaactacggtaaccctttccacccgtttcctaccaacccgtagtacccggaacgtacggaccgtacggacgtaccgtaggtaacgttagttttacgacgttagttacttaacgttacgttacgtacgtaagtactaacgttaacgttacggtaggggaacgttaccgggttaccgggaaccggtaaacggggaaccgttaaaggggtaacggtaaaacgtaaccgtaaaacggtaaccggttaggtacggtcgtaacgacccgtaaaccgttacgtaccgtttccgttaccttaccgtacgtttccccgtaccccggtaccttaaccgttacgtaggtaacggtttcggg

SEQ ID NO: 228806 - DNA, 814 bp, Homo sapiens
  misc_feature: GYAE6OF01ESHJU.33.85.H08.1.454.CMB.1.raw
  modified_base (201)..(201): a, c, t, g, unknown or other
  misc_feature (201)..(201): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagactaccaccggagaaattgtgttcgacacagtctccggccaccctgtctttgtctccgaggggaaancgccaccctctcctgccagggccagtcagagtgttacgcggtacctagcctggtaccaacgagacgaccgtggcccagggcctcccgaggcctcctcttctatgatgcactccaacgcgggccagtcggccactcccagcccgtaggttcagggtcgggtcggtcgggtcgtacggggactacggtaccttccgaaccgttcctcgaaccctacgtccgaacggtccaacggtacccgttaaggaccgtacccgttaaggtaacgtttaacgtttttacggaccgtttaacggttacttttaacgtttaaccgttacgtacgttacggtaccgtttaacggtttaacgggtttaacgtttcccgtaacgtttaccccggttacccgggttaaccgggtttacccgggaaccgggttaaaccggggtaaacccggttaaaacggggtaaccgggttaaaaaccgtaacccggtaaaaaccggttaaccggttacgggttaccgggtaaccggttacggtacccctaacccggttaacttccgtttaccggtttaccctttacccggttaccttttacccccgttacccccgtaccgtttacgtttaaccccggg

SEQ ID NO: 228807 - DNA, 619 bp, Homo sapiens
  misc_feature: GYAE6OF01AK2EE.33.85.H08.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (606)..(606): a, c, t, g, unknown or other
  misc_feature (606)..(606): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaangccaccctctcctgcagggccagtcagngtgtagcgggtacctagcctggtaccaacgagacgacctggccaggcctcccgaggcctcctcttctatgatgcactccaacgcggccagtggcactcccagccctaggttcgaggtcgggcggttcgggtctaggggactaggccttcacctctacacctatccagcctacgcctaggacgtccgtaggtaagttactttcgactttagttttactacttgtccgtagcgtacgtcgtagactacgttggttcgtacgggtaccgttcgggaccgtaacgggaacgtaagggtacgaaacgtaccgaaacggtagtcggtacgccgtacgaccgtacctgttccttacgttccttaccttaccttaccccgtttacccnccgttgttaccgg

SEQ ID NO: 228808 - DNA, 867 bp, Homo sapiens
  misc_feature: GYAE6OF01ERZ40.33.85.H08.1.454.CMB.1.raw
  modified_base (150)..(150): a, c, t, g, unknown or other
  misc_feature (150)..(150): n is a, c, g, or t
  modified_base (278)..(278): a, c, t, g, unknown or other
  misc_feature (278)..(278): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
tcagtacacacactcacgaccggtgctcgatttagtatcactcagtcgcggggggggagaactgctcagttacggacccagagggaaccatggaacgccccagctcagcttctcttcctcctgctactctggcctcccgaaggggaaacncgccctaccctctcctgcgacgggccagtcaggtagttgttaggccgggttacctacgcccgtaggtaacccaacgaaggacgtaccgtcgggccacggccctccgaggtcccttccttcttactagngtatcgactactaccgaaacggcggtccacgttcggacctaccnccgacgtacgtaggttcnggtcgggtcgggtcggtcgtaggggactacggtacctccgtaacttcccactaaaccgttcgtaaccgacgtacccgttacggacccctaggtaaccggtaccgttaaggtaaacgtttcccgtttagtaacccgtttaaagttttttaaccgtacgtttaccgggtacactaaacggttcggtaacccgtaaagtacccgttaacggtttgggtttacccgtttacggtacccggtttaccggaaccgggtaaccgggtaaacggaaacgggttaacggtaaacctaaccgtaaaacggtacgttaacggttcgggaaccgttaccgtaccgtaaccgtacgttaccgttcccggtttacctttaaccgtacccgtttccccgtacccccgtactttaaccggttaccttacggttaaggttacgtttacgggttaccgtagggttaccggggtaacgggtcccggaacgggttcgggttaaacccggacggttaccggttaaacggtactacggttagcgaggtg

SEQ ID NO: 228809 - DNA, 692 bp, Homo sapiens
  misc_feature: GYAE6OF01EKDO5.33.85.H08.1.454.CMB.1.raw
  modified_base (146)..(146): a, c, t, g, unknown or other
  misc_feature (146)..(146): n is a, c, g, or t
  modified_base (688)..(689): a, c, t, g, unknown or other
  misc_feature (688)..(689): n is a, c, g, or t
  modified_base (692)..(692): a, c, t, g, unknown or other
  misc_feature (692)..(692): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctccgaggggaaancgccaccctctcctgcaggccagtcagagtgttagcggtactagcctggtaccaacagacgacctggaccaggcctcccgaggtccttcctcttctagtgatcgacactcccaaacgcgggccctacgtcggcactcccagcccgtaggttcaggtcggcgggttgggtcgtaggggacagtaccgttcaactcctcaacctatccgagtcacgtctagacgtccgtagaagtttcgttttcgactttaagtttacttacttgtacctaaggctacggtacgttaacgacttaacgttgggttaccgtttagggtacccggtttaccgggaacccggtaaaggggtaaacccgtaaggggtaaacggtaaaactaacgaaaacggttacgttcgggtacgcctaggaccctaaccgtacgtttacggtctttaacgttactaccgtttcccgttaacccgtactacgttcgtacggtagttggttcgttagttacgtaggaccgggtgggacgttcgggacgtacggaccttagacgtagcnngtn

SEQ ID NO: 228810 - DNA, 555 bp, Homo sapiens
  misc_feature: GYAE6OF01BESTJ.33.85.H08.1.454.CMB.1.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaaangccaccctctcctgcagggccagtcagagtgttagcggtacctagcctggtaccaacagagacctggccaggctcccaggctcctctctatgatgcatccaacngggccacgtggcactcccagccaggttcagtggcggtgggtctgggacagacttcactctcacatcagcagcctagagcctagaagtattttgactagttttattacgtgtcagcgagcgtagactaacgtggttcgttggacggttcggaccgtaagggaacctaagggtaggaaacgtacgaaacgtacgtggtacggcgtcgaccacgtacttctagttccttacgacttcctccccgtctacgttacg

SEQ ID NO: 228811 - DNA, 769 bp, Homo sapiens
  misc_feature: GYAE6OF01CWBPU.33.85.H08.1.454.CMB.1.raw
  modified_base (251)..(251): a, c, t, g, unknown or other
  misc_feature (251)..(251): n is a, c, g, or t
  modified_base (765)..(765): a, c, t, g, unknown or other
  misc_feature (765)..(765): n is a, c, g, or t
  modified_base (767)..(767): a, c, t, g, unknown or other
  misc_feature (767)..(767): n is a, c, g, or t
  modified_base (769)..(769): a, c, t, g, unknown or other
  misc_feature (769)..(769): n is a, c, g, or t
tcagtacacacactcacgaccggtgctcgatttagtatcactcagtcggcggggggggaggaactgctcagttaggacccagagggaaccatggaagcccagctcagcttctcttcctcctgcttactctggcctccgaggggaagcgccacctctcctgcagggccagtcagagtgttagcgggtacctagccgtggtaaccaacagacgaccgtggccacggcctcccgaggtccttcctctttctagngatcgacactaccgaccgagggtaccacgtcggcactcccgagcccgtaggttcaggtcggcgtagggttcgggtacgttcggggaacctacggtaacctttccgaactttcctaaccaaccctagtaccgaacggtaccaccggtacccttaagggacgaccgtttaaggtaaacgttttacgttttacggtactttaacgttttttacgtaacttacgggttcaaacgggttccagggttaccgtaaacgtaccttaacggtttcgggttcgtttacgggaccggttttaccgggaacggtaaacgggtaacgtaaagggtaacgtaaacgtaacgtaaacgggtacgtacggttacggtactacggtacctacgtacgttacgttcgttacgttaccttaccttaccccgttcccgtacttacgttcgttaacggttaacgttggttaccgtcgttaacggtcggtaacgggtcgggtcgttacgggacggacggtacgaccgagtacggngngn

SEQ ID NO: 228812 - DNA, 1085 bp, Homo sapiens
  misc_feature: GYAE6OF01CERX5.33.85.H08.1.454.CMB.1.raw
tcagtacacacactcacgaccggtgctcgatttagtatcactcagtcgcggggaggaactgctcagttaggacccagagggaaccatggaacgccccagctcagcttctcttcctcctgctactctggctccagatacccgaccggaagtaattgtgttacgaccacgagttcctacccggcctaccccttggttccgtttttcgtccgtacccggaaggggggaaaacgtccgacccctacccccttccgttcccgtaggaccggacggggaccctaggtaccaagggtaggttacggtttacgggacccggggtttaacctaccgggtacccgtttaacgggtaaaccccaaacgttaagaaccggtaacccgttacggaaaccccgacggggtcccttaacccccggaagggtccccttacccctacgtaccttaccgttacgtacgtaccgggtacccgtaaccccgaaggaaccggggccctaaccgtcgggaccaaccgtaccccgacgtacccggttagttaccggtagggtacggaccgtagggttaccggggtacggacgggaacctaacggtacctttcgaactttccgacccgaaactacgtacgacgtaccgacgggttacccctaaggtaccggtaccgttaacgggttaaagttttacggttttaacgtaacggttttaaaacgtttttaacccgtttaacggtttaccggttaaccgtaacggtaaccggtaacggttaccgggttaaacggttacccgttaaaccgggtttcgggtttttaacccggggtttaccgggttttaaacccgggggttaacccggggtaaaccccggggttaaaaaccgggggtaaccccgggtttaaaaacggggttaaacggtaaaacccggtttaaacccggtaaaacccgggtaaaccggtttacgggtaaacccgggggttacccgtaaccggggtaaacccccggttaacttaaacccggttttaccgttacggtttaaccccctttaccggttaaccccttttacccccggtttaacccgtaccccgtttaaagtttaaccgggg

SEQ ID NO: 228813 - DNA, 719 bp, Homo sapiens
  misc_feature: GYAE6OF01BPUX9.33.85.H08.1.454.CMB.1.raw
tcagtacacacactcacgaccggtgctcgatttagtatcactcagtcgcggggaggaactgctcagttaggacccagagggaaccatggaagccccagctcagcttctcttcctcctgctactctggcctcccagataccaccggagaaattgtgttgacacagtctccggccaccctgtctttgtctccgagggaaagcgcccacctctctgcgagggccagtcagtagtgttacggcggtacctacgccgtaggaccaacgagacgaccgtggaccaggcctcccgaggtcctccttcttctagtgatgaccactacccgaacggcgggccctacggtcggacctaccgtcccgagcccgtaggttaccgaggttcggggtcgggtgggtcgtagggacctaggtaccttcaccgttcctaccaaccgtatccgaagcccgtaacggtaccctaaggaaccgttacccgtaggttaagtttacttttcggtacgtttaagtttttactaacgttacgtacgagtacgtacgtcggtaacgtacgttaacggttggttaccggtttacggtaccggtttaccgggaacgtaacggggtaaccgtaaagggtaacggtaaactaccggaaaacgtacggttcggtacggcgtacgacccgtaacttcgttaccgttacgttaccttcccgtactttcccgtcccttacgtacgttaccg

SEQ ID NO: 228814 - DNA, 581 bp, Homo sapiens
  misc_feature: GYAE6OF01C8LHD.33.85.H08.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (567)..(567): a, c, t, g, unknown or other
  misc_feature (567)..(567): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaggggaaagagccaccctctcctgcagggccagtcagagtgttagcggtactagcctggtaccaacngagacctggccaggcctcccaggcctcctcctctatggtcgcactccaccgacgggccacgtggcactcccagacgaggttcaggtggacaggtgggtcgngggacagccttcactcgtcaccatcgacagacgtggacgtcctaggaacgtattttcgctacgttacttatttactgtccgagctagtatacggtggggacgtacggtcggaccgaacgggaccgaaggtaggaaacgtacgaaacgtaacgtgtacggtcgtacgacacctatcgttcgttacttctacttccctacccgctactcgttaggtagttgttgtcgtacgtggtacggcgggtacgtcggacgaggcggacngtaagcanncnggn

SEQ ID NO: 228815 - DNA, 613 bp, Homo sapiens
  misc_feature: GYAE6OF01ARNV7.33.85.H08.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggccctccaggcctcctcttctatgatgcatccaacnggccactggcatcccagccaggttcagttcggcggtgggtctgggacagtacttcactctcacatcagcagcctagacgcctagaagtatttgctagtttattactgtcagcgagtcgtagctaacgtggttcttcgggtaccgttccgggaccgtaaacgggaccgtaaggtacgggaaacttaccgaaaacggtacgtcgggttacgggccgttacggaccctaacccgtcttacccggtttacggtttacccttttaccgtacccgttttcccctttacccccggtacccttaacgttacccgg

SEQ ID NO: 228816 - DNA, 695 bp, Homo sapiens
  misc_feature: GYAE6OF01EAXBO.33.85.H08.1.454.CMB.1.raw
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccagataccacggagtaattgtgttgacgcagtctccaggcaccctgtctttntctcgagggacagacnccaccctctcctgcgagggccagtcagtactgtagcgagcggtctttcgtagccgtaggtaccagacaacgaacccgtggcccaggcctccgagccttcctctttctatggatgactatacccaacgcgggccacgtggacctactacccgagtacccgtaggtttcgaggggtcgggtcgggtcgggttacggcggggaacctacggtacctttaccgtacctccgtaccaacctacgtaccgacgaccgtaacgtccgtaacgtacgtccgtaacggtaagtttacgttttacgtacgtttaagttttaacttacgttgtacgtacgtacgttagtacggtacggtacggggtacgtacggttaccgggacggtaacgggtaacgtaagggtaacggtaaacgtaacgtaaacgtacgttacgggtacggtacgtacgtacaaccgtacttccgttacggttaccttacgttacccttccgtcccgtacg

SEQ ID NO: 228817 - DNA, 698 bp, Homo sapiens
  misc_feature: GYAE6OF01B5IS0.33.85.H08.1.454.CMB.1.raw
  modified_base (200)..(200): a, c, t, g, unknown or other
  misc_feature (200)..(200): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaagngccaccctctcctgcagggccaatcagagtgttagcagacaactacttagcctaggtaccagcagaccacctggaccaggcctcccgaggccctcctacactcccagttcggtcgaccactcccgaacccgaggggcccaacgttcgggacctaccgtacccccgaagtaaccgtagggtttaccgaaggttcgggacgtaggttcggggtccgtacgggaactaacggtaccttactaacgtttccctaccgtaacctactacgaacgtaccgaaggtaccgtcggaacgtaccgtagtaagttattttcgacgtacggtttagttactttacgtacgtactaacggtacgtaaggtttaacggttacgttaccgtaagttcccgttaccggtaccggttaccgggaccgtaaacgggacccgtaaagggtaacggtaaacgtaccgaaaacggtacggtggtacgacgtcgaccacctactcgttcgttcttaccg

SEQ ID NO: 228818 - DNA, 889 bp, Homo sapiens
  misc_feature: GYAE6OF01AC78L.33.85.H08.1.454.CMB.1.raw
  modified_base (200)..(200): a, c, t, g, unknown or other
  misc_feature (200)..(200): n is a, c, g, or t
tcagtacacacactcacgaccggtgctcgatttagtatcactcagtcgcggggaggaactgctcagttaggacccagagggaaccatggaagccccagctcagcttctcttcctcctgctactctggcctccagactaccaccggataaattgtgttgacacagtctccgccacctgttctttgtctccgaaggggaacncgcccacccttctccgtgcgacgggccagtcagagttgttagccggtactacgccgtacggtaccaacgagacgtaccgtggacccgaggccctacccggagggtcccttccgtcacgttcccgaagtcggggtactaccaccgtaccccgaaccggcggggtaccctaacgttcgtaccctaaccctacccggtacgtaaccggtacgggtttccgaggggttccggaccggttaaggggtttccggggttccgtaacgggggtaaccttaccggttaccttttaactaccggtttacctacccggtaacttaaccgtacggaacggtccctaagggtaccggttacgggaccggttaccgtaagggttaaacgtttcgttttacgtaagttaacgggtttcgttaaacgtttacgtcgttaaccggtacggtacgtttaacggggttacgttttaccgttaaccgttccgtttacccggttaaccgttacccgggtttaccgggaaaccgggtaaaccgggttaaccggtaaacggggttaaaccgtaaaaccggtaaccggtaaaccgttaaaccgggttcggtaacccgggtaccgttacgtaaacccgtccgttacgttacccgttcggtttaaccccttacggttaacccccttttcccggtaccccgtttacggtaacccgg

SEQ ID NO: 228819 - DNA, 694 bp, Homo sapiens
  misc_feature: GYAE6OF01EO1VK.33.85.H08.1.454.CMB.1.raw
  modified_base (146)..(146): a, c, t, g, unknown or other
  misc_feature (146)..(146): n is a, c, g, or t
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (429)..(429): a, c, t, g, unknown or other
  misc_feature (429)..(429): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccgganaaattgtgttgacacagtctccggccacctgtctttgtctccgaggggaaangcccaccctctcctgcagggccagtcagagtgttagcggtactagcctggtaccaanagacgacctggccaggcctcccgaggcctcctcttctatgatcgcatccgaacgcgggccagtcggcactcccagcccaggttcaggtcgggcggtgggtacgtggggactaggtccttcaccttctaccaacctagtccagccacggtccctaagcgtccgtagtaaacgttnttttacgactttaagttttactacgttgtactaggaccgtagtacgtaacgcgttaacgttgggttacgttacgggtaccgggtttaccggaacccggtaaacggggtaccgtaaacggggttacggtaaaacctaccggtaaaaaccggtaacggtttcgggtaccgggtaccgtttacggaaccccgttaacgtacgttcccgtttacgttacccgtttacctaccgttttaccccccgttcccgtaccgttacgttaaccgg

SEQ ID NO: 228820 - DNA, 749 bp, Homo sapiens
  misc_feature: GYAE6OF01DXKW2.33.85.H08.1.454.CMB.1.raw
tcagtacacacactcacgaccggtgctcgatttagtatcactcagtcgcggggggggaggaactgctcagttaggacccagagggaaccatggaagccccagctcagcttctcttcctcctgctactctggctcccgaagggggaaagagccaccctctcctgcagggccagtcagagtgttagcagcaactacttagcctggtaccagcagacacctggccaggctcccgaggctcctcagtccatgtgcactccacaggccacgtggcacgtcccagacgtacggttcgagtcggctaggtgggtacgtggggaactacggtaactttctacttcctactaccagtcacgacagaccgtggaacgtccgtaggaaagttattttaggactaaggtttagttagtttacctaggtttaccgaaggtactaacgggtttaacggttacgtttacaacgttcccgttacccggtaacccggtttccgggaacccgtaaacgggggtaaaccctaaaggggttaacggtaaaaccgtaaccggtaaaaccggttaccgttagggtaacggtacgtacggaaccctaacgtacgtttcgttacgttacctttacgtaccctttccccgttaccccgaccttaacgttcccggtaggtttaacggttcgggttacgtttacggtaccggttacggggaccgggtaccggggttcggtaacggggttaccggaaacgggtccggtacgtaacgg

SEQ ID NO: 228821 - DNA, 694 bp, Homo sapiens
  misc_feature: GYAE6OF01C24LP.33.85.H08.1.454.CMB.1.raw
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (685)..(685): a, c, t, g, unknown or other
  misc_feature (685)..(685): n is a, c, g, or t
  modified_base (687)..(688): a, c, t, g, unknown or other
  misc_feature (687)..(688): n is a, c, g, or t
  modified_base (691)..(691): a, c, t, g, unknown or other
  misc_feature (691)..(691): n is a, c, g, or t
tcagtacacacactcacgaccggtgctcgatttagtatcactcagtcggcggggggggaggaactgctcagttaggacccagaggaaccatggaagccccagctcagcttctcttcctcctgcctactctggcctcccgaaggggaaagacgcccaccctctcctgcacggcagtcaagtgtgttagcgggtacctagcctggtaccanagagacctggccaggcctcccgaggtcctcctnttctatgatgcactccaacgnggccagtcggcactcccgagtcccgtaaggttccaggtggcgggttggtcgtgggactacggtaccttcacctcacctaccatcgacagtccgtaggacggccttaaggaagttacgttttcggaccgtagtttaccttatttaacgtgttccgagtacgtaagttaagtacggttacggggtaacgtaccggtttccgggaaccgtaaacgggtaccgtaaagggttacggaaaactaccggtaaaacgtaaggtggtacggtactacgaccctaacgacttcgttacgttactttcccagtttcccccgttacccgtccgttaattcccgtaggttaaacggtttcggttaggttcgttaccggtacggtacgggtacgggtaccgttacgggacgaacgggcgtaacgagtaagctacngnngtnacg

SEQ ID NO: 228822 - DNA, 758 bp, Homo sapiens
  misc_feature: GYAE6OF01CUGWP.33.85.H08.1.454.CMB.1.raw
  modified_base (169)..(169): a, c, t, g, unknown or other
  misc_feature (169)..(169): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggcctccagactaccgaaccgggtaattgtgttgacacagtcnccagccacctgttctttgtctacgaaggggaaancgcctaccctctccgtgcgaggccagtcagngtgcgtaggcagactaaacgttacgaccgtacggtaaacccaaaacgtaaaaaccgtcggaaccaacgaccctacccgaggtccctacctactactccgtaattagaacgtccgactaaccgttaccccgaaccggtacgggtacccaagttccggacctaaccgtacccgacgtacccgtaggttacgaacggtcggcgtaaggtcgggtacgtacggactagtaccttacgaccttccacaaaccgtatacggaactacgacgtaccgtaaggaccgtacgttaaaggtaagtttactttaagaccgttttaaagtttacgttactacggttactacgtaaccgtaggtacgtaacggaccctaacggtacccgtacccgttaaacccggtacccgttaaccgggaacgtaacccgggaactaccggtaacgaggtaaaccgtaaaacgttaacggacttagggaccgtgtaacccgacttaccgtaccgtttgttaaccttcctaacccgtcgttaccccg

SEQ ID NO: 228823 - DNA, 813 bp, Homo sapiens
  misc_feature: GYAE6OF01DSOKN.33.85.H08.1.454.CMB.1.raw
tcagtacacacactcacgaccggtgctcgatttagtatcactcagtcgcggggggggaggaactgctcagttaggacccagagggaaccatggaaaccccagcgcagcttctcttcctcctgcttctctggctcccagataccaccggagaaattgtgttgacgcagtctccagcaccctgtctttgtctccaggggacagacgccacctctcctgcgagggcagtcagactgttagcagcggtcttcttagcctggtacagcaagaaacctggccgaggcctccgacggtcctcctcctctagtggtcgacacgtcccaccgtacgggccacgtcggctacgtccagacgtggttcaggtcggctaggtgggtcgtagggacgtagtaccttaccgacgttccaccgtaccctagtacccgacgtaacggtaaccgttacgggaaccgttccgttaacgggtaaaacggttttcgttttaacgggtaccgttacggttttaccttttaaacgttttaacccgttcgggtaaccgttaccgggtaacttaacgggtttaacgtttaacccggggtttaaagggggaacgggtttaaacccggggttttacccgggaaccgggttaaaaccgggggtaaacccgttaaagggggttaccggttaaaaacgggttaacccggtaaaaacccggtaacggtttacgggtaccgggtaccgtaacgggtacccttaaaccggtacgtttacccggttcggtttacccctttaaacggtccccgttttaacccgtcccccggttaaccgttaacccgg

SEQ ID NO: 228824 - DNA, 650 bp, Homo sapiens
  misc_feature: GYAE6OF01D2FAI.33.85.H08.1.454.CMB.1.raw
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (576)..(576): a, c, t, g, unknown or other
  misc_feature (576)..(576): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccgaccggagtaattgtgttgacacagtcctccggccaccctgttctttgtctaccgaagggaaancgcccaccctctcctgcgaggccagtcagagtgttagcggtactgcctaggaccaacagacgactggccacgcctaccgagccttcctcttcatgatcgactaactaccaacgacggccagtcgcacgtcccagtcgtaggtcaggtggtcggttaggtcgagggacacggtcttcactctccgacncgtacagtacacgacctagaccgtactaaggtaacgtttntttacgntttaacgtttaacttacgtacgacgtagtaccgtaggtacgttaacgacctttaacggttcggttcgttagggttaaccggttacccggaaccgtaaacggggtaaccgtaagggtacgtaaacctaacggtaaaccggngtacggtcggacgtacgacctaccggtacttcgttcttacccgtattaccctcccgtttaccgacttgttacgg

SEQ ID NO: 228825 - DNA, 721 bp, Homo sapiens
  misc_feature: GYAE6OF01EZTWF.33.85.H08.1.454.CMB.1.raw
  modified_base (204)..(204): a, c, t, g, unknown or other
  misc_feature (204)..(204): n is a, c, g, or t
  modified_base (671)..(671): a, c, t, g, unknown or other
  misc_feature (671)..(671): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagactaccaccggagtaaattgtgttgacacagtctccggccacccgttgtctttgctaccgaaggggaaancgccaccctctcctgcgagggcctagtcgaaggtacgttggttacgaccgggtacctaggtccctagggtaccaacaggacgaccgtggccgaggtcctcccgaggcccttccgtctctatcgtatcgacactccgaacgacgggccagtcggaccaccgtaccgacgtccgtaggttcgaagggtcgggtacggttcgggtcgtacggggtaacaccgggtacctttccgacctttcccgtaaccaccgttacgccgtacgtaccgacgtacgtaacgacgtacctagtagttactttcgtacgtttagtttaacgtacgttgtacgtcggactaggtcgtagaccgttaacggttcggtaacgttcgggttaacccggtccggaacggtaaccgggtaaccggtaagggtaacgaacgtaaaccgtaaacggtacgtacgacggtactaccggacctaacggttntccgttacgttccgtttactacccgttacccgtaccctcgtacggttacg

SEQ ID NO: 228826 - DNA, 600 bp, Homo sapiens
  misc_feature: GYAE6OF01DPXES.33.85.H08.1.454.CMB.1.raw
  modified_base (197)..(197): a, c, t, g, unknown or other
  misc_feature (197)..(197): n is a, c, g, or t
  modified_base (354)..(354): a, c, t, g, unknown or other
  misc_feature (354)..(354): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccacctgtcttgtctccgaggggaaangccaccctctcctgcagggccagtcagagtgtagcgggtacctagcctggaccaacagacgacctggccaggcctccaggccttcctcttctatgatgctatccaacgcgggccagtcggcactcccagccgtaggttcaggtcggcgggtggtcgngggacagtaccttcactcactacatcagtcagtacctagcgtacctagaacgttattttcgactttagtttacttacgtcgtacacgtacacgtacgtacgtacgtaacgttcggtacgtttcgggtaaccggttcggaaccgtaacgggacgtaagggtagaaactacgtaaacgtacgtcggtacggacgtcgaccacgtcgtacgttcgttccgttactacttcccgttcccgtctcgttacg

SEQ ID NO: 228827 - DNA, 783 bp, Homo sapiens
  misc_feature: GYAE6OF01D5C25.33.85.H08.1.454.CMB.1.raw
  modified_base (242)..(242): a, c, t, g, unknown or other
  misc_feature (242)..(242): n is a, c, g, or t
  modified_base (773)..(773): a, c, t, g, unknown or other
  misc_feature (773)..(773): n is a, c, g, or t
  modified_base (778)..(778): a, c, t, g, unknown or other
  misc_feature (778)..(778): n is a, c, g, or t
tcagtacacacactcacgaccggtgctcgatttagtatcactcagtcggcgggggggggaggaactgctcagttaggacccagagggaaccatggaagccccagctcagcttctcttcctcctgctactctggctccgaaggggaaagacgccaccctctcctgcgagggccagtcagagtgttagcggtactagctggtaacaacagacgacctggccaggcctccgaggccttcctcttnatgatgcatccgaagcgggccacgtggcactccagccgtaggttcaggtggtcggtagggtcgtaggggactaacggtaccttcctaaccgtcctaccgaacctaagtccaaggccaacggtaaccccgtaaggaaccgggtaccttaagggtaaaacgttacgttttttaccggacgttttaaaacggttttaatttaccggtagtttacccgaaggtacctaacgggtaccggttaaggtaaccctaaagggtttcgggttaccgtttacggggtaaccggtttaccgggaaacccgggtaaaggggtaaaccccgtaaaggggttaacggtaaaaacttacgaaaaaccggtacgtttacgggagtacctgaacccgtaactacgttactttcgtactttacgacccttacccgttaccccgacttaacgttaccgtaggttaaccgttggtaacggtttacgaacggtttacgggaccggggtacgggtacgttacgggaaccggtaacggtcccgataacgggtancgtancgtac

SEQ ID NO: 228828 - DNA, 676 bp, Homo sapiens
  misc_feature: GYAE6OF01BBZR7.33.85.H08.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (659)..(659): a, c, t, g, unknown or other
  misc_feature (659)..(659): n is a, c, g, or t
tcagtacacacactacacgaccggtgctcgatttagtatcactcagtcgcggggaggaactggcgtcagttaggacccagagggaaccatggaagccccagctcagcttctcttcctcctgctactcgtggcctcccagactacccaccggaagtaaattgtgttagacactagtctccggccacctgtctttgtctccgagggtaancgccaccctctccgtgcgacgggccagtcaagngttgtacgcggtacctagccgtggaccaagagtacgaccgtggccgaggcctcccgaggtcctcctacttctatgactgcactccgacgtaggccagtcggcactcccaagccctagttcaggtcgatcgggtcgtcgtacgggacaacgtctttaccactccactaccattaccgaacaccgtaacctaaggtaacttaggtaattttactttcgtaattttacgtactacggttacaaactgtaccgacgtcacgtcctacggtccctgttcccgtacgggttcgggaacgggtaccggaaggttacggtatacgggttacaaacccgttaaaaggcgtttcggaacggtccgtacggtaaccacctttaagtccgggtttaacgtccctttaaagccccctttacccggtacccncccgttttaggtaccgg

SEQ ID NO: 228829 - DNA, 693 bp, Homo sapiens
  misc_feature: GYAE6OF01EUB71.33.85.H08.1.454.CMB.1.raw
  modified_base (207)..(207): a, c, t, g, unknown or other
  misc_feature (207)..(207): n is a, c, g, or t
  modified_base (334)..(334): a, c, t, g, unknown or other
  misc_feature (334)..(334): n is a, c, g, or t
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
tcagtacacacactcacgaccggtgctcgatttagtatcactcagtcgcgggggggggaggaactgctcagttaggacccagagggaaccatggaagccccagctcagcttctcttcctcctgctactctggcctcccgaggggaaagacgcccaccctctcctgcagggccagtcagagtgttagcggtacctgcctggtaccaanagagacctggccaggcctcccgaggtcctcctcttctatgatgcactccaaacgcgggccacgtcggcactcccagcccgtaggttccgaggtcgggcggtgggtcgtgggacagtacttcgactcncaccatcagcacgcctagacgtaccgtagtaagttagtttgacttagtttacttacgtcgtacagcgtacggtcgtaagtaccgtacgttcggttcggttcggtaccggtttccggaacgaacgggtacccgtaaagggtaacgtaaacgtaaccgaaacggtacgttaggtacggacgtacgacctacgtacttccgttcgttacctttacgtaaccttccccgttaccccgaccttacgttacgttacgtaagttcggttacggttacgttacggtacggtaccggggttaccggggtcggttacggggaacccggaacggggttacccgtacggttaagtaccggtncgngtaccg

SEQ ID NO: 228830 - DNA, 532 bp, Homo sapiens
  misc_feature: GYAE6OF01B51QZ.33.85.H08.1.454.CMB.1.raw
  modified_base (334)..(334): a, c, t, g, unknown or other
  misc_feature (334)..(334): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
  modified_base (522)..(522): a, c, t, g, unknown or other
  misc_feature (522)..(522): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccgaggcctcctcttctatgatgcatccaacgaggccactggcactcccagccaggttcagtggcggtaggtctagggacagacttcgactcctcaccatcagcagcctagngcctagaagtattttgactagtttacttatcgtacagcagtcgtagcaacgttgtcgttggacgttccgcgaaggactaaggtagaaactanaaacgacgtgtgctgcctacatccgtntcttcacttccgtcccgactatcgtagtagtcgtagtcgtacgtgacggtcggcgtcgacgaacggcanactagnnntn

SEQ ID NO: 228831 - DNA, 596 bp, Homo sapiens
  misc_feature: GYAE6OF01BQYB9.33.85.H08.1.454.CMB.1.raw
  modified_base (355)..(355): a, c, t, g, unknown or other
  misc_feature (355)..(355): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatcccaacacggggccacgtggccactcccagccaggttcagtggcggtgggtctggggacagacttcactctcaccatcagcagcctagacgcctagaagtagttttcgntagtttattacgtgtcagcagcgtagctaacgtggtcttggtacttcacgccgaagggaccgaagggtacgaaatacgaaacgacgtaggtcgactcgacctacctgtctcgttcttaccgacgttcccttcccgacctacgtaccgtaggtaacgttcggttacggtacggttacgtgggtacgggtcccggggtcgtacccgggacgaacggggtccgtaacgtaagtacggngtagng

SEQ ID NO: 228832 - DNA, 735 bp, Homo sapiens
  misc_feature: GYAE6OF01E14JG.33.85.H08.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
tcagtacacacactcacgaccggtgctcgatttagtatcactcagtcggcggggggggagaactgctcagttaggacccagagggaaccatggaacgccccagctcagcttctcttcctcctgctactctggcctcccgaaggggaaancgccctaccctctcctgcgagggccagtcagagtgtagcggtacagcctggtaccaagngacgccgtggccacggcctcccgaggcctcctcttctagtgatgacctactaccaacggcggtaccacgtcggcctacctcccgacgccgtaggttccaggtcggtcgttaggtcggtcgtgggactacggtacttccgtacgtcctaccacctactacgacgtacgacgtaccgtaagacgtacctaaggtacgttacttttacggacgtttaagtttacttacgtacgtacgtacgcgtacgtacgtacgtaccttaacggttcggtttacggtacggttacccggtaccggtaaccgggtaaaccgggacgttaaacgggtaacgtaacgtaacgtaaccggtacgttacgggtacgtaccgtacgtaccctacgtacgttcgtacgttccgttaccgtacccgttacccgttacccgtacttacccgttacgtaggttacgttacgtacgttaccggttaacggtcggttacggggcggttacgggaccggaaggttaccggcggtaacgttagcgtgcctag

SEQ ID NO: 228833 - DNA, 624 bp, Homo sapiens
  misc_feature: GYAE6OF01EDGZC.33.85.H08.1.454.CMB.1.raw
  modified_base (145)..(145): a, c, t, g, unknown or other
  misc_feature (145)..(145): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaangccaccctctcctgcagggccagtcagagtgttagcggtacctagcctggtaccaacagagacctggccaggcctcccaggctcctcttctatcgatgacatcccaaagcggggccacgtggccatcccagccaggttcaggtggcggtggtcgtgggacagacttcgactcctcaccgactcacgacacgcctaagacgtcctagaacgtattttcggacttagtttattacgtggtacacggtctagtcgtaacgcctaacgttggttacgttaggtaccggttaccggacgtaacgggtacctaaggtacgaaactacgaaacgaccgttggtcgtactcggaaccacctagttccgtcggttactttaccgtacttcccgttccccgtacctagttcccgtagtaacggtttgtggttcgttaaccgtgggaacggtcgggtcctgggacgtaacgggcgtaacagtancngtng

SEQ ID NO: 228834 - DNA, 796 bp, Homo sapiens
  misc_feature: GYAE6OF01AI6VB.33.85.H08.1.454.CMB.1.raw
  modified_base (666)..(666): a, c, t, g, unknown or other
  misc_feature (666)..(666): n is a, c, g, or t
  modified_base (673)..(673): a, c, t, g, unknown or other
  misc_feature (673)..(673): n is a, c, g, or t
  modified_base (724)..(724): a, c, t, g, unknown or other
  misc_feature (724)..(724): n is a, c, g, or t
  modified_base (769)..(769): a, c, t, g, unknown or other
  misc_feature (769)..(769): n is a, c, g, or t
  modified_base (783)..(783): a, c, t, g, unknown or other
  misc_feature (783)..(783): n is a, c, g, or t
  modified_base (788)..(790): a, c, t, g, unknown or other
  misc_feature (788)..(790): n is a, c, g, or t
  modified_base (793)..(793): a, c, t, g, unknown or other
  misc_feature (793)..(793): n is a, c, g, or t
  modified_base (796)..(796): a, c, t, g, unknown or other
  misc_feature (796)..(796): n is a, c, g, or t
tcagtacacacactcacgaccggtgctcgatttagtatcactcagtcgcggggggggagaactgctcagttaggacccagagggaaccatggaacgccccagctcagcttctcttcctcctgctactctggcctccgaggggaaagacgcccaccctctccgtgccgacgggccagtcgagtagttggttacggccgggtacctacggccgtaggtaacccaaacgagacgacccgtcggaccgacggccctacccgaggtcccttcccgttcttacctagttacgactcgacctaaccgtacccgaaaccggtaccgggtaccctaccgttcggaccctaacccgtacccccggtacggtacccgttaggggtttaaccgccgggggtttccgggggtccggggtttcggggttaccggtaacgggggtaaccctaccggtttacccttacccgtacccgtttcccgtaacccaacccgtattacccgacgtaccgacgttaccgtacggtcgtacgtaaggttaactttacggttctaacgttttagttactacgttcggaccgtagaccgtcggtactcgacgttacgttcgggttccgtacgggtaccgtaccgggaacgacgggtacgtaaacggtaacttaaccgaaacggttaagtcgnggtaacncgtacgccctagttgttccttacttcgtaaccgcccgtttccgtaacccgngttcttaggacgttacgttgttagccgtaggcggacggtgtacgnggacgaccggttancgtannncgngtn

SEQ ID NO: 228835 - DNA, 712 bp, Homo sapiens
  misc_feature: GYAE6OF01C2TGB.33.85.H08.1.454.CMB.1.raw
  modified_base (548)..(548): a, c, t, g, unknown or other
  misc_feature (548)..(548): n is a, c, g, or t
  modified_base (663)..(663): a, c, t, g, unknown or other
  misc_feature (663)..(663): n is a, c, g, or t
tcagtacacacactcacgaccggtgctcgatttagtatcactcagtcggcggggaggaactgctcagttaggaccagagggaaccatggaagccccagctcagcttcgtcttcctcctgtctttctctcggcctccgagataccgaccggaagtaattgtgttagacgacgtagtcctcgaggcctacccgttgttccgtttcgtcgacccgaggggacaggaccgccaccgttctaccgtgacgtgggccagtcgaagtctgtagcgagtcggtacttcgtagccgtagtaccagtacaacgtaacgcggtaaccgcggtcctcccgaggtccgtacacgctacgtacgatcgactaccacggtcggactacgtcggacaccgtccggaacgtccggtaggttacgacgttcggacgtaggtcggtaaccggcggtaacgtcttaccgttcaacgtctaaccactacgtacacgacaacgttactaacttaagtattttacgttattaacttttatacggtactacgtaactacgtaccgtaacggntaccggacggttttacaccgttccttaacgggttcgttaccggggaaggttaccggtaccggttaacgcggtttaccgaaacccgttaagttaaacccggtgttacggggtaccncggtttacacgttaacgtccgacttttacgccgttacctagttccccgg

SEQ ID NO: 228836 - DNA, 611 bp, Homo sapiens
  misc_feature: GYAE6OF01EKFBU.33.85.H08.1.454.CMB.1.raw
  modified_base (145)..(145): a, c, t, g, unknown or other
  misc_feature (145)..(145): n is a, c, g, or t
  modified_base (205)..(205): a, c, t, g, unknown or other
  misc_feature (205)..(205): n is a, c, g, or t
  modified_base (608)..(608): a, c, t, g, unknown or other
  misc_feature (608)..(608): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaanagccaccctctcctgcagggccagtcagagtgttagcgggtacctagcctggtaccaacngagacctggccaggctcccaggctcctcttctatgatcgcagtcccaaacgacgggccaccgtggccactccccgagcctaaggttcagtcggcggtgggtctggggacagaccttcacgtctcaccagtccagcacgtcctaagacgcctagaacttgttttgactagttttatactgtcagtctacgcgtagactaacgtggttcttggacgtttcggaccgtaaagggaccgaagggtacgaaactacaaaccggtaactggtggctacggaccacgtatccgtagttccttacaccttcccgttccccgacctagttccgtagtaacggttgttagtacgttacgttaggacggtcggggactcgggaaccgaacgggtcccgagtaacgtaggatcgngtg

SEQ ID NO: 228837 - DNA, 762 bp, Homo sapiens
  misc_feature: GYAE6OF01CCV2Q.33.85.H08.1.454.CMB.1.raw
tcagtacacacactcacgaccggtgctcgatttagtatcactcagtcggcggggggggaggaactgctcagttaggacccagagggaaccatggaagccccagctcagcttctcttcctcctgctactctggctcccgaggggaagacgccaccctctcctgcgagggccagtcagagtgttagcgggtacctagcctaggtaaccaaacaaaaacgtcggaccagacctcccgacggcctcctcactctatgactcgctactccgaccgacgggccacgtggacctactcccgaggtcccgtaggttcgaggtcggacgtagggtcggggtacgtagggaactacggtaccttcgacctcctaccaccgtatcgacgcctacgaccgtaggaccgtctaggtaacgttcgttttcggactttaacggtttacttacggttcgttcgtacgtacgtacggtaccgtacgtacccgtaccgttaccgggtaacccttaacccggtaccccggttacggggtaacccgaacggggtaacccgtaaccggtacggtaacgggtaaacggttaaaccggttaaacggtaaccggtttacgggtaccggtacggtaccggacctaacccgtacgttaccgtttcgtttaaccgtccttaccttcccgttacccgtactacgttacgtacggttcggttacgtcggttaccgtggcgggtccggtcggggtacgtcgggaacggaccggtacgaacgtacgatgagtg

SEQ ID NO: 228838 - DNA, 832 bp, Homo sapiens
  misc_feature: GYAE6OF01CIJZL.33.85.H08.1.454.CMB.1.raw
  modified_base (142)..(142): a, c, t, g, unknown or other
  misc_feature (142)..(142): n is a, c, g, or t
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
tcagtacacacactcacgaccggtgctcgatttagtatcactcagtcggcggggggggagaactgctcagttaggacccagagggaaccatggaagccccagctcagcttctcttctcctgctactctggctccgagggaancgccacctctcctgcgaggccagtcagtagtcgttaggccggtactagccgtggtaaccaagnggtacgaccgtggcctaggcctaccgaggcctcctnattctatgactcgcactccgacgcgggcctacgtgacctactcccgaggccctaggttccgaggtacggcgtacggttggggtctagggggactaggtaccttcgacttacccacgtacctacgtacgacggtaccgacgtaccgtacggtaccgtaccgtaggtaacgtttcgtttttaacggacgttttaacggtttttaaccttacggttagttccgtacgtacgtaggtaccgttacgaccttaacgggtccgtaacccttacgtaccggtttaccgggaaccgttaaacgggacctaacggtacgtaaggtaaccgtaaacgtttaaaccggacgttagggtaccggtacttaacgacccgtaacgtaccgtttaccggtttctttaacccggttcccttaccgttttacccccgttaaccccgggactttaaacccgttccggggtttaaagtaaacccgggttttttggtaacccggtttaacgggttacccggtttagggggaaccccggggtttcccggggtacgtttaacggggaaccccgggtaaacggggtcccttaaaagggttcccgggaacgttcg

SEQ ID NO: 228839 - DNA, 717 bp, Homo sapiens
  misc_feature: GYAE6OF01BK980.33.85.H08.1.454.CMB.1.raw
  modified_base (206)..(206): a, c, t, g, unknown or other
  misc_feature (206)..(206): n is a, c, g, or t
  modified_base (712)..(712): a, c, t, g, unknown or other
  misc_feature (712)..(712): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctaccgaagggggaaagacgcccaccctctcctgcgagggccagtcagagtgttagcggtactgctgtaaccanagacgacctggccaggcctcccgagtcctcctcgttactatagatcgactacttaccgaacgacggggtccacgtacggacctaacctcccgtaacggccgtacgggttaaccgtaggggtcggggttaccggggtggggtaccgtaggggtaactaacggtaccgtttaccaaccggttcctacctaaccgacttacgacgacctacgaccgttaagctaccggtagtaagttctttagacgtttagtttactacgttgacctaggtactacggtacgtacgtacgtacgttaggttccggttacgtaccgggttaccggtaacggaaccgggttaacgtaagggtaaacgtaacgtaaccgtaaacgtacggtacgtacggtcctacgtacctacgtacttccgttacttctactccgtacccttcccgtactagtacgtagtacgtttaggattcggacggtggtccggtagggtacgtacggacggtactacgacagtacgntgntn

SEQ ID NO: 228840 - DNA, 723 bp, Homo sapiens
  misc_feature: GYAE6OF01EHKGE.33.85.H08.1.454.CMB.1.raw
  modified_base (101)..(101): a, c, t, g, unknown or other
  misc_feature (101)..(101): n is a, c, g, or t
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
  modified_base (706)..(706): a, c, t, g, unknown or other
  misc_feature (706)..(706): n is a, c, g, or t
tcagtacacacactcacgaccggtgctcgatttagtatcactcagtcgcggggaggaactgctcagttaggacccagagggaaccatggaagccccagctnagcttctcttcctcctgctactctggcctccagactaccacggaagtaaattggtnttgacacagtcnccacgccaccttgttctttgtctaccgaggaagaaagtccgcccacctcactacgtgacgacgggaccagtacgagtaggtattcgacctattcgttcgttcggaccgtaggtaacctaacgaacggtaaaccgtcgggacctaggtcccgtacccgtacggtccttacccgttacaccgttaccgaaagtacgtaccgactaaccgtaccaaacggcggtaccacgtcgacctacgtacccggagtccgtacggtccgaggtccggttaggtacggtgggtaccgtcgggaaccgttacgtaaccgttccgacctttccgaaccctacgggttaccacgtacgacccgtacgtaccgaacgtccggtacgttacgggactttagtacgttactacgtttaagtttccgttaacgcgttaacgagtccgtaacgtcctactacgttccgtaccggtacctccggttaccaccgttccggtaacccgagtacgacgtagttacgtaggaacttcggtaacgaacttgtcgtaggaccnccgttacccgtgttacg

SEQ ID NO: 228841 - DNA, 966 bp, Homo sapiens
  misc_feature: GYAE6OF01BBL9M.33.85.H08.1.454.CMB.1.raw
tcagtacacacactcacgaccggtgctcgatttagtatcactcagtcgcgggggggggaggaactgctcagttaggacccagagggaaccatggaacgccccagctcagcttctcttcctcctgctactctggcctaccgaaggggaaacgacgaccctaccctcctccgtggccgacgggccacgtcaggtaggttggtttacggtaccggggttaaccttacggcccgttaacgggtaacccaaacgacggaacgtacccggtcggaccgacgggtaccctacccgcggtccttcccttcttacttatgatcgctaactaccgaacgcggacctacgtcggacctacctaccgacgtaccggtacggttacgtacgggtcggggtccggggttacgggtacggttacggggaccgtacggttaccttaccgtaccgttacctaccgtaaccgtactaccgtaaccgtaaccctaaaaccgttagtaaaccgttttaacgtaaacttttttacttttttaccgtttaaatttttttaaccgtttaacggttaacttaacgtaaactttaaccgtacccggacggttacctacgggtacccgtttaccggtacctttaccgtttacccggtttaccggggtttaccggggtaacccgggaaccggggttaaccggtaacggggttaaaccgggtaacggtaaccggttaaaaccggtaaaacccggttaacggtttaccgggttaaccggtaccggtaaaccgtaaccccgttaacttacggtttaccctttacgtttaccttacccgttacccttcccggttacccgtacccgtttaacgttccggttaacggttacggttacggtttacggttaccggttagggtaaccgggtcgggtaccggggttaccgggtcggtaacccggggaacgggtaccgtaacgttacgtacggatcgagtcgac

SEQ ID NO: 228842 - DNA, 649 bp, Homo sapiens
  misc_feature: GYAE6OF01ANVQF.33.85.H08.1.454.CMB.1.raw
  modified_base (145)..(145): a, c, t, g, unknown or other
  misc_feature (145)..(145): n is a, c, g, or t
  modified_base (200)..(200): a, c, t, g, unknown or other
  misc_feature (200)..(200): n is a, c, g, or t
  modified_base (644)..(644): a, c, t, g, unknown or other
  misc_feature (644)..(644): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaangccacctctcctgcagggccagtcagagtgttagcggtactagcctggtaccaanagacgacctggccaggcctcccgaggcctcctcttctatgatgacctactcccaaacgacgggccacgtcggaccactccccagccgtaggttcaggtggcggtggtcgtggacagtctcactctcaccatcacgcacgtcctaagacgtcctaggtaacgttactttttggacttaagttttaacgttactggttacacgcgtacgccgttaacgactaacggtttgggttaccgtttcgggtacggtttacccggaccgaaacggggtaccctaaagggtaacggtaaactaaccgtaaaacggtaacgttggtacggacttcgacctacctagtccttgttccttactacttcccgttcccgacctactacgttagtaacgttgtagtggttacgtcgggaacggtccgggagtcgggacgaccggtcgacgtaacgtgcngtgcg

SEQ ID NO: 228843 - DNA, 926 bp, Homo sapiens
  misc_feature: GYAE6OF01B9VGE.33.85.H08.1.454.CMB.1.raw
  modified_base (150)..(150): a, c, t, g, unknown or other
  misc_feature (150)..(150): n is a, c, g, or t
tcagtacacacactcacgaccggtgctcgatttagtatcactcagtcgcggggaggaactgctcagttaggacccagagggaaccatggaagccccagctcagcttctcttcctcctgctactctggcctcccagactacccgacggaanaattgtgttgaacactagtccgtcccggcctaccctgtttctttgtcctaccggaaggggaaacgcgcccacccttcctccgtcgaccggacggcctaggtcgaaggtaggttaggttaacgggtaccgggttaacctacggtccgttaacgggtaacccaagtaacggaccgtaccgttacggcccgtaccgggtaccctaccccgtaccggtccctttacccgttaccgtttcgttaagtcgtacgttccgccgtaacccgtaccccgtaaacgggacccgggaaccgttaaccgggcggtacccgttaacccggtaccccgaaccgggttaacccggtaacgggtttcccggtaacggggtttaccggggggttcccggggttaccgggggttaaccggtaccggggggtaaaaccttaacccgggtttaacccggtttaaccccttaacccgttacccgttaacccgtaaaccttacccgtaaacgtaccccggtaacgacccggtaaacccgtagggtaacccgtacggttaacggttaagtttacgttttacgtacgtttaacgtttacgttaacgttccgtacgtaacgacgtacgtaccggtaacgtaccgtttacggttacgttcgggttacggtaacccgggtacgtaccgggtaacggaacggttaagtaacgaactaaccgggtaacgtacgtagggtcggtacgccgtaacgtaccttactcgttacgttccttacgtcctacccggtcctcgttcgtaacgg

SEQ ID NO: 228844 - DNA, 647 bp, Homo sapiens
  misc_feature: GYAE6OF01CUX32.33.85.H08.1.454.CMB.1.raw
  modified_base (144)..(144): a, c, t, g, unknown or other
  misc_feature (144)..(144): n is a, c, g, or t
  modified_base (155)..(155): a, c, t, g, unknown or other
  misc_feature (155)..(155): n is a, c, g, or t
  modified_base (357)..(357): a, c, t, g, unknown or other
  misc_feature (357)..(357): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (620)..(620): a, c, t, g, unknown or other
  misc_feature (620)..(620): n is a, c, g, or t
  modified_base (642)..(642): a, c, t, g, unknown or other
  misc_feature (642)..(642): n is a, c, g, or t
  modified_base (647)..(647): a, c, t, g, unknown or other
  misc_feature (647)..(647): n is a, c, g, or t
tcagtacacacactcacgaccggtgctcgatttagtatcactcagtcggcggggggggagaactgctcagttaggacccagagggaccagtggaagccccagctcagcttctcttcctcctgctactctggctccgaagggaancgcctaccctntcctgcagggccagtcagtagtgttagcgggttaccagccgtagtaccaactggacacctggccaggcctccgagcctcctagttcatgatgctactaccaacgagggtccaactcggcctactccccgagacccgtagttaccaggtgggtccggttgggtcgtacgggactacgaacttcgacctctacacctatcgganctacgccgtagacggtcctagtaagtcttttaggacttagtttactcgtagttanacgtcagtaccggtanacctaaccgttggtccgttacgggtaccgttccggaacgaacgggtaacgtaacggttagaaacgtaacgaaacgtctaggtcggtactacggacctacgtacttcgtacggttacctaccgtttacgtcccgtttacccgacgtgtaacccgtgtagttacggtgtcgttacgtgaacgggtgttaccggnaccgtaaggcgtagacgtgacnggtcn

SEQ ID NO: 228845 - DNA, 848 bp, Homo sapiens
  misc_feature: GYAE6OF01CNUJ3.33.85.H08.1.454.CMB.1.raw
  modified_base (837)..(837): a, c, t, g, unknown or other
  misc_feature (837)..(837): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctcggctccgaggggaaagacgccaccctctcctgcgagggccagtcagagtgttaggcgggtactagcctaggtaaccaacagacgacctggccaggcctccgaggcctcctcttcagtgatcgctactaccgaaacgcgggaccacgtcggaccactcccgacgccgtaaggttacgtaggttcggggcggggttcggggttcggtcggggaacgtacggtacctttaccaccgttccgtaccctaaccctacgttccgaacgtccgaacggtaccctaacggacgtacccgttaaggtaacgttagttttttacggtacgtttaacggtttttaacttaccgtttaggtacctaacggtacgtacggtaccgtaacggtaccgtaacggtttcgggttaccggtttaacgggttaccgggtttccgggaaccgggtaaacggggtaacccggtaaagggttaacgggtaaaacgttaaccggtaaaaaccggtacggttaagggttaccgggtaccgttacggtaccctaaaccgtttcgttaccgttacgtttacccgttaaccgttacctttacccccgtttcccgtaacccttacttaaccggttaggttaaaggtttcggttacggttacggttaacgggtacgggtaccggggtcccggggttacggtaccgggaacggttaacgggaccgtacgtaaggnggtacagtgac

SEQ ID NO: 228846 - DNA, 718 bp, Homo sapiens
  misc_feature: GYAE6OF01DNE5W.33.85.H08.1.454.CMB.1.raw
  modified_base (151)..(151): a, c, t, g, unknown or other
  misc_feature (151)..(151): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (568)..(568): a, c, t, g, unknown or other
  misc_feature (568)..(568): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaaggggaaagacncccaccctctcctgcgaggccagtcaggtagtgtaggcggtactagcctaggtacaacagacgacctggaccaggcctaccgaggcccttccttcttcattgatcgactaactaccaaacgcgggaccagtcggcaacctccccaggccgtaaggttcgaggtcgggcgggtggtcgtacggacacgtacctcactcctaccaccgatcggacnctacgtaccgnggaacgtcctaggttaagttnttttacgacgtttaagtttcttacgtcgtacgatacgacggtacgacgtacgtaacggtttgttaccggttacgggttaccgttaccgggaaccggtaaacgggtaaccggtaaagggttaacgaaaacgtaacgtaaaccggtaggtacggtacgtcgacgacctacgtnttcgttactcgtaccttacccgttcccttacccgtcgttacttcggtacggttacggttcgttacggttaccgttaggccgggtacgggtaccgggttcgggttaaccgggtacgggtaacggtaccggtaaggaacgttagcagtcgag

SEQ ID NO: 228847 - DNA, 735 bp, Homo sapiens
  misc_feature: GYAE6OF01E433J.33.85.H08.1.454.CMB.1.raw
  modified_base (688)..(688): a, c, t, g, unknown or other
  misc_feature (688)..(688): n is a, c, g, or t
  modified_base (731)..(731): a, c, t, g, unknown or other
  misc_feature (731)..(731): n is a, c, g, or t
tcagtacacacactcacgaccggtgctcgatttagtatcactcagtcgcggggggggagaactgctcagttaggacccagagggaaccatggaacgccccagctcagcttctcttcctcctgctactctcggcctacccgaggggaaagacgcccacccttctcctgccgacggggccaggtcaggtagtaggttacggccgggtaacctaggcctacgggtaacccaaacgacggacgaccgtcgggaccacgggcctcccgaggtcctccgtcttctatgactcgaccactaccgaacggcggcctacgtggaccactccgacgcgtacggttcaggtcggtcggggtcggtcggtaggacgtacgtaccttactacctcctacctacctacgtaccgaacgctaacgtaccggtagaccggtactaaggttaacgttacgttttcgaacgtttaacgttttacgtaccgttacggtacgacgtacgtacggtaccgtaacgtacgtaacgtttcgggttacggtccgggtaccggttaccggaccgggtaacgggaccgtaaaggtaacgaacgtaaccgaaagtacggtcgtacggtccgttacgacctacgttctaccgttcgttccttacgtacccgttccctaccgccttagtaccgttaggtacgttgtcgtcggtaacncgggcggacgttcggccggagtcggaccgaactacgtagctgngtac

SEQ ID NO: 228848 - DNA, 801 bp, Homo sapiens
  misc_feature: GYAE6OF01ATDRN.33.85.H08.1.454.CMB.1.raw
tcagtacacacactcacgaccggtgctcgatttagtatcactcagtcgcggggaggaactgctcagttaggacccagagggaaccatggaagccccagctcagcttctcttcctcctgctactctggcctcccagactaccaccggagaaattgtgttgacacagtctcccgccaccctgttctttgtcctaccgaaggggaaagcgccctacccttcctcctgcgacgggccagtcaggacgtgcgtggcacgtctaacgttacgccgttacggtaaacccaaaccgtaaaaccgtcggaccacgaaccgtcccgacggtcctcctacatcttagtagtatcgacctactcccgaaccggacgggcctaccgtcggacctaccgtacccgacggtacccgttacgggtttacgacgggtccggtacggtaggggttaccggggttcggtaaccggggtaactaacgggttaccctttaccgtaaccccgtttacctacccgtaaccgtacgtaccgaacgggtaccctacggaaccgtttacggaccgttaccggttaagttaacgtttcgtttaactacgttttaacgttttacttcggttacgttcgtcggaccgttacggtaccgtacggtaccttaaccgttacggtaaccccgttaaccgttaccggtaccgtaacccggacgggacctacggtacggtaaggtaaacgtaaaccgtaacgggtcgttacggtacggtccgtaccgaaccgttactacggtttacgttcttacccttacgttcccgttacccccg

SEQ ID NO: 228849 - DNA, 893 bp, Homo sapiens
  misc_feature: GYAE6OF01BO3BK.33.85.H08.1.454.CMB.1.raw
  modified_base (881)..(881): a, c, t, g, unknown or other
  misc_feature (881)..(881): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgttagcggtacctagcctggtaccaacagagacctggccaggcctcccgaggcctcctcttctatgatgcatccaacgacgggcccacgtggaccactaccccgagccgtagggttcaggtgggtcgggtgggtcgtaggggacacgtacctttcaccgttcctaccacctataccgacgaccgtacgacccttaaggaccgtaccgttaaggtaagtttatttttcggaacgtttaaacggttttttaacttaccgtttacggttaacgacggtaccgtaacgggtaccggttaagtacccgttaaaccggtttcggggtttaccgtttaccggggttaaccgggttttacccggggaaccccgggtaaaaccggggggtaaaccccgttaaaagggggttaaaccgggtaaaacgtaaacccggtaaaaaaccgggttaaccggtttacgggttaacggggtaccctttaacccgggaaccccgttaacccgtaacggtttccgtttacccggtttaccttttaaccgtaccccgttttacccccgtttacccccgtaccctttaaccgttacggttaacggtttaaccgggtttacggttttaaccggtttaccggtaggggtacccggggtttccggggtaccgggttaaccggggtaaccggtaaacggggtccccgtaaacggttaacgggtaacgtnaccgtgtacctg

SEQ ID NO: 228850 - DNA, 742 bp, Homo sapiens
  misc_feature: GYAE6OF01A3E5V.33.85.H08.1.454.CMB.1.raw
  modified_base (199)..(199): a, c, t, g, unknown or other
  misc_feature (199)..(199): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagatacccaccggagaaattgtgttgacacagtctccaggcaccctgtctttgctccgaggggaaangcccaccctctcctgcagggccaatcagagtgttagctagttaacttagtctggtaaccaatatagacctagaccacggctcccgaggcctacctcgactcgtacgagtcggaccgtccaacgacggcccacgtggctacgtccccgaggacccgtaggttcaaggtcggcgtacggtcgggtacggtacggggaaccgagtacctttacgaccttacctccgaaccctagtccaaccggtacctaaaccgttacgtaaaccgtttacggtaacgtttactttttttacttaagtttttttaacttaccgttagtttaaccgtaaacctacgtttaacccgaccgggtacacgttaccgtcggtccctttacgtcccgttacggtttaccggggacgggtaaccgggttacccggtaagggtacggtaacgaccgttaacccgaaacggtacgttcgggtaccggtcgtaccgggtacaccccgtagtttcccttcggtttaaccttccttaacccgtttcccgttccccgtaaccgtttacg

SEQ ID NO: 228851 - DNA, 932 bp, Homo sapiens
  misc_feature: GYAE6OF01AVXPK.33.85.H08.1.454.CMB.1.raw
  modified_base (927)..(927): a, c, t, g, unknown or other
  misc_feature (927)..(927): n is a, c, g, or t
tcagtacacacactcacgaccggtgctcgatttagtatcactcagtcggcggggggggagaactgctcagttaggacccagagggaaccatggaacgccccagctcagcttctcttcctcctgctactctggcctcccgaggggaaagcgccctaccctctcctgcgagggccagtcagtgtgttacggcggtacctaggtcctaggtaacccaagagacgtacccgtggcccaggccctacccgaggtcctccctacactccctagttcgggtacgacctacgtcccgaaccggtacgggaccctagtcgggacctaccgtcccgaaggtaccgtagggttccaggtcgggacctaggggttcggggtacctaggggaaccgtaacgtttactttcccgaacgtttccctaacccgaacccgtagttacccgaacggtaccgtaacgggtaccgttaacgggtaacctaccggtttaagggaaacgttttgttttaccggaactttaacgtttttaaaccgtcggttagtaccgtaacggtccgtaaagggtacccgtttaaccgaaccggtttaacgggttcggggtttaccggtttacggggtaacccggtttacccggggaaacccgggtaaacggggttaaacccggtaaaacggggttaaccgggtaaaaccttaacccgggtaaaaccggttaaccgggttaccgggttacggttccctaaccgtacccgttaacgttcgtttaaccgttccgtttaacccttacccgtttaccggtttacccccgttacccgtaccttaaggttacccgttagggtacggtttacggttaccgggttaaccgttcgggtaagggtaccggggtacccgggtacggttacccggacggggtaaaccgggccgttaacggaagtacgtcgngtacg

SEQ ID NO: 228852 - DNA, 818 bp, Homo sapiens
  misc_feature: GYAE6OF01B9WUX.33.85.H08.1.454.CMB.1.raw
  modified_base (148)..(148): a, c, t, g, unknown or other
  misc_feature (148)..(148): n is a, c, g, or t
  modified_base (207)..(207): a, c, t, g, unknown or other
  misc_feature (207)..(207): n is a, c, g, or t
tcagtacacacactcacgaccggtgctcgatttagtatcactcagtcggcggggggggaggaactgctcagttaggacccagagggaaccatggaacgccccagctcagcttctcttcctcctgctactctggcctccgaggggaaancgcccaccctctcctgcgagggccagtcagagtgttagccggtactagcctggaccaanagacgacctggccagacctcccaggtcctcctcatctatgatcgcactccgacgcggccacgtgcactccacgccgacggttcgtacggtcggcgtaggttcgggtcggtcggggacgtaacggtacttacctaccgttacctaccgtaccctacttaccgaacgtccgtaaccgtacccgtacggaacgtacccggttaacgtaaacgtttaacgtttttacggttaacgtttaacgtttttaacgtttaaccgttcggtttcgttcgtacgtacggaccgttttttaacgacgttaacccgtaccggttaacccgttaacccgttacccgggttacccgggtaacccgggtaaacgggtaacccgtaaccggtaaccggtaacgggtaacggttaaacggtttaaaccggtaaacggttacggttacggtacgtacgacccgtaacctaccgtacgtttaccgttccttaccgttaccttccccgttaccccgtaccttacgttaccgttacggtacggtttcggttacgttaccggttacggttaccgggtaccgggtaccgggtaccgggtaccggtacggtaaccggtacggaccgtacgtaggcg

SEQ ID NO: 228853 - DNA, 595 bp, Homo sapiens
  misc_feature: GYAE6OF01BHMT8.33.85.H08.1.454.CMB.1.raw
  modified_base (229)..(229): a, c, t, g, unknown or other
  misc_feature (229)..(229): n is a, c, g, or t
  modified_base (554)..(554): a, c, t, g, unknown or other
  misc_feature (554)..(554): n is a, c, g, or t
  modified_base (565)..(565): a, c, t, g, unknown or other
  misc_feature (565)..(565): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaaagagcccaccctctcctgcagggccagtcagngtgtagcggtactagcctggtaccaacagagaccgtggccaggcctcccaggcctcctcttctatgatgcatccaacgacgggcctagtggccactcccagccctaggttcaggtcggctaggtcgggtctagggactacgtactttcgacttccacgacctatcgagcgacgacctagacgtacctaggtaagttacttttgacgttagttttacttcgtgttctggacgtagtcgtacgacctacgtcggtacctaaccgtaccgttcgggaccgaacgggacacggtactagggtaagtaacgttaaacgacgttgtcgtancggacaccgtntcctcgttaccttactcttccgtcccgtac

SEQ ID NO: 228854 - DNA, 979 bp, Homo sapiens
  misc_feature: GYAE6OF01BWVUM.33.85.H08.1.454.CMB.1.raw
  modified_base (160)..(160): a, c, t, g, unknown or other
  misc_feature (160)..(160): n is a, c, g, or t
  modified_base (978)..(978): a, c, t, g, unknown or other
  misc_feature (978)..(978): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctccgaggggaaagacgcccacccttcncctgcacgggccagtcagagtgttagcggtacctagcctaggtaaccaacgaggacgaccgtggtcagggcctcccgaggccttccttcttcgtatcgtatcgacctactacccgaaacgcggggaccctaacgtcggacctaccgttacccccgaacggtacccgtacgggtttccgtaaggggttcgggggtccgggggttcgggggttaccggtagggggtaaccgtaacgggtacctttaccggtaccttacccgtacccgtaacccgtacttccggaaaccgggtcgtaacccgggtaaccggtaaccggtaacggtacccggttaagggtaaacggttttacgtttttacgggaaccgttttaacggtttttaaactttaaccggtttcggttaaaccgtaacggtaccggtaaacgtaaccgggtttaacgaccggttaaaaccgtttcggggttttacccggtttacggggttaccccggggttttaacccggggacccgggttaaaccgggggtaaacccggttaaaacgggggtttaaacgggtaaaacccgtttaaaaccggaaaaccggggttaaacggttaccgggtttacggggaaacccttcggggaacccttaaccgttaactttcccggttaacggtttacccttttccgtaacccgttttaccccggttacccctaccgttaagttaccgttacgggttaacggttacggtttaggtaccgtttaaggtaccgggtacgggaccggggttacgttccgggggaacgtaaaccggccgtaaccgttaggaacggtctgagng

SEQ ID NO: 228855 - DNA, 741 bp, Homo sapiens
  misc_feature: GYAE6OF01CCXY1.33.85.H08.1.454.CMB.1.raw
  modified_base (389)..(389): a, c, t, g, unknown or other
  misc_feature (389)..(389): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
tcagtacacacactcacgaccggtgctcgatttagtatcactcagtcgcggggaggaactgctcagttaggacccagagggaaccatggaagccccagctcagtccttctcttcctcctgctactcgtggcctccagactaccgaacggaataaattgtgttacgaactacacgttccgtcccggccctacccgttgtttccttttcggaccgtccgggaaaggggaaacgccgaccctaccccttctccgtgccggacgggaccaaggttccgaaggtacgttcggttaacggccgggttaaactcggtaccgttacggtaaccaagacggtaacgacgtcggaccgacggtccctaccggacggtccttccttcgttactagttcgntcgacctactaaccgaacggtcggacctcgtcgacctaccgaccgtgtaaccgtacgggttcgagggttcggcgggttacggcggtaggaacttaccgtcctactacctcgtaccactacgcacgtccgaactacggagtaccgtacgtaaggtactttacgttacgtaacgtttattacttacgtgtaaccgntacgngcgtatacgttagtcgttcggtcggtacggtaccgaacgggtaagacggtaaacgtaaggaaacctaacggaacgtaggtcctaggtacctacgtacgtacttcgtacttcgttaaccttcgttaccccttagaccccgttagtggtaaaccg

SEQ ID NO: 228856 - DNA, 604 bp, Homo sapiens
  misc_feature: GYAE6OF01EIHIN.33.85.H08.1.454.CMB.1.raw
  modified_base (338)..(338): a, c, t, g, unknown or other
  misc_feature (338)..(338): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (530)..(530): a, c, t, g, unknown or other
  misc_feature (530)..(530): n is a, c, g, or t
  modified_base (545)..(545): a, c, t, g, unknown or other
  misc_feature (545)..(545): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
  modified_base (579)..(579): a, c, t, g, unknown or other
  misc_feature (579)..(579): n is a, c, g, or t
  modified_base (598)..(598): a, c, t, g, unknown or other
  misc_feature (598)..(598): n is a, c, g, or t
  modified_base (601)..(603): a, c, t, g, unknown or other
  misc_feature (601)..(603): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctcccgaaggggaaagacgcccaccctctcctgacagggccagtcagagtgttagcggtactagcctaggtaaccaagagacgacctggccaggcctcccgaggccttcctcttctatgatcgcatccaacgcggcctacgtggcactccccagccgtaggttcgaggttgggcgggttgggtcgtaggggaccacgtccttaccnccttacctcaacctatcgacgacacgacctagacgccttaggaagtttacttttaggacttagtttacttactgtacgacncgagtaccggtanactaacgttggttacgttacggtaccgttcggaccgtaacgggaacgtaagggtaagaacgtacgaaacgatggtgcgtagccactgtacctgtactntccttcctccctacnttcgtagagtgttntgtagnggacgtggtacggngaccgtaggcgctacggancgnnng

SEQ ID NO: 228857 - DNA, 649 bp, Homo sapiens
  misc_feature: GYAE6OF01AJ0AQ.33.85.H08.1.454.CMB.1.raw
  modified_base (146)..(146): a, c, t, g, unknown or other
  misc_feature (146)..(146): n is a, c, g, or t
  modified_base (203)..(203): a, c, t, g, unknown or other
  misc_feature (203)..(203): n is a, c, g, or t
  modified_base (649)..(649): a, c, t, g, unknown or other
  misc_feature (649)..(649): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccagggaaagngccacctctcctgcaggccagtcagagtgttagcgggtacctagcctggtaccaacnggaactaccgtggccagggcctcccgaggccttccgttcttactagtacgcgttgacctatacccgaaacgtacggggtccctacgtgggaccctactccccgaagcccgtaggtttccaggtcgggtcggtcggggtcgtcggactagtacgttccacgtctaccactaatcgacgcacgacctaggactctacgtaagtttactttcgaagttgtttactcttaggctaacgcttaagcgttacgactaacgcgtaccctacgtacccgtacgtaccgaacggtacaccgagtaggagttaacgtaacgtacgttggtcgatcgactactacgttctccgttctacgtacttcccgtaccgtcctacgttcgttacgtagtgttcgttacgtactcggtacgggttcggcgttacggacggtacggtaccgatacggttgatgn

SEQ ID NO: 228858 - DNA, 593 bp, Homo sapiens
  misc_feature: GYAE6OF01CR5I7.33.85.H08.1.454.CMB.1.raw
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccagggaaagagccaccctctcctgcagggccagtcagagtgttagcgggtacctagcctggtaccaacagagacctggccaggctcccaggctcctcttcatgatgcatccgaacagggccatggcatcccagccaggttcagtggcggtgggtctggggacagacttcactctcaccatcagtcagcctagagcctgaagtattttagactaggttttaattactaggtacagtcacgtcgttacgctaaacgtggtcttggaccgtttacgggcctaaacggggaccaaagggtaggaaactaccggaaaacgacgtgtacgggtactggaccacctaagttcgtgttaccttctatttcccgtaccccgtctagtaccgtagtaacgttcgttagtcgttagtagggacggtcgggcgtaggccgtaaagggtccacgaacgttaggctagngtn

SEQ ID NO: 228859 - DNA, 826 bp, Homo sapiens
  misc_feature: GYAE6OF01D4YX5.33.85.H08.1.454.CMB.1.raw
  modified_base (452)..(452): a, c, t, g, unknown or other
  misc_feature (452)..(452): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccagataccgaccggaagtaaattgtgttgacacgtagtcctccggacccacccgttgttcgtttcgtcctaccggaaaggggaaacgacgccctaaccctctccgtggaccgacgggccaaggttcaggtacgtggttaacgccgggtaactacgtccgtaggtaaccaaacaggtaccgaaccgtcggaccgtaacggccttacccggagtccttacccgtaactaacttactaacggtaactccggtaaccgtacaaaccggcgggtaacccacgttacggaccctaaccgtcccgaacggtaccgtaagggttaacnggtacggacgtagggtacggtcggtagggactaaggtcccttacgtaactcccgtaacctaccgagttaccaacggtaacctaaaccggtaaagttaacgttaacgtaacgtttaacttttaacctagtttttaaacttacgttacgtaacctaataaccgtacgaaccggtacgtacgtacgtacggtaccctttacgtaccgtaacccgggttttaccgggaaccggggtaacgggttaacccgtaaggggttaacggaacgaaccgtaacgtaaaccgtaacgtttaggcggttacaccggtaccctacgttacttccgtagttcccgtaactaccgttaccccgttacccgtactaccgtcggttaaagg

SEQ ID NO: 228860 - DNA, 897 bp, Homo sapiens
  misc_feature: GYAE6OF01CB7ZU.33.85.H08.1.454.CMB.1.raw
tcagtacacacactcacgaccggtgctcgatttagtatcactcagtcggcgggggggggagaactgctcagttaggacccagagggaaccatggaacgccccagctcagccttctccttcctcctgcttactcgtggcctacccggaagggggaaagaccgcccctaccccttcctccgtgccgacgggccagtcgaggtagtaggttacggccggggtacctacggcccgttacggtaacccaaacgaggaaccggtacccgtcgggacccacgggtccctccccggacggtcccttcccttctttacctaagtggactcgaccactacccggaacggacgggtaccacgtcggacctaccgtcccgaacggcccgttaggttcgaggggtcggggtcgggttcggggtcgtacggggaacctacggttacctccgtaaccttccacccaaacctctccgacgacgtaaaccgtaccgtacggaccgtccgtaaggttaacgtttattttacggaacttttaaggttttacctacgtttcggacgtaacgtccggtacgtaccgtaggtaccgttaaccggttggttaccggttacgggttaccggttcgggaaccggtaaccgggtaacggtaaacggtaacggtaaacgtaaccgaaacgtacgggttggtaccggtacgtaccgtccgtaaccttacgtccgtttccggttaccctttaccgttaccccgttccccgttaaccccgtaccgttacggtttaccggtagggtttaacccggtgggttttaccggtaacgggttccgttaacgggggtccggggttacccgggaccgggttacggggaacccggtaaacgggtcccggtaggttacgtaaccggagtccgagtcg

SEQ ID NO: 228861 - DNA, 820 bp, Homo sapiens
  misc_feature: GYAE6OF01A57WF.33.85.H08.1.454.CMB.1.raw
  modified_base (201)..(201): a, c, t, g, unknown or other
  misc_feature (201)..(201): n is a, c, g, or t
tcagtacacacactcacgaccggtgctcgatttagtatcactcagtcgcggggaggaactgctcagttaggacccagagggaaccatggaagcccccagctcagccttctcttcctcctgctactctggctcccagataccaccggagaaattggtgttgacacagtctccggccaccctgtctttgtctccgaggggaancgccaccctctcctgcagggccagtcagagtgttagcggtacctagcctaggaccaagagacgaccgtggccaggcctcccgaggcctcctctttctatgtatgacctactacccaacgacgggaccctacgtcggccaaccttaccccgagtaaccgtacgggttccaaagggttcgggcgtagggttacggggttccgtacgggggtaaccgtaacggtaccttttccgaactttcccgtaccctaaaccccgtagttaccgaacgtacccgtaacggtaacccgtacggggaaccgttacccgtaagggtaaacgtttagttttccggtacgttaacggttacgtttaaccgtttaaccgttacggttccgtaaggtaaccgttaacgggtttaaccgggttttaacgttacccgttaacgtttcccgttaaccccgggttacccgggtttacccgggtaaacccggtaaccggggtaaacccgttaagggaacggtaaactaacccggaaaacggtaccgtaggttacgggtacctaggaccccgtaaccgtacgtttaccgttaacgtttcccttaaccgttaccttccccgttaccccgtacctttaacccgg

SEQ ID NO: 228862 - DNA, 808 bp, Homo sapiens
  misc_feature: GYAE6OF01EP100.33.85.H08.1.454.CMB.1.raw
  modified_base (159)..(159): a, c, t, g, unknown or other
  misc_feature (159)..(159): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagtacacacactcacgaccggtgctcgattttagtatcactcagtcgcggggaggaactgctcagttaggacccagagggaaccatggaagccccagctcagcttctcttcctcctgctactctggctcccagactaccaccggagaaattgtgttnacacagtctccggccaccctgtctttgctccaggggaaancnccaccctctcctgcagggccaggtcagagtgttaggccgggtaacctagccgtgtaaccaagagacgacctggaccaaggctacccaggcctcctnttctatgatgcactaccgaacacgggccaacgttcggacctactaccccacggacccgtacgggtttaccacggtacggggtacgggttacgggggttccgtagggggtaacgaacgtaacccgtttacaaccgttaccgttaccaaccctaacgtaccggtaaacccgaaacggtaccggttacgggaccggtacccgttacggtaaacgtttacgtttttaggacccgttaaggtttaccctttaagtttaccgttcgttaacctacggtaccgttaagttaacgttaacggttacggggtaacggttacgtttacccgggtaaccgaaaggggtaacccgtaaaggggttaacggtaaagtaacggaaaacgtaacgtaacgggtacggtacgtaccggacccgtaaccgtaacgttaccggtttacgttacccgtttacgtacccttttaccccgtttacccccggtaccttaaccttacccggtttaacgtaagggtttaaccggg

SEQ ID NO: 228863 - DNA, 962 bp, Homo sapiens
  misc_feature: GYAE6OF01AMZC4.33.85.H08.1.454.CMB.1.raw
  modified_base (152)..(152): a, c, t, g, unknown or other
  misc_feature (152)..(152): n is a, c, g, or t
tcagtacacacactcacgaccggtgctcgatttagtatcactcagtcggcggggggggaggaactgctcagttacggacccagagggaaccatggaacgccccagctcagccttctcttcctcctgacctactctggcctccgaggggaaancgcccaccctctctggcacgggcctagtcagtagtgttacggcgggtacctaggcctaggtaaccaacgaggaccgtaccgtcggaccgtaacggcccttaccccgaaggggtccctttcccgttacttttacctaagtccggtaaattccggtacaaccgttaccgtaaaccggtaccgggggacccttaaccgtcgggtaaccctaaccgttcccccgaacggtaccccggttaacgggttacccggtaagggttcggggggtaccccggggttacggggggttcccggtaaccgggggaaccttaaccgggtttaacctttcccgaaacccggtttccctaaccggaacccttaacgtcccggaatccccggtaacggtccgtaaaacgggtccgtaccgttaaggtaaacggtttcgtttttaaccggcttttaaaggttttaacgtaacgttccgttagtaaccggttacgtacggtaccgggttaaacctaccgtaaaggtttccgggtttaccggttaacgggttaaccccggggttaccggtaaccgggttaaaccgggtaaaccgggtaaaggggtttaaaccgtaaaacggtacccggtaaaacggtacggttcggtaacggtacccgttacgtaccgtacgtacttccggtttaccgttaccgttacctaccgtttacccggttaccccgtacgtaacttccggttaaggttaccgttcggtacggttacgtcggtaagggttccgggacggttaccgtcggggacgtaacggtcggtaacgttacgacggtgctgtcg

SEQ ID NO: 228864 - DNA, 786 bp, Homo sapiens
  misc_feature: GYAE6OF01BZWH0.33.85.H08.1.454.CMB.1.raw
  modified_base (780)..(780): a, c, t, g, unknown or other
  misc_feature (780)..(780): n is a, c, g, or t
  modified_base (784)..(784): a, c, t, g, unknown or other
  misc_feature (784)..(784): n is a, c, g, or t
tcagtacacacactcacgaccggtgctcgatttagtatcactcagtcgcggggggggaggaactgctcagttaggacccagagggaaccatggaacgccccagctcagtcctctcttcctctgactctctcggcctccgaagggaagacgcctaccctctccgtcggaccgagggaccacgtcagtacgtttaggttacgggtaccgggtaccgtagcccgttacgtaaccaacgaggtaaccgtaccgtggccgacggtacccctccgacggtcctcctacgttacgtatacggatcgaccactacgaaccggtcggctccgtacggacacctaccgtacgaccgtacgtacgaggtcggtacggtcggtcgaggactacgtacgtcgtactactaccactcgtacgaccgacgacgacgtacggaccgtaccgtaaggtaactttcggtttaccgttaagttttagtttaacctttacgttacgtacgtacgacgtacgtacgttaacgtaaccgttaccggtttcggtttaccgggtttacggtaaccgggtaacccggtaaccgtaaccggggtaaacggtaagggaaaccgttaacggaaacgtaaacggtgtaacggtccggacgtacgcctacgttcgttactacgtttacctaccgtaaccgtttcccttaccgtaccgtacgttaacgtacgttaacggtcgttcggttacgtacggttacggacggtcccgggtagtccgggtacgtacggtaaggttaccgactaagcngtancg

SEQ ID NO: 228865 - DNA, 887 bp, Homo sapiens
  misc_feature: GYAE6OF01DN1P7.33.85.H08.1.454.CMB.1.raw
  modified_base (222)..(222): a, c, t, g, unknown or other
  misc_feature (222)..(222): n is a, c, g, or t
tcagtacacacactcacgaccggtgctcgatttagtatcactcagtcgcggggagaactgctcagttaggacccagagggaaccatggaagccccagctcagcttctcttcctcctgctactctggctcccagactaccacggagtaaattcgtgttcgacacgtagttccgtaccggccctaccttggttccttttggtacctaccggaaaggggtaaacncgtacccctacccgtccttaccgtggccgaggaccctagttccgaaggtacgttcggttaacggccggttaacctacggtcccgtagggtaaacccaacggaacgtaccggtaacctcggggaacccgtaacgggccctacccggaacgggtccttcccgttcgtttacgtaacgttacgtaagttcgacctaacggtacctaaaccgggaccgggtaccctacgtcggaaccttaaccggtcccaggtaccgttaggtcgacggtttcgggaccgggttgggttccggtacggaacctaggttacccgttaccgtaacctcgtaaccgaaaccctttagaccccggtaggtaacgacccgttccgtaaggtaccgtaaccgtaagtacgttaacgttttcgtaacgttttaacgtttaactccggttactaaccggtaacgtcgtaaccgggtaccttacggtaccgtttaaccgggtcggtttaacgttaccggggttaaccggttacccgggaaccgtaaaccggggttaacccgtaagggttaacccggtaaaccggtaaaccgttaacgggtaccgttagggaccgttacgttaccgacgtaaccgttgacccgtttattacccgtcttaacccgttcctccccgtacttacggtacggg

SEQ ID NO: 228866 - DNA, 766 bp, Homo sapiens
  misc_feature: GYAE6OF01A1NVV.33.85.H08.1.454.CMB.1.raw
tcagtacacacactcacgaccggtgctcgatttagtatcactcagtcggcgggggggagaactgctcagttaggacccagagggaaccatggaacgccccagctcagcttctcttcctcctgctactctggcctcccgaggggaaacacgcccacccttctcctgccgaggccagtcagtgtgttagcggttacagcctaggtaaccaacgagacgtacctggcccaggtccctaccccgagggtcccttcccgttactttaccgtagttcggactcggacctactaccccgaacccgacggggtcctaaccgtggacctaccgtaccccgacgccggtaacggtttcacggtcggtaccgtagggtcggggttcctaggggacctaaggtaccctttcgaaccttccgtaccaacctagtaccacggtccctaagtacccttaggaccgccgttaggtaaactttcgttttagaccgtttaagttttacttccgtagttcgtagctaaggtccgtaaggcctaacgttcgtaaccctaacgttacccggtacgaacccggtaacgtacgaaccggaacgttacgtaaacgtaaacgtaacgtaacgtcggtcgtcctagaaccctacgtacgttccgttctaaccgtttcgtaccgttccccttaccgaccgttattaccgtaagttcgtttggtacgttcgttaacggcggtaccgggtcggtaacggttggaacccgtaaggtccaaactcggttaccgtacg

SEQ ID NO: 228867 - DNA, 492 bp, Homo sapiens
  misc_feature: GYAE6OF02ID0B6.33.85.H08.1.454.CMB.1.raw
  modified_base (489)..(492): a, c, t, g, unknown or other
  misc_feature (489)..(492): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacaggacttcactctcaccatcagcagcctagagcctgaagatttgcagtttatactgtcagcagcgtagcaactggtcttggacgttcggccaagggaccaaggtggaaatcaaacgaactgtggctgcaccatctgtcttcatcttcccgccatctgaagtgtgtgtactgagcgggctggcaaggcgcatagnnnn

SEQ ID NO: 228868 - DNA, 493 bp, Homo sapiens
  misc_feature: GYAE6OF02JUYWL.33.85.H08.1.454.CMB.1.raw
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (490)..(493): a, c, t, g, unknown or other
  misc_feature (490)..(493): n is a, c, g, or t
tcagtacacacactcacgaccggtgctcgatttagtatcactcagtcgcggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacaggacttcactctcaccatcagcagcctagagcctgaagtattttgctagtttattactgtcagcagcgtagcaactggtcttggacgttcggcaagggaccaaggtaggaaatcgaaacgactgtgactgacacatctgtcttcatctccgcatctgaagtgtntgtactgaggcggntggctaaggcnatgnnnn

SEQ ID NO: 228869 - DNA, 511 bp, Homo sapiens
  misc_feature: GYAE6OF02HU2XH.33.85.H08.1.454.CMB.1.raw
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtggtctggggacagacttcactctcaccatcagcagcctagagcctgaagtattttgctagtttattactgtcagcagcgtagcaactggtcttggacgttcggccaagggaccaaggtggaaatcgaaacgactgtggctgcaccatctgtcttcattccttcccgcatcg

SEQ ID NO: 228870 - DNA, 490 bp, Homo sapiens
  misc_feature: GYAE6OF02GY5LO.33.85.H08.1.454.CMB.1.raw
  modified_base (487)..(490): a, c, t, g, unknown or other
  misc_feature (487)..(490): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgcagtttattactgtcagcagcgtagcaactggtcttggacgttcggccaagggaccaaggtgaaatcaaacgactgtggctgcacatctgtcttcatttcccgcatctgaagtgtgtgtactgagcgggctgggcaaggcgcagtagnnnn

SEQ ID NO: 228871 - DNA, 525 bp, Homo sapiens
  misc_feature: GYAE6OF02JIXPF.33.85.H08.1.454.CMB.1.raw
  modified_base (198)..(198): a, c, t, g, unknown or other
  misc_feature (198)..(198): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgctggcagcaacttagcctggtaccaacaaaacctggccagactccaggctcctcatctatgatgcatccacaggccactggcatcccagccaggttcagtggcagtgggtctgggacagacttcattctcaccatcagcagactggancctgaagtatttgctagtgtattacngtcagcagtacgtagttacatctaccgtacgttcggaccgaaggaccgaaggtcggaaatacgtaaacgaaccgttagtacggtacgtcgactaccagtccgtagttaccttacattcccg

SEQ ID NO: 228872 - DNA, 498 bp, Homo sapiens
  misc_feature: GYAE6OF02GLEY4.33.85.H08.1.454.CMB.1.raw
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctggggacaggacttcactctcaccatcagcagcctagagcctgaagtatttgctagtttattactgtcagcagcgtctcaactggcctccgtgcaccttcggccaagggcacgattgganattagacgaatgngctgcacctntgtcttcacttcttcccgctatctgtagtgtgtgtactggagcggtntggcaaggcgcagtagn

SEQ ID NO: 228873 - DNA, 496 bp, Homo sapiens
  misc_feature: GYAE6OF02HA64A.33.85.H08.1.454.CMB.1.raw
  modified_base (496)..(496): a, c, t, g, unknown or other
  misc_feature (496)..(496): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccagactcccaggctcctcatctatgatgcatccaccagggccactggcatccccagccaggttcagtggcagtgggtctgggacagacttcactctcaccatcagcagcctagagcctgaagattttgcagttttattactgtctgcagcgtagcaactggccctaacacccttcggccaagggacacgactggagattaaacgaactgtgctgcacatctgtcttcattccttcccgccatctgagttgtgtgtactggagtcgggctggcaaggcgcatagn

SEQ ID NO: 228874 - DNA, 493 bp, Homo sapiens
  misc_feature: GYAE6OF02H7GCU.33.85.H08.1.454.CMB.1.raw
  modified_base (436)..(436): a, c, t, g, unknown or other
  misc_feature (436)..(436): n is a, c, g, or t
  modified_base (491)..(493): a, c, t, g, unknown or other
  misc_feature (491)..(493): n is a, c, g, or t
tcagtacacacactcacgaccggtgctcgatttagtatcactcagtcgcggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaatggtcttggacgttcggccaagggaccaaggtgaaatcaaagaactgtaggctgcacatctgtcttnatcttcccgctatctgaagtgtgtgtactggagcgggctggcaaggcgcagtagnnn

SEQ ID NO: 228875 - DNA, 483 bp, Homo sapiens
  misc_feature: GYAE6OF02FPJVK.33.85.H08.1.454.CMB.1.raw
  modified_base (467)..(467): a, c, t, g, unknown or other
  misc_feature (467)..(467): n is a, c, g, or t
  modified_base (483)..(483): a, c, t, g, unknown or other
  misc_feature (483)..(483): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagagacctggccaggctcccaggctcctcatctatgatgcatccaccagggccactggcatcccagccaggttcagtggcagtgggtctgggacagacttcactctcaccatcagcagcctagagcctgaagattttgctagtttattactgtctgcagcgtagcaactggcctaacaccttcggaccaagggacacgactggagattaaacgactgtgctgcacatctgtcttcattctccgcatctgagtgtgtgtactgagcggntcggcaggcgcatagn

SEQ ID NO: 228876 - DNA, 518 bp, Homo sapiens
  misc_feature: GYAE6OF02H9Z5C.33.85.H08.1.454.CMB.1.raw
  modified_base (250)..(250): a, c, t, g, unknown or other
  misc_feature (250)..(250): n is a, c, g, or t
  modified_base (515)..(518): a, c, t, g, unknown or other
  misc_feature (515)..(518): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaanagggccactggcatcccagccaggttcagtggcggtgggtctgggacagacttcactctcaccatcagcagcctagagcctgaagtattttgctagtttattactgtcagcagcgtagcaatggtcttggacgtttcggaccgaagggaccgaagggtaggaaatacgaaacgaactggtaggtctgcacatctgttcttcatccttcccgcctatctagaagttgtgtgtacgtggaggcgggctgggacaagggcgcagtagnnnn

SEQ ID NO: 228877 - DNA, 490 bp, Homo sapiens
  misc_feature: GYAE6OF02I61XX.33.85.H08.1.454.CMB.1.raw
  modified_base (488)..(490): a, c, t, g, unknown or other
  misc_feature (488)..(490): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagtattttgctagtttattactgtctgcagcgtagcaactggcctaacaccttcggccaagggacacgactggagataaacgactgtgctgcaccatctgtcttcatctcccgctatctgagtgtgtgtactgagcgggctggcaggcgcagtagnnn

SEQ ID NO: 228878 - DNA, 495 bp, Homo sapiens
  misc_feature: GYAE6OF02FQ561.33.85.H08.1.454.CMB.1.raw
  modified_base (492)..(495): a, c, t, g, unknown or other
  misc_feature (492)..(495): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggtcttggacgttcggccaagggaccaaggtgaaatcgaaacgaactgtgctgcacatctgtcttcatcttcccgcctatctgaagtgtgtgtactgagcgggctggcaaggcgcatagnnnn

SEQ ID NO: 228879 - DNA, 500 bp, Homo sapiens
  misc_feature: GYAE6OF02FIITX.33.85.H08.1.454.CMB.1.raw
  modified_base (462)..(462): a, c, t, g, unknown or other
  misc_feature (462)..(462): n is a, c, g, or t
  modified_base (498)..(499): a, c, t, g, unknown or other
  misc_feature (498)..(499): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcatctatgatgcatccaccagggccactggcatcccagccaggttcagtggcagtgggtctggggacagacttcactctcaccatcagcagcctagagcctgaagattttgcagtgtattactgtcagcagtacggtagttcatctccgacgttcggccaagggaccaagggtggaaatcaaacgaactgtggctgcaccatctgtcttcatcttcccgcatctgaattgngtgtactggagcggggctgggacaagggcgcatagnng

SEQ ID NO: 228880 - DNA, 499 bp, Homo sapiens
  misc_feature: GYAE6OF02IXJOK.33.85.H08.1.454.CMB.1.raw
  modified_base (327)..(327): a, c, t, g, unknown or other
  misc_feature (327)..(327): n is a, c, g, or t
  modified_base (493)..(499): a, c, t, g, unknown or other
  misc_feature (493)..(499): n is a, c, g, or t
tcagtacacacactcacgaccggtgctcgatttagtatcactcagtcgcggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcctctatggtgcatccaccagggccactggcatcccagacaggttcagtggcagtgggtctgggacagacttcactctcaccatcgacagactggancctgaagattttgctagtctattactgtcagcagtatactggggagacgttcggaccaaagggaccaaagggtggaaatcaaacgaactgtggctgcaccatctgtctcatcttcccgccatctgtaagtgtgtgtactgagcgggctggcaagggtcgcgatagnnnnnnn

SEQ ID NO: 228881 - DNA, 503 bp, Homo sapiens
  misc_feature: GYAE6OF02GBUP9.33.85.H08.1.454.CMB.1.raw
  modified_base (499)..(499): a, c, t, g, unknown or other
  misc_feature (499)..(499): n is a, c, g, or t
  modified_base (501)..(503): a, c, t, g, unknown or other
  misc_feature (501)..(503): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggtcttggacgttcggccaagggaccaaggtggaaatcaaacgaactgtggctgcaccatctgtcttcatccttcccgcctatctgaagtgtgtgtactggacgcgggctggcgaaggcgcagtagntnnn

SEQ ID NO: 228882 - DNA, 534 bp, Homo sapiens
  misc_feature: GYAE6OF02IZS23.33.85.H08.1.454.CMB.1.raw
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
tcagtacacacactcacgaccggtgctcgatttagtatcactcagtcgcggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctggggacaggacttcactctcaccatcagcagcctagagcctagaagtattttgctagtttatactgtcagcagcgtagcaactggtctggacgttcggaccaagggaccaagggtaggaaatacgaaacgaactggtggctgcaaccatcgtgtcttcacttccttcccgctacttctagtaaagttggtcgttgttaacctggacggtcgggtctgggcaagggccgcaacgttaggntngn

SEQ ID NO: 228883 - DNA, 502 bp, Homo sapiens
  misc_feature: GYAE6OF02GU9JI.33.85.H08.1.454.CMB.1.raw
  modified_base (467)..(467): a, c, t, g, unknown or other
  misc_feature (467)..(467): n is a, c, g, or t
  modified_base (499)..(502): a, c, t, g, unknown or other
  misc_feature (499)..(502): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagagacctggccaggctcccaggctcctcttctatgatgcatccaacagggcccactggcatcccagccaggttcagtggcggtgggtctgggacagacttcactctcaccatcagcagcctagagcctgaagattttgctagtttattactgtcagcagcgtagcaactggtcttggacgttcggccaagggaccaagggtgaaatcgaaacgaactgtagctgcaccatctgttctcatccttcccgctattctagaagtgtntgtactggagcgggctgggcaaggcgcatagnnnn

SEQ ID NO: 228884 - DNA, 548 bp, Homo sapiens
  misc_feature: GYAE6OF02JUO1N.33.85.H08.1.454.CMB.1.raw
  modified_base (513)..(513): a, c, t, g, unknown or other
  misc_feature (513)..(513): n is a, c, g, or t
  modified_base (544)..(544): a, c, t, g, unknown or other
  misc_feature (544)..(544): n is a, c, g, or t
  modified_base (546)..(548): a, c, t, g, unknown or other
  misc_feature (546)..(548): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatcccaaacgagggccactggcacgtcccagccaggttcagtggcggtgggtctgggacagactcactctcacatcagcacgcctagacgcctgaagtatttgactagtttatactgtcagcagcgtagcaacgtggtcgttggtaccgttcggaccgaagggaccgaaggtggaaacgtacgaaacgtaacgtaggtcggacttacgcctaccgatctgttcgttacacgtccttcccgacctatctgtaagtcgtagttgtacgtggnggtcggacggtggacgaaggcgactagtagntnnn

SEQ ID NO: 228885 - DNA, 575 bp, Homo sapiens
  misc_feature: GYAE6OF02JGBVN.33.85.H08.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcgggtacctagcctggtaccaacagagacctggccaggctcccaggctcctcttctatgatgcatccaacngggccactggcatcccagccaggttcagtggcggtggtctgggacngacttcactctcaccatcagcagcctagagcctgaagtatttgctagtttatactgtcagcagcgtagctaactggtcttggacgtttccggaccgaacgggacccaaagggtacgggaaacttaccgaaaacggtaactacggtacggtacgtcggaccaaccgtaacgttccgttacggttcctttaccgtacgtttcccgtttaccccgtcctacttaccg

SEQ ID NO: 228886 - DNA, 514 bp, Homo sapiens
  misc_feature: GYAE6OF02I8GPY.33.85.H08.1.454.CMB.1.raw
  modified_base (249)..(249): a, c, t, g, unknown or other
  misc_feature (249)..(249): n is a, c, g, or t
  modified_base (463)..(463): a, c, t, g, unknown or other
  misc_feature (463)..(463): n is a, c, g, or t
  modified_base (511)..(514): a, c, t, g, unknown or other
  misc_feature (511)..(514): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctagccaggctcccaggctcctcttctatgatgcatccaacngggccactggcatcccagccaggttcagtggcggtgggtctgggacagacttcactctcaccatccagcacgcctagacgcctagaagtattttgctaagtttattaactgtacagcaagcgtagctaacgtggtcttgggacgtttcggcaagggaccaagggtggaaatacaaacgactggtgctgcaccatctgtcttcacttccttcccncattctagtaagtgttgtgtactggagtcggctggcaggcgctagtgnnnn

SEQ ID NO: 228887 - DNA, 493 bp, Homo sapiens
  misc_feature: GYAE6OF02HPQGW.33.85.H08.1.454.CMB.1.raw
  modified_base (250)..(250): a, c, t, g, unknown or other
  misc_feature (250)..(250): n is a, c, g, or t
  modified_base (460)..(460): a, c, t, g, unknown or other
  misc_feature (460)..(460): n is a, c, g, or t
  modified_base (485)..(485): a, c, t, g, unknown or other
  misc_feature (485)..(485): n is a, c, g, or t
  modified_base (490)..(493): a, c, t, g, unknown or other
  misc_feature (490)..(493): n is a, c, g, or t
tcagtacacacactcacgaccggtgctcgatttagtatcactcagtcgcggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacngggccactggcatcccagccaggttcagtggcggtgggtctgggacagacttcactctcaccatcagcagcctagagcctgaagattttgcagtttattactgtcagcagcgtagcaactggtcttggacgtttcggccaagggaccaaggtgaaatcaaacgaactgtaggctgcaccatctgtcttcatcttcccgcatcctgaagtntgtgtactgagcgggctggcaggcncatgnnnn

SEQ ID NO: 228888 - DNA, 505 bp, Homo sapiens
  misc_feature: GYAE6OF02GXNRE.33.85.H08.1.454.CMB.1.raw
  modified_base (502)..(505): a, c, t, g, unknown or other
  misc_feature (502)..(505): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacaggacttcactctcaccatcagcagccctagagcctgaagattttgctagtttattactgtcagcagcgtagcaactggtcttggacgtttcggccaagggaccaagggtggaaatcgaaacgaactggtagctgcaccatctgtcttcatccttccgccatcctgaagtgtgtgtactggagcgggctggcgaaggcgcatagnnnn

SEQ ID NO: 228889 - DNA, 595 bp, Homo sapiens
  misc_feature: GYAE6OF02G9YVO.33.85.H08.1.454.CMB.1.raw
tcagtacacacactcacgaccggtgctcgatttagtatcactcagttcggtcgggggaggaactgtctcagttaggacccagagggaaccatggaagccccagctacaagcttactcttcctcctgtccttacctcctggctcccgagagtaccacccggagaagttggtcgttgaccgcagtctccaggcaccctgtctttgtccgtcccgaggggtaaagagccacccttcgtcctcgcacgggccaatcagagtgttagcaggtaacttagtctaggtaccaacagtacgaccttgaccaggctcccaggctcctcactcctagtgatgcatccacgaggccactggcatccgagccaggttcagtggccagtggtctgggactagacttcactcgtcaccatcaagctacgtcctagacgtccgtagtacgtatttgactagtttacttacgtcgtcgtgtctagtcgttagcgtacgtcgaccttaacgtaccgttccggaccaaggacgacgtacgttggaagtacgttaaacggacgttacggtaggtacgtgaccgtaccgtacttccgttacgttccttactaccg

SEQ ID NO: 228890 - DNA, 531 bp, Homo sapiens
  misc_feature: GYAE6OF02GU30V.33.85.H08.1.454.CMB.1.raw
  modified_base (198)..(198): a, c, t, g, unknown or other
  misc_feature (198)..(198): n is a, c, g, or t
  modified_base (391)..(391): a, c, t, g, unknown or other
  misc_feature (391)..(391): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccaggctcctcttctatgatgcatccaacgagggccactggcactcccagccaggttcagtggcggtgggtctgggacagacttcactctcacatcagcagcctagacgcctgaatntttgctagtttattactgtcagcagtcgtagactaacgtggttcttgggaccgtttcggaccgaagggaccaagggtagaaactacgaaacgacgtgtcggctgacaccatcgtgtccttcacttccgttccgcctatcg

SEQ ID NO: 228891 - DNA, 506 bp, Homo sapiens
  misc_feature: GYAE6OF02G87DY.33.85.H08.1.454.CMB.1.raw
  modified_base (503)..(506): a, c, t, g, unknown or other
  misc_feature (503)..(506): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctccaggggaagagccacctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagacgcctgaagtattttgctagtttattactgtcagcagcgtagcaactggtcttggacgttcggacaagggaccaaggtgaaatcaaacgactgtggctagcaccatctgtctcatcttcccgctatctagagtgtgtgttactggacggtcgggctggacgaagggccgacagtaggnnnn

SEQ ID NO: 228892 - DNA, 499 bp, Homo sapiens
  misc_feature: GYAE6OF02JDFDT.33.85.H08.1.454.CMB.1.raw
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (496)..(499): a, c, t, g, unknown or other
  misc_feature (496)..(499): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggtcttggacgttcggccaagggaccaaggtgaaatcaaacgactgtggctgcacatctgtcttcatccttcccgcctatctgaagttgtgtntacgtgngcgggctggcaagggcgcagtagnnnn

SEQ ID NO: 228893 - DNA, 576 bp, Homo sapiens
  misc_feature: GYAE6OF02GTXP5.33.85.H08.1.454.CMB.1.raw
  modified_base (208)..(208): a, c, t, g, unknown or other
  misc_feature (208)..(208): n is a, c, g, or t
  modified_base (574)..(574): a, c, t, g, unknown or other
  misc_feature (574)..(574): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggcctcccgaaggggaaagagcccaccctctcctgcgagggccagtcagagtgttagcgggtacctagcctggtaccaanagacgacctggccaggcctcccgaggcctcctcttctatgatgcactccaaacgcgggcccacgtcggcactcccagccgaggttcaggtggcgggtgggtcgtgggacagtacttcactctcaccatcagcacgacgtggacgcctagaagtattttgactagttagttaatttacgtgtcagctaggtacggtagttcatccgtccgtacggttcggacgaagggaccgtaaggtagaaactacgaaacgactaggtagctgaccacatctgttcttactacttcctcccgtactacttctagtaagttgtagttagtacgtggacggtcgggtacgtcggacgacggtcgacgtagtagatgntg

SEQ ID NO: 228894 - DNA, 555 bp, Homo sapiens
  misc_feature: GYAE6OF02JPO4K.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctttctttgtctccaggggaaangccaccctctcctgcagggccagtcagagtgttagcgggtacctagcctggtaccaacgagagacctggccaggcctcccgaggcctcctcttctatgatgcatccaacagggccactggcatcccagccaggttcaggtggcggtggtctgggacaggtacttcactctcgaccatccagcacgcctagacgccgtagaagtatttgctagtgtattactgtacagctagtacgtagttcactctcgtacgttcgccgtaagggaccgtaaggtacgaaacgtacgaaacgtacgtagtagcgtacgcaacctacgtactcgttacttacacgttccttacccgctactcgtacgg

SEQ ID NO: 228895 - DNA, 554 bp, Homo sapiens
  misc_feature: GYAE6OF02GIPML.33.85.H08.1.454.CMB.1.raw
  modified_base (375)..(375): a, c, t, g, unknown or other
  misc_feature (375)..(375): n is a, c, g, or t
tcagtacacacactcacgaccggtgctcgatttagtatcactcagtcgcgggtgcagctgcaggagtcgggccccaggactggtgaagccttcggagactctgtccctcacctgcacttgtctctgatgtctccatcggtagtttctactggagttggatccggcagcccccagggaagggactggagtggattgggtttactcttttacagtgggatcaccaactacaaccctccctcaagagtcgagtcaccatatcactagacacgtccaggaaccagttctccctgaaggtgaactctgtgaccgctgcggacacggccgtgtattactgtgcgagagcttcgtatatctagcagctggtctttgacttcnggggccagggaaccctggtcaccgtctcctcagcctcaccaacggcccagtccggtccttccccgtcgccaccctcctccaacgcgcacctcgtcggggcacgacgcggccgtcgggctcgccgtcggtccgaaggacctacgttccgagttcgtcggtcgtacgtcggacggcggtcg

SEQ ID NO: 228896 - DNA, 577 bp, Homo sapiens
  misc_feature: GYAE6OF02HC8OG.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcgagggccagtcatagtgttagcgggtacctagcctggtaccaacagagacctggccaggcctcccaggctcctcttctatgatgcatccaacgagggccagtggccactccccgagcccaggttcaggtcgggcggttgggtctggggaacaggtacctttcacgtctacaccatcagcagcctagacgctagtaagtattttcgacttagtttattactgtcagtcagtcgtagctaacgtggttcgttggtaccggttcggaccggaaacgggaccgtaaagggtacggtaaagtaacgtaaaccgaattaggaggacgtgacaccattcgtagttcttcacttccgtcccgtcctatacg

SEQ ID NO: 228897 - DNA, 571 bp, Homo sapiens
  misc_feature: GYAE6OF02JZ5G4.33.85.H08.1.454.CMB.1.raw
  modified_base (198)..(198): a, c, t, g, unknown or other
  misc_feature (198)..(198): n is a, c, g, or t
  modified_base (369)..(369): a, c, t, g, unknown or other
  misc_feature (369)..(369): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccaatcagagtgttagcagtaacttagtctggtaccaacatagacctgaccaggctccaggctcctcttctatgatgcatccaacagggccactcggcactcccagccaggttcagtggcggtggtctgggacagcttcacgtctcgaccntcagcagcctagacgcctagaagtatttgactagtttattactgtactagcctagtcgtagctaacgtggttcgttcggacgtttcggaccgtaacgggaccaagggtacggaaatacgaaaccgacgtaggtaggtcttacggaccgaaccgtacttcgttacggttccttaccgtaacttcccgttacccggaccttacg

SEQ ID NO: 228898 - DNA, 571 bp, Homo sapiens
  misc_feature: GYAE6OF02HZ3MD.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagtattttgctagtttattactgtcagcagcgtagcaactggtcttgggacgtttcggaccgaagggaccaagggttacggaaaattaccgaaaacggtaacttggtacgggacttcggacctaaccgacgttacctcggttacctttcctaactttcccgtttaccccgtccctaacgttccg

SEQ ID NO: 228899 - DNA, 590 bp, Homo sapiens
  misc_feature: GYAE6OF02IRJHJ.33.85.H08.1.454.CMB.1.raw
  modified_base (260)..(260): a, c, t, g, unknown or other
  misc_feature (260)..(260): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
tcagtacacacactcacgaccggtgctcgatttagtatcactcagtcgcggggggggagggaactgctcagttaggacccagagggaaccatggaagccccagctcagcttctcttcctcctgctactctggcctcccgaaggggaaagagcccaccctctcctgcagggccagtcagagtgttagcgggtacctagcctggtaaccaacagagacctggccaggcctcccgaggctcctcttctatgatgcatccaaangggccacgtggcactccagcctaggttcaggtggcggtggtctgggacagacttcactctacaccatcagcaacctagaacttgaaagttctttttacaatttttattaactgtacaaactatcgtacggactaagcgtcggtccctctctactttcgggcggtacgggaaccgaagggtcggagtactaaccgaaacgtaacgtggtgctacgaccacctatcgtagtacttactacttccgttacccgcctaagttctaagtaagtgtttacgtagtacgttggaacggtcggggcgttacggacgaacgggctacagtagcngntnn

SEQ ID NO: 228900 - DNA, 536 bp, Homo sapiens
  misc_feature: GYAE6OF02H02SG.33.85.H08.1.454.CMB.1.raw
  modified_base (197)..(197): a, c, t, g, unknown or other
  misc_feature (197)..(197): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccaccggagaaattgtgttgacacagtctccggccaccctgtctttgtctccaggggaaanagccaccctctcctgcagggccagtcagagtgttagcgggtacctagcctggtaccaacagagacctggccaggcctcccaggcctcctctctatgatgcatccaacagggccacgtggccactcccagccaggttcaggtggcggtgggtctgggacagacttcactctcaccatcagcagcctagacgcctagaagtattttgcttagtttattactgtcagtctagcgtagctacgtggtcgttggtacgttcggaccgtaagggaccgtaaggtagaaactacgaaacgacgtgtaggctgcacatcgtgttcttctacttccttcccgctatcg

SEQ ID NO: 228901 - DNA, 519 bp, Homo sapiens
  misc_feature: GYAE6OF02G6BGE.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccaggctcctcttctatgatgcatccaacagggccactggcatcccagccaggttcagtggcggtgggtctggggacagacttcactctcaccatcagcagcctagacgcctgaagtattttgctagtttattactgtcagcagcgtagcaactggtcttggacgttcggaccgtaagggaccaagggtggaaactacgaaacgactgtaggctgacacatctgtcttcatccttcccgctatcg

SEQ ID NO: 228902 - DNA, 590 bp, Homo sapiens
  misc_feature: GYAE6OF02IQWGV.33.85.H08.1.454.CMB.1.raw
  modified_base (588)..(589): a, c, t, g, unknown or other
  misc_feature (588)..(589): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagagacctggccaggcctcccaggctcctcttctatgatgcatccaacagggccactggcatcccagccaggttcagtggcggtggtctggggacaggacttcactctcaccatcagcagcctagagcctagaagtattttgctagtttattactgtcagcaggcgtagacaactggtcttggaccgtttcggaccgaagggacccgtaaaggtcggaaaacttcgaaaaccggaacttggtacggctacgaccaacccgattccgtagttccttacgacgtttccgttccccggccttaacgttccgtaggtaacgttggttgttaggtaccttgggaacggtccggggcttcgggacgtaagggccgtacgtaacgtagctgnng

SEQ ID NO: 228903 - DNA, 531 bp, Homo sapiens
  misc_feature: GYAE6OF02IZ577.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcagcggcttcttagcctggtaccagcagaaacctggccaggcctccaggctcctcctctatggtgcatccaccagggccactggcatcccagacaggttcagtggcaggtgggtctgggacagacttcactctcaccatcgacagactggacgcctagaagtatttgctagtctattactgtcagctagtatacgtgggagtacggttcggaccgaagggaccgaaggtaggaaatacgaaacgaacgtgtacgacgtcgcaccagtctgtcttctactccttcccgtccacttacg

SEQ ID NO: 228904 - DNA, 567 bp, Homo sapiens
  misc_feature: GYAE6OF02H11G5.33.85.H08.1.454.CMB.1.raw
  modified_base (308)..(308): a, c, t, g, unknown or other
  misc_feature (308)..(308): n is a, c, g, or t
  modified_base (563)..(563): a, c, t, g, unknown or other
  misc_feature (563)..(563): n is a, c, g, or t
  modified_base (565)..(567): a, c, t, g, unknown or other
  misc_feature (565)..(567): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagcccaccctctcctgcagggccagtcagagtgttagcgggtacctagcctggtaccaacagagacctggccaggctcccaggctcctcttctatgatgcatccaacagggccactggcatcccagccaggttcagtggcggtgggtcgtgggacagacttcnctctcaccatcagcacgcctagagcctgaagtattttgctagtttatactgtcagcagcgtagacaacgttggtcttggacgttcggccgaagggaccgaaggtaggaaactacgaaaacgtaactaggttcggctgaccaacctatccgttgttccttacacttccctttccccgcctacttcctaggtaagttgttagttcgtacgtggaacggtccgggtcgtgggaccgtaagggtccgcgtaagttaggntnnn

SEQ ID NO: 228905 - DNA, 673 bp, Homo sapiens
  misc_feature: GYAE6OF02JQT5X.33.85.H08.1.454.CMB.1.raw
  modified_base (254)..(254): a, c, t, g, unknown or other
  misc_feature (254)..(254): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccgaggctcctcttctatgatgcatccaacgngggccacgtggcatcccagccaggttcaggtcggcggtgggtcgtgggacaggtacttcgactctcaccatcgagcacgcctagacgcctagaagtattttgacttagtttacttacgtgttcgagtcgagtcgtagacctaacgttcggttacgtttacggggtaacccgtttcggaacccggtaaaggggtacccgtaaaggggttacggaaaaccttacggaaaaacggtacgttcgggtacggtacgtaccgggaaccctaccgtaatttccgttagttacccgtttaccacctttccccgttacccgtccctaagtttcccgtaggtaaacggtttccgttgttaccgttaccgttagggacgggtccgggtacgttacgggaccgtaacgggcctacgagtaggctagtgacg

SEQ ID NO: 228906 - DNA, 543 bp, Homo sapiens
  misc_feature: GYAE6OF02GW053.33.85.H08.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (537)..(537): a, c, t, g, unknown or other
  misc_feature (537)..(537): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctntcctgcagggccagtcagngtgttagcgggtacctagcctggtaccaacagagacctggccaggctcccaggctcctctctatgatgcatccaacagggccactggcactcccagcccaggttcaggtggcggtggtctgggacagacttcactctcacatcagcacgcctagacgcctagaagtattttgactagttttattacttgtctgactagcgtagcaactcggacctaacgaccgttcgaccgaaggacacgacgtggaagtattaaacgataggtacggctacggaccacctattctacgttccttactacttcccttcccnctaacg

SEQ ID NO: 228907 - DNA, 501 bp, Homo sapiens
  misc_feature: GYAE6OF02HBMRH.33.85.H08.1.454.CMB.1.raw
  modified_base (497)..(497): a, c, t, g, unknown or other
  misc_feature (497)..(497): n is a, c, g, or t
  modified_base (499)..(501): a, c, t, g, unknown or other
  misc_feature (499)..(501): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggttcttggacgttcggccaagggaccaaggtgaaatcaaacgactgtgctgcacatctgtcttcatccttcccgcctatctgaagttgtgtgtactggaggcgggctgggacaaggcgcatagntnnn

SEQ ID NO: 228908 - DNA, 498 bp, Homo sapiens
  misc_feature: GYAE6OF02G7EZD.33.85.H08.1.454.CMB.1.raw
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (496)..(498): a, c, t, g, unknown or other
  misc_feature (496)..(498): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacaggacttcactctcaccatcagcagcctagagcctgaagtattttgctagtttattactgtctgcagcgtagcactggcctaacaccttcggaccaaggacacgactggagataaacgactgngctgcacntctgtctcatcctcccgctatctagtagtgtgtgtactggacgcgggctggacgaggcgacagtagnnn

SEQ ID NO: 228909 - DNA, 511 bp, Homo sapiens
  misc_feature: GYAE6OF02IBIF4.33.85.H08.1.454.CMB.1.raw
  modified_base (252)..(252): a, c, t, g, unknown or other
  misc_feature (252)..(252): n is a, c, g, or t
  modified_base (378)..(378): a, c, t, g, unknown or other
  misc_feature (378)..(378): n is a, c, g, or t
  modified_base (464)..(464): a, c, t, g, unknown or other
  misc_feature (464)..(464): n is a, c, g, or t
  modified_base (507)..(511): a, c, t, g, unknown or other
  misc_feature (507)..(511): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctgggccaggctcccaggctcctcttctatgatgcatccaaanagggccactggcatcccagccaggttcagtggcggtggtctgggacagtacttcactctcaccatcagcagcctagagcctagaagtatttgctagtctattactgtcagcagtatacgtgggganacgttcggactaaagggaccaaaggtaggaaatcaaaacgactgtggactgcacatctgtacttcatcctcccgctatctagatgngtagtactgaggcgggctaggacaacgggcacgtaatacggannnnn

SEQ ID NO: 228910 - DNA, 575 bp, Homo sapiens
  misc_feature: GYAE6OF02HU52X.33.85.H08.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (404)..(404): a, c, t, g, unknown or other
  misc_feature (404)..(404): n is a, c, g, or t
  modified_base (498)..(498): a, c, t, g, unknown or other
  misc_feature (498)..(498): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtactagcctggtaccaanagagacctggccaggcctcccaggctcctcttctatgatgcactccaacgacggggcccaacgtggccatccccagtccctaggttccaggtgggcggttggggtctggggacaggacttcactcgtacaccatccaggcagcctaagngcctagaagtatttgcttagtttattacgtgtcagtcagcgtagcacgtcgacctaacgtaccgttccggaccgaagggaccacgacgtggaanaacgttaacgacgttggtacggctcggaccaccgtatccgttacgttccttaccacgttccccttacccgactaacg

SEQ ID NO: 228911 - DNA, 506 bp, Homo sapiens
  misc_feature: GYAE6OF02IKUI1.33.85.H08.1.454.CMB.1.raw
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (495)..(495): a, c, t, g, unknown or other
  misc_feature (495)..(495): n is a, c, g, or t
  modified_base (503)..(506): a, c, t, g, unknown or other
  misc_feature (503)..(506): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagagacctggccaggctcccaggctcctcttctatgatgcatcccaacagggccactggcactcccagccaggtcagtggcggtgggtcgtgggacagacttcactctcaccatcagcagcctagagcctagagtattttgctagtttatactgtcagcagcgtagctaacgtggtcttggacgttcggaccgtaagggacaaggtagaaatacaaagacgtgtgctagcaccatctntcttctntcttccncatctagatgtgtctacgtgcggcggctggacgtacggcncgagtagnnnn

SEQ ID NO: 228912 - DNA, 520 bp, Homo sapiens
  misc_feature: GYAE6OF02IRFU3.33.85.H08.1.454.CMB.1.raw
  modified_base (327)..(327): a, c, t, g, unknown or other
  misc_feature (327)..(327): n is a, c, g, or t
  modified_base (517)..(520): a, c, t, g, unknown or other
  misc_feature (517)..(520): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagagacctggcccaggcctcccaggctcctcttctatgatgcatccaacagggccactggcatcccagccaggttcagtggcgtgggtctgggacagacttcactctcaccatcagcagcctagngcctgaagattttgctagtttattactgtcagcagcgtagcaactggtcttggaccgtttcggaccgaagggaccgaagggtggaaactacaaacggaactggtggctcgcaccatctgtcttcatccttcccgcctatctgaagttgtgtgtacgtggacgtcgggctgggcgaacggcgacgataggnnnn

SEQ ID NO: 228913 - DNA, 606 bp, Homo sapiens
  misc_feature: GYAE6OF02ITSWZ.33.85.H08.1.454.CMB.1.raw
  modified_base (198)..(198): a, c, t, g, unknown or other
  misc_feature (198)..(198): n is a, c, g, or t
  modified_base (405)..(405): a, c, t, g, unknown or other
  misc_feature (405)..(405): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccaccggagaaattgtgttgacacagtctccggccaccctgtctttgtctccaggggaaagngccaccctctcctgcagggccagtcagagtgttagcgggtacctagcctggtaccaacagagacctggccaggcctcccgaggcctcctctctatgatcgcactccaacgacgggccaacgtggcactcccagcctaggttcagtggcggtgggtctgggacagaccttcactctcaacatcagcacgcctagacgacctagaagtnttttagcttagttttaacttacgtcgtacagacgagtcgtaagaccgaacttgggtcttaggaccgttcggacgaagggtaaccaaagggtaggaaaactaaccgaaacgtaacgtggtaggtaccgtcggtaccaaccctaagttccgttagtttacccgtttactaacgttcccgttttaccccggaccctattaccgg

SEQ ID NO: 228914 - DNA, 505 bp, Homo sapiens
  misc_feature: GYAE6OF02F9CK9.33.85.H08.1.454.CMB.1.raw
  modified_base (433)..(433): a, c, t, g, unknown or other
  misc_feature (433)..(433): n is a, c, g, or t
  modified_base (503)..(504): a, c, t, g, unknown or other
  misc_feature (503)..(504): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaccagggccactggcatcccagccaggttcagtggcagtgggtctgggacagacttcactctcaccatcagcagcctagagcctgaagattttgctagtttattactgtctgcagcgtagcaactggacctaacaccttcggccaagggacacgactggacgaattaaacgaatgtgctgcaccntctgtctcatcttcccgcactctgagttgtgtgtactgtacgcgggtctggacgagggccgacagtacgnng

SEQ ID NO: 228915 - DNA, 495 bp, Homo sapiens
  misc_feature: GYAE6OF02GMVIA.33.85.H08.1.454.CMB.1.raw
  modified_base (488)..(488): a, c, t, g, unknown or other
  misc_feature (488)..(488): n is a, c, g, or t
  modified_base (494)..(495): a, c, t, g, unknown or other
  misc_feature (494)..(495): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccatggcatcccagccaggttcagtggcggtgggtctgggacagacttcactctcaccatcagcagcctagagcctgaagtatttgctagtttattactgtctgcagcgtagcaactggacctaacaccttcggaccaagggacacgactggagattaaacgactgtgctgcacatctgtcttcattccttcccgctatctagacgtgtgtgtactgagcgggctggcaggcncatagnn

SEQ ID NO: 228916 - DNA, 519 bp, Homo sapiens
  misc_feature: GYAE6OF02IMHQK.33.85.H08.1.454.CMB.1.raw
  modified_base (516)..(519): a, c, t, g, unknown or other
  misc_feature (516)..(519): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaacagggccactggcatcccagccaggttcagtggcggtgggtctgggacagacttcactctcaccatcagcagcctagagcctgaagtattttgctagtttattactgtcagcagcgtagcaactggtcttggacgttcggaccgaagggacctaagggtaggaaatacgaaacgactggtgctcgcacatctgtcttcactccttcccgctactctagaagttgtgtgtacgtggacggtcggcgtggcgaaggccgcgataggnnnn

SEQ ID NO: 228917 - DNA, 688 bp, Homo sapiens
  misc_feature: GYAE6OF02FUZ92.33.85.H08.1.454.CMB.1.raw
  modified_base (489)..(489): a, c, t, g, unknown or other
  misc_feature (489)..(489): n is a, c, g, or t
tcagtacacacactcacgaccggtgctcgatttagtatcactcagtcggcgggggggaggaactgtctcagttaggacccaggtagggaaccatggaagccccagctcagcttctcgttcctcctagctaactactgggtcccttcccgagagtacccaacccggagaaactttcgttggttcgacgtacagtccttccagtccaccgtggtactttaggctcccgagggtagaaacgagcccaccgtcgttccagtgccacgggcccaggtcagagtacttagcgattccttcttcggcccttggtaccaacacgtaaacctggccgacggcctccgaggcctccgtcaagtccaggaagtggcattcaacaggccactagcatccgagccaagttactaggtggcaggtcggtcgtagggactagtacttcacttcctaccaccgataccagccaaggaccctagacgtccgttagaggtacttacnggaactaggtttactttacgtgttacttggacgtacggtacggttaataccgtaaccgttgggtacccttaaccgtacccgtttccggacccgtaagggaccctacggaaccgtacgggaacgttaacgttaaacccgggaaccgttgggtaccggtaccgtccggtacccgaacccgtacgttacccgtcgttacccg

SEQ ID NO: 228918 - DNA, 597 bp, Homo sapiens
  misc_feature: GYAE6OF02GELNL.33.85.H08.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccaggctcctcttctatgatgcatcccaacngggccactggcatcccagccaggttcaggtggcggtgggtctggggacaggcttcactctcacatcagcagcctagagcctagaagtattttgctagtttattacgtgtcagcagtcgtagctacgttcggttcgttacggtaccggtttaccgggaccgtaaacggggaccgtaaaggggtacggaaaagtaccgaaaacgtaccgttagggtacggtacgtcggaccaccgtacgttaccgttacgttccgtttactaaccgttcccgtttccccgtacctacttaccgg

SEQ ID NO: 228919 - DNA, 590 bp, Homo sapiens
  misc_feature: GYAE6OF02JYEG9.33.85.H08.1.454.CMB.1.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (364)..(364): a, c, t, g, unknown or other
  misc_feature (364)..(364): n is a, c, g, or t
tcagtacacacactcacgaccggtgctcgatttagtatcactcagtcgcggggaggaacgtgctcagttaggacccagagggaaccatggaagccccagctcagcttctcttcctcctgctactctggctcccagatacccaccggagaaattgtgttgacacagtctccggccaccctgtcttgtctccagggaagagccaccctctcctgcacgggccagtcagtgtgttagcggtacngtcctaggtaccaanagacgacctggccaggcctcccagggcctacctcgatctatgatcgacacgtcccacgagggcccagtcggcactccgaagcccaggttcaggtgctacggtgggtcngggacagtactcgtatctacgaccagtccagcacgaccgtgacgtccgtgaaacgtgttttacacgttagtttacttagtcgttctagtcgacggttacgtacgactacgttacggtaccttaactaccgttccgacgtaagaccgtacgagtacgtagtactaacggtacgtgtacggtctacgaccgactacgttcgtcgttaccttacgtacctcgtaccccg

SEQ ID NO: 228920 - DNA, 531 bp, Homo sapiens
  misc_feature: GYAE6OF02F219Z.33.85.H08.1.454.CMB.1.raw
  modified_base (465)..(465): a, c, t, g, unknown or other
  misc_feature (465)..(465): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (530)..(531): a, c, t, g, unknown or other
  misc_feature (530)..(531): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggcccactggcatcccagccaggttcagtggcggtgggtctgggacagcttcactctcaccatcagcagcctagacgcctaggaagtattttgcttaagtttacttactgtcagcagtcgtagcaacgtggtcttggacgtttccggaccgaagggaccgtaaggtaggaaatacgaaaacgactggtaggctgacaccgatcgtgttcctntactccttcccgcctatctagtagtgtgtgtactggngcggntggacgtaaggcgacaagtgcann

SEQ ID NO: 228921 - DNA, 518 bp, Homo sapiens
  misc_feature: GYAE6OF02HE8JS.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccaggctcctcttctatgatgcatccaacagggccactggcatcccagccaggttcagtggcggtggtctgggacagacttcactctcaccatccagcagcctagacgcctgaagtattttgctagtttattactgtcagcagcgtagcaacgtggtcttggacgttcggaccgaacgggaccaagggtacgaaatcgaaacgactgtgcgtgaccacatctgtcttcactcctcccgctatcg

SEQ ID NO: 228922 - DNA, 541 bp, Homo sapiens
  misc_feature: GYAE6OF02HSZTT.33.85.H08.1.454.CMB.1.raw
  modified_base (257)..(257): a, c, t, g, unknown or other
  misc_feature (257)..(257): n is a, c, g, or t
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacaatctccggccaccctgtctttgtctccaggggaaagagccaccctctcctgcagggccagtcagagtgttagcgggtacctagcctggtaccaanagagacctggccggctcccaggctcctcttcatgatgcatcccaacgagggccactggcactccccagccaggttcaggtggcggtggtctgggacagtacttcactctcaccntcagcagcctagacgcctagaagtattttgactagtttattactgtcagtcagtcgtancaactggttcttggcgttcggacgaagggaccgtaaggtacgaaagtacgaaacgtacgtagtagcgtagcaccatcgtcgtccttctactcccgttcccgctactctacg

SEQ ID NO: 228923 - DNA, 652 bp, Homo sapiens
  misc_feature: GYAE6OF02FOBOW.33.85.H08.1.454.CMB.1.raw
  modified_base (207)..(207): a, c, t, g, unknown or other
  misc_feature (207)..(207): n is a, c, g, or t
  modified_base (269)..(269): a, c, t, g, unknown or other
  misc_feature (269)..(269): n is a, c, g, or t
tcagtacacacactcacgaccggtgctcgatttagtatcactcagtcgcgggagaactggctcagttaggacccagagggaaccactggaacgccccaagcctcagtcttcttcttcctcctgctactctggcctcccagataccaccggagaaattgtgttgacacagtctccggtcctaccttgttctttgctccaggggaaagngccaccctctcctgcagggccaggtcagtagtgttagccggtacctagccctggtaccaacngacgcctggccacggtctcccgaggcctcctcttctatgatgctatccaacgcgggcccacgtggccacgtcccgagccctaggttcgaggtggcggtcgggtctaggggaacaggtccttcgacttctacaccatcgagccacgccctagcgacccgtagaacgtagttttcgcctacgttcttaattaccgtgtactacgactaagtacttacgtagggtaagttaccggttcggaccgtaacgggtaccgtaacgggtaggtaaaacctaccgaaaacggtaaacgtcggtacgggctacggaccgtaacctagttaccgttgttaccgttttagtaaccgtttcccgttaccccgtacctacgttaccgtcgtaaccgg

SEQ ID NO: 228924 - DNA, 531 bp, Homo sapiens
  misc_feature: GYAE6OF02FNPYN.33.85.H08.1.454.CMB.1.raw
  modified_base (198)..(198): a, c, t, g, unknown or other
  misc_feature (198)..(198): n is a, c, g, or t
  modified_base (382)..(382): a, c, t, g, unknown or other
  misc_feature (382)..(382): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccaggctcctcttctatgatgcatccaacagggccactggcatcccagccaggttcagtggcggtgggtctggggacagacttcattctcaccatcagcagactggancctgagtatttgcagtgtattactgtcagctagttacggtagttcaattcctccgtacgttccggaccgaaggggaccaagggtcggaaaactcgaaacgactgtaggctggactaccattcgtgtcttcattccgtcccgtcattccg

SEQ ID NO: 228925 - DNA, 523 bp, Homo sapiens
  misc_feature: GYAE6OF02IOE7B.33.85.H08.1.454.CMB.1.raw
  modified_base (198)..(198): a, c, t, g, unknown or other
  misc_feature (198)..(198): n is a, c, g, or t
  modified_base (392)..(392): a, c, t, g, unknown or other
  misc_feature (392)..(392): n is a, c, g, or t
  modified_base (492)..(492): a, c, t, g, unknown or other
  misc_feature (492)..(492): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacaatctccggccaccctgtctttgtctccaggggaaanagccaccctctcctgcagggccagtcagagtgttagcgggtacctagcctggtaccaacagagacctggccgggctcccaggcctcctcttctatgatgcatcccaacagggccactggcatcccagccaggttcagtggcggtggtctgggacagacttcactctcaccatcagcagcctagcgcctgaagtnttttgctagtttatactgtcagcagcgtagacaactggtcttggacgttcggaccaagggaccaaggtagaaatacgaaacgtacgtgtgcgtgcaaccntctcgtcttcacttcctcccgctactctacg

SEQ ID NO: 228926 - DNA, 592 bp, Homo sapiens
  misc_feature: GYAE6OF02I7PU9.33.85.H08.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
  modified_base (376)..(376): a, c, t, g, unknown or other
  misc_feature (376)..(376): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacgagacgacctggccaggcctcccaggcctcctcttctatgatcgctatccaacgngggccacgtggcactcccagccaggttcagtcggcggtggtctgggacagtacttcactctcacntcagcacgcctagacgccgtagaacgttatttgacttagtttactactgtacagtacacgtcgtctactacgtcggcctcggtctaccgtaccgttcggaccgtaacgggacctacgtacgttacgggacgtacgttacggaccgtaacgttggtacgggtacttaccgtaccgtacccgttcgttcgttacccttcgtaccgttccttaccccgg

SEQ ID NO: 228927 - DNA, 725 bp, Homo sapiens
  misc_feature: GYAE6OF02INOWI.33.85.H08.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
tcagtacacacactcacgaccggtgctcgatttagtatcactcagtcgcggggggaggaactgctcagttaggacccagagggaaccatggaagccccagctcagcttctcttcctcctgctactctggctccagataccaccggagaaattgtgttgacacagtctccagccaccctgtctttgtctccaggagaagngccacctctcatgcagggccagtcngagtattagcatcttntggcctgtaccaacagaacctggccaggctcccaggcctcctcatccagaatgcattcaacacgggccactcggcactcccagccgtacggttcacggtcggacgtagggttcggggttccgtaggggaaccaacggtacctttaccgaaccgttccttacccgaaaccctacgttaccaacggtcctaacggaccccgttaaggaaccggtcccgttagggaacggttaactttccgtacggtaccgttaaacggttttttaacttaccgttagttaccgacggtacctacggtccgtttaccgttacccgtaaacggttcccgggtacccgtttcccggtacggtacccttaaccccggttcgggaaccccgtaacggggtaaccgtaccgggtaacggtttaccggggacgtaaaccggtttaacggaacccggttaacgttcgggtacggtcccgttaccggtacccgtaccccgtttcgg

SEQ ID NO: 228928 - DNA, 500 bp, Homo sapiens
  misc_feature: GYAE6OF02IPGPX.33.85.H08.1.454.CMB.1.raw
  modified_base (252)..(252): a, c, t, g, unknown or other
  misc_feature (252)..(252): n is a, c, g, or t
  modified_base (497)..(500): a, c, t, g, unknown or other
  misc_feature (497)..(500): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacngggccactggcatcccagccaggttcagtggcggtgggtctgggacagacttcactctcaccatcagcagcctagagcctgaagattttgctagtttattactgtcagcagcgtagcaacgtggtcttggacgttcggccaagggaccaaggtgaaatacaaacgactgtgctgcacatctgtcttcatccttccgctatctgtagtgtgtgtactggagcgggtctggacgaggcacgagtagnnnn

SEQ ID NO: 228929 - DNA, 506 bp, Homo sapiens
  misc_feature: GYAE6OF02FQ2PR.33.85.H08.1.454.CMB.1.raw
  modified_base (456)..(456): a, c, t, g, unknown or other
  misc_feature (456)..(456): n is a, c, g, or t
  modified_base (503)..(504): a, c, t, g, unknown or other
  misc_feature (503)..(504): n is a, c, g, or t
  modified_base (506)..(506): a, c, t, g, unknown or other
  misc_feature (506)..(506): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggcccatggcactcccagccaggttcagtggcggtggtctgggacagacttcactctcaccatcagcagcctagacgcctgaagtattttgctagtttattactgtcagcagcgtagcaactggtcttgggacgttcggcgaaacgggacaagggtgaaactcaaacgactgtacgctgcactatctgttcttcattcctccnctatctagtaagtgtgtgtactggacggcggctggcaggcgcagtcnngn

SEQ ID NO: 228930 - DNA, 716 bp, Homo sapiens
  misc_feature: GYAE6OF02HASNX.33.85.H08.1.454.CMB.1.raw
  modified_base (252)..(252): a, c, t, g, unknown or other
  misc_feature (252)..(252): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccaggctcctcttctatgatgcatccaangggcccatggcatcccagccaggttcagtggcggtgggtctgggacagacttcactctcaccatcagcagcctagacgcctagaagtattttgactagtttattactgtacagcagtcgtagacctaacgtcggttcgttacgggtaccggtttaccgggacccgaaaggggtaacccgtaaaaggggttacgggaaaaacgttaaccggaaaaaccggtaaaccgttacgggtacgggtaccgttacggacccgtaacccgtaactttacccgttacggtttacctttacctaaccgttttcccccgtttaccccgggtaccccttaacgtttaacccgttacggttaaacggtttcggtttacgggtttacggttaacgttacgggtaacgggtccggggttaccggttacggggaaccgtaacggggtcccggacgtaaggtaacgggtcacggtcgtacg

SEQ ID NO: 228931 - DNA, 600 bp, Homo sapiens
  misc_feature: GYAE6OF02HO2Q4.33.85.H08.1.454.CMB.1.raw
  modified_base (265)..(265): a, c, t, g, unknown or other
  misc_feature (265)..(265): n is a, c, g, or t
  modified_base (353)..(353): a, c, t, g, unknown or other
  misc_feature (353)..(353): n is a, c, g, or t
  modified_base (598)..(598): a, c, t, g, unknown or other
  misc_feature (598)..(598): n is a, c, g, or t
tcagtacacacactcacgaccggtgctcgatttagtatcactcagtcgtcggggggggaggaactgcgtcagttaggacccagagggaaccatggaagccccagcctcgagcttctcttcctcctgcctactctggctcccaggggaaagaggcccacccgtctcctgcacgggccagtcagagtgttacgcgggtacctagccgtggtacccaacagagacctggccaggcctcccaggctcctcttctatgatgctatccaangggccatggcatcccagccacggtcagtcgacggtgggtctggactgacttcgactctcaccatccagcagcctagacgcctgaagtntttgactagtttatactgtacacgcacgcgtacgctaaactcggttcgttggtacccggtttcggccgaaagggacccgtaagggtaggaaaactcgaaaacgtaactggtggctggaccacctatcctagtaccttactaactccttcccgcctacgttcgtaggaaacgttgtgtacgtacgttaggaacggtccggggcctggggaccctaacgggcccgacgtaacgttacggctcgtacncg

SEQ ID NO: 228932 - DNA, 539 bp, Homo sapiens
  misc_feature: GYAE6OF02IQSNQ.33.85.H08.1.454.CMB.1.raw
  modified_base (538)..(539): a, c, t, g, unknown or other
  misc_feature (538)..(539): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggcccaggcctcccaggctcctcttctatgatgcatccaacagggccactggcatcccagccagttcagtggcggtgggtctgggacagacttcactctcaccatcagcagcctagacgcctgagtatttgctagtttattactgtcagcagcgtagcaacgtggtcttggacgtttcggccgaaagggacccgaaagggtaggaaactaccgaaacgtacgtggtggtctgcaccatcctgttcttcactccttcccgctacttctgtaacgttgttgtgttacgtggacggtcgggcgtggaccgaaggcgactacgtagctgnn

SEQ ID NO: 228933 - DNA, 539 bp, Homo sapiens
  misc_feature: GYAE6OF02FWLVZ.33.85.H08.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
  modified_base (535)..(535): a, c, t, g, unknown or other
  misc_feature (535)..(535): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccaggctcctcttctatgatgcatccaacngggccactggcatcccagccaggttcagtggcggtggtctggggacaggtacttcactctcaccatcagcacgcctagacgcctagaatagttttgactagttttactacgtgtcagtcagtcgtagctaacgtggtcttggtacgttcggacgaacgggtccaaagggtgaaactacgaaacgtactggtaggctgacacgatcgtgtcttcgacttccttcccgacctntccg

SEQ ID NO: 228934 - DNA, 562 bp, Homo sapiens
  misc_feature: GYAE6OF02IKJSU.33.85.H08.1.454.CMB.1.raw
  modified_base (342)..(342): a, c, t, g, unknown or other
  misc_feature (342)..(342): n is a, c, g, or t
  modified_base (560)..(562): a, c, t, g, unknown or other
  misc_feature (560)..(562): n is a, c, g, or t
tcagtacacacactcacgaccggtgctcgatttagtatcactcagtcgcggggggggaggaactgctcagttaggacccagagggaccatggaagccccagctcagcttctcttcctcctgctactctggctcccaggggaaagagccaccctctcctgcagggccagtcagagtgttagcgggtactagcctggtaccaacagagacctggccaggcctcccaggctcctcttctatgatgcatcccacgagggcccatggcatcccagccaggtcagtggcggtggtctgggacagacttcactctccaccatcacgcagacgtggacgccgtagaagtnttttgcgtagtgttattacgtgtacagactaggtacggttagttctagttcctaccggtacgttccggaccggtaaacgggaccgaagggtacgaaacgtaaccgaaacgaactgtacggtactacgactacatcctgttcttactactccttccgacctattcgtagtacgtgtgttgtacgtgcggtcggtcgcggtacgaaggcgacgtagagcnnn

SEQ ID NO: 228935 - DNA, 565 bp, Homo sapiens
  misc_feature: GYAE6OF02GNP1T.33.85.H08.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacngagacctggccaggctcccaggctcctcatccatggtncatccaccgagggccactggcactcccagacaggttcagtggcaggtggtctgggacagacttcattcacaccatccgacagacctggacgtccgtagaagtattttacgctagttctatttactgtcagcacgcgtagctaacgttcggttcgttcggtacggttcggaccgaacgggtaccgaagggtacggaaagtacgaaacgtacgtggtacggtcgtacgactacctagttcgtacgttcttactacttccgttacccgctacg

SEQ ID NO: 228936 - DNA, 557 bp, Homo sapiens
  misc_feature: GYAE6OF02JD0IS.33.85.H08.1.454.CMB.1.raw
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (429)..(429): a, c, t, g, unknown or other
  misc_feature (429)..(429): n is a, c, g, or t
tcagtacacacactcacgaccggtgctcgatttagtatcactcagtcggcggggaggaactgctcagttaggacccagagggaaccatggaagccccagctcagcttctcttcctcctgctactctggcctcccagactacccaccggagtaaattgtgttgacacagtctccggcaccctgtcttgctaccagggaaangccacctctcctgcagggcctagtcagagtgtagcggtacctagcctggtaccaangagaccgtgccaggctcccgaggtcctcgtcttctagtgactcgctaatccaaacgcgggtccaacgtggccactcccaagccagggttcaggtggcggttggctgggacagcttcgactcgacacagtcagctagcctagacgtcctagaactgtttcgactagttacttcngtacagctagtctagctacgtggtctggtacgttcggaccgtaagggacctaagtagaaactacgaacgactgtacgacgtcgtaccaacgtcctacgttagtccttcacgttcctccgactactacg

SEQ ID NO: 228937 - DNA, 634 bp, Homo sapiens
  misc_feature: GYAE6OF02FZ86Y.33.85.H08.1.454.CMB.1.raw
  modified_base (218)..(218): a, c, t, g, unknown or other
  misc_feature (218)..(218): n is a, c, g, or t
  modified_base (629)..(629): a, c, t, g, unknown or other
  misc_feature (629)..(629): n is a, c, g, or t
tcagtacacacactcacgaccggtgctcgatttagtatcactcagtcggcggggggggaggaacgtggctcagttaggacccagagggaaccatcggaagccccagcctcgagcttctcttccctcctcgctactctggctcccgaggggaaagacggcccacccgtctccgtgcagggccagtcagagtgttagcgggtacctagcctggtaccaanagagactggccaggctcccaggcctcctcttctatgatgcatcccaacgacgggcccacgtggcactccccgagccaggttcagtgggcggtgggtctgggacagacttcactctcaccatcagcagccctagacgcctgaaagtattttcgcttaagttttattacgtgtcagctagcgtagactaacgtggttcttcgggtacgttcccgggacgaaacggggtaccgaaagggtacggtaaaacgtaacgaaacggtaaccgtggtcggtcgttaggaccaccgtactcgttgttaccttcctactttcccgttacccgaccctacttccgttaggtaacgttgttcggttacgtacgtcggtaacggccgggtcgtacggcgaaagggtccgtacgtaacgtagcgngtagc

SEQ ID NO: 228938 - DNA, 532 bp, Homo sapiens
  misc_feature: GYAE6OF02FV9E4.33.85.H08.1.454.CMB.1.raw
  modified_base (198)..(198): a, c, t, g, unknown or other
  misc_feature (198)..(198): n is a, c, g, or t
  modified_base (381)..(381): a, c, t, g, unknown or other
  misc_feature (381)..(381): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccaacagagacctggccaggctcccgggctcctcttctatgatgcatccaacagggccactggcatccagccaggttcagtggcggtgggtctgggacagacttcactctcaccatcagcagcctagacncctgaagtattttgctagtttattactgtcagcagcgtagctaactgtcttggacgttcggcctaagggaccaagggtgaaactcgaaacgtaacgtggtaggctcggcaccgtagtctacgttcttacacttccttcccgcctatctagg

SEQ ID NO: 228939 - DNA, 757 bp, Homo sapiens
  misc_feature: GYAE6OF02JOGRH.33.85.H08.1.454.CMB.1.raw
  modified_base (756)..(756): a, c, t, g, unknown or other
  misc_feature (756)..(756): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggcctccgagggaaagacgcccaccctctcctgcgacgggccagtcagagtgttagcggtacctagcctggtaccaacagagaccgtggaccaggcctacccgaggtcctccttcttactatgactcgacactacccgaaacgcgggccacgttggacctaccgtcccgagccgtaaggttccgaggtcgggtcggttgggtcgtagggacagtaccgttccacttcctaccacctactccgacgactacgacctaacggcggtacctaggtaattcgttttacgacgttagttttactaccgtagtaccgtagaccgtaagtcgtaacgtacgtacgtttcggttaccggtttaggaccgtttaccggaaccgtaacgggtaaaccgtaagggtaacggtaaaacgtaccgaaaacggtaacgtcggtacgggtaacctacgacccgtaacttacggtttccttacggttacctttaccgtacccgttacccgtttccccggtaacgttcgtttaaccgtagggtttaaacgttcgttttacggtacgtttacgttacggggtcccggtacgggtaggttacccgggaacgtagggtacccgtagttaacggtaaccggcgtctagng

SEQ ID NO: 228940 - DNA, 574 bp, Homo sapiens
  misc_feature: GYAE6OF02G6PTP.33.85.H08.1.454.CMB.1.raw
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaagagccaccctctcctgcagggccagtcagagtgttaacgggtacctagcctggtaccaacagagacctggccaggctcccaggctcctcttctatgatgcatccaacagggccactggcatcccagccaggttcagtggcagtgggtcgtgggacagacttcattctccaccatcagacagactggacgcctagaatattttgactagttgttatttacgtgtacagcgtaaggtacggttagttacattccgtccgtacggtttcggaccgtaacgggaccgaagggtagaaatacgaaacgaactggtgacgtgccacgtatcgttgtcttactactccttcccgactactctaggtaagttgttgtagttacgtaggtcggtccgggtcgtcgggacgtaacgggccgtacgtaagtacggcgtangn

SEQ ID NO: 228941 - DNA, 600 bp, Homo sapiens
  misc_feature: GYAE6OF02FPHTI.33.85.H08.1.454.CMB.1.raw
  modified_base (145)..(145): a, c, t, g, unknown or other
  misc_feature (145)..(145): n is a, c, g, or t
  modified_base (596)..(596): a, c, t, g, unknown or other
  misc_feature (596)..(596): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaagngccaccctctcctgcagggccagtcagagtgttagcgggtacctagcctggtaccaacagacgacctggccaggctcccgaggctcctcatctatgatgcatcccacgagggccactggcatcccgacgccacggttcagtggcgaggtcggtcgtgggacagacttcactctcaccatcgagcacgcctagacgcctagaagtagttttgcgtagtagttacttacgtgtacagtcgagttacggtagttctatcctcggtaccgttcggaccgtaagggaccgtaaggtaggaaacgtacaaaacgaacgtaggtacggcgtacgccaaccacttctcggttcttacctactcctttccccgcctacgttcttacgtacgttgttacggtacggttacgtaggaccggtcgggtaccgtacgggacgaacgggccgtacgacggtacgntacg

SEQ ID NO: 228942 - DNA, 492 bp, Homo sapiens
  misc_feature: GYAE6OF02JC3VG.33.85.H08.1.454.CMB.1.raw
  modified_base (427)..(427): a, c, t, g, unknown or other
  misc_feature (427)..(427): n is a, c, g, or t
  modified_base (460)..(460): a, c, t, g, unknown or other
  misc_feature (460)..(460): n is a, c, g, or t
  modified_base (489)..(492): a, c, t, g, unknown or other
  misc_feature (489)..(492): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttatactgtcagcagcgtagcaactggtcttggacgttcggccaagggccaaggtgaaatcaaacgaactgtggctgcacntctgtcttcatcttcccgcatctgaagtgtgtntactggacgcgggctggcaaggcgcatgnnnn

SEQ ID NO: 228943 - DNA, 532 bp, Homo sapiens
  misc_feature: GYAE6OF02GLNCK.33.85.H08.1.454.CMB.1.raw
  modified_base (529)..(529): a, c, t, g, unknown or other
  misc_feature (529)..(529): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtggtctgggacagacttcactctcaccatcagcagcctagacgcctgaagtattttgactagtttattacttgtcagtcagcgtagcaactggtcttggacgtttcggaccaaggggaccctaagggtgaaataccgaaacgaactggtacggctcgaccacatctagtcttacatccttccgcctatcgtgaagtgtgtacgtactggacggcggtcgtggaccgaaggccgcaagtgctagntac

SEQ ID NO: 228944 - DNA, 559 bp, Homo sapiens
  misc_feature: GYAE6OF02JDVQ7.33.85.H08.1.454.CMB.1.raw
  modified_base (257)..(257): a, c, t, g, unknown or other
  misc_feature (257)..(257): n is a, c, g, or t
  modified_base (371)..(371): a, c, t, g, unknown or other
  misc_feature (371)..(371): n is a, c, g, or t
  modified_base (541)..(541): a, c, t, g, unknown or other
  misc_feature (541)..(541): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaagagccaccctctcctgcagggccagtcagagtgttagcgggtacctagcctggtaccaangagacctggccaggctcccaggctcctcatctatgatgcatccaccgagggcccacgtggcactcccgagacaggttcaggtggcaggtgggtctgggacaggacttcatttcncaccatcagtcagacgtggacgcgtagaagtatttgactagttgtattacgttgtcagtctagttacgtacttcattccgtaccgtacgttccggaccgaacgggtaaccaaggtacgaatacgaacgtacgtaggtcggtacgtcgacacctagtcttcgtaccttacncgttacccttcccgtacc

SEQ ID NO: 228945 - DNA, 556 bp, Homo sapiens
  misc_feature: GYAE6OF02GB6CQ.33.85.H08.1.454.CMB.1.raw
  modified_base (552)..(553): a, c, t, g, unknown or other
  misc_feature (552)..(553): n is a, c, g, or t
  modified_base (555)..(556): a, c, t, g, unknown or other
  misc_feature (555)..(556): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggcctcctcttctatgatgcatccaacgagggccacgtggcatcccagccaggttcagtggcggtgggtcgtgggacagacttcactctcaccatcagcagcctagagcctgaagtattttgctagtttattactgtcagcagcgtagctaacgtggtcttggacggttcggaccgaagggaccaaagggtaggaaactaccgaaacgtaacgtggtacggctagccacctatccgttagttccttctacttccttccccgcctactctagaagttgttgtgttacgtggtacggcgggtcgtggaccgaagggtcgacgagtaggnngnn

SEQ ID NO: 228946 - DNA, 499 bp, Homo sapiens
  misc_feature: GYAE6OF02ICT4I.33.85.H08.1.454.CMB.1.raw
  modified_base (251)..(251): a, c, t, g, unknown or other
  misc_feature (251)..(251): n is a, c, g, or t
  modified_base (427)..(427): a, c, t, g, unknown or other
  misc_feature (427)..(427): n is a, c, g, or t
  modified_base (476)..(476): a, c, t, g, unknown or other
  misc_feature (476)..(476): n is a, c, g, or t
  modified_base (496)..(499): a, c, t, g, unknown or other
  misc_feature (496)..(499): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacnggtccactggcatcccagccaggttcagtggcggtgggtctgggacagacttcactctcaccatcagcagcctagagcctagaagattttgctagtttattactgtcagcagcgtagcaactggtcttggacgtttcggcaagggaccaaggtgaaatcaaacgatgtgctgcacntctgtcttcatccttccgctatctagaagtgtgtagtactgaggcgggntgggacaaggcgcagtacgnnnn

SEQ ID NO: 228947 - DNA, 589 bp, Homo sapiens
  misc_feature: GYAE6OF02HO8ER.33.85.H08.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttgcctggaaccaanagagacctggccaggcctccgaggctcctcttcatgatgcatccaaacgngggccaacgtggccatcccaggcctaggttcaggtcggcgggtggtctgggacagtcttcactctacacatcagccacgacctagacgtctagaaagttctttagcttaagttttacttacgtcgtacaggtctaggtacgtacgactaacgttggtacgtttgggtaccgttacggacccggaaagggtaccgaaagggtacgaacgtacgaaacgtaacgtgggtacggtctagaccactagttccgtagttcctttacgtacttcccttccccgg

SEQ ID NO: 228948 - DNA, 554 bp, Homo sapiens
  misc_feature: GYAE6OF02F1604.33.85.H08.1.454.CMB.1.raw
  modified_base (204)..(204): a, c, t, g, unknown or other
  misc_feature (204)..(204): n is a, c, g, or t
  modified_base (324)..(324): a, c, t, g, unknown or other
  misc_feature (324)..(324): n is a, c, g, or t
  modified_base (451)..(451): a, c, t, g, unknown or other
  misc_feature (451)..(451): n is a, c, g, or t
  modified_base (552)..(554): a, c, t, g, unknown or other
  misc_feature (552)..(554): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaanagagacctggccaggctcccaggcctcctcttctatgatgcatccaacgagggccactggcactcccagccaggttcaggtggcggtgggtctgggacagtcttcactctccaccatcancacgcctagacgcctagaagtattttgacttagtttattactgtacagcagcgtagctaacgtggttcgttggtacggttcggaccgaacgggactaagggtacgaaagtaccgaaacgacgttggnggtcctagaccactatctgttcttactaccttccgttcccgctactcgtagtagttcgtagttgtacgtggcggcggtcgtcggacgaggctacgagtgcnnn

SEQ ID NO: 228949 - DNA, 653 bp, Homo sapiens
  misc_feature: GYAE6OF02HYXSH.33.85.H08.1.454.CMB.1.raw
  modified_base (191)..(191): a, c, t, g, unknown or other
  misc_feature (191)..(191): n is a, c, g, or t
tcagtacacacactcacgaccggtgctcgatttagtatcactcagtcgcgggagaactgctcagttaggacccagagggaaccatgggagccccagctcagcttctcttcctcctgctactctggctccagataccaccgggaaattgtgttgacacagtctccagccacctgtctttgctccaggggaangccaccctctcctgcagggccagtcagagtgctggcagcaacttagcctggtaaccaacaaaacctggaccagactccgaggcctcctcatcctatgatgctatccacgacggccacgtcggccactcccagtccgtaggttccgaggtcggactacggtcgggtcgtagggaccaagtaccgttcgaccttccgtacctaccgattcgacgtaccagtcccttaaggacgtacccgtaggaacgtttacgttttacgccgtttaagttttacttaccgttcgggttaccttaggaccgtagtacggttaacggaccgtaaacgtcggtaccctaaacgtcccggtttaccggaccgtaaacggggcctaaccgggtacgtcggaacgtaacgttaaccgtaacgtcggtacgccgtacgaccgtacctacgttccgttacgttaccttctaccttaccccg

SEQ ID NO: 228950 - DNA, 721 bp, Homo sapiens
  misc_feature: GYAE6OF02H9Z1T.33.85.H08.1.454.CMB.1.raw
  modified_base (198)..(198): a, c, t, g, unknown or other
  misc_feature (198)..(198): n is a, c, g, or t
  modified_base (714)..(714): a, c, t, g, unknown or other
  misc_feature (714)..(714): n is a, c, g, or t
tcagtacacacactcacgaccggtgctcgatttagtatcactcagtcgcggggagaactgctcagttaggacccagagggaaccatggaagccccagctcagcttctcttcctcctgctactctggctcccagataccgaccggggaaattgtgttgacacagtctccagccaccctgtctttgtctccaggggaaancgccaccctctcctgcgagggccaagtcagagtgctggacagactaacttacggcctacggtaaccaaaaccaaaaaacctgggaccaacggaacctaccccgaagggcctcccttacaactcctaatagaatcgaccacttaccccgaaccgaacggggcccacgtacgggaccaacgtccccgaaggtacccctaagggtttccgaaaggttcgggaaccgtaaggggttcgggggttacctaagggggaacctaaacggtaacctttaccgacttaccttaccgaaaccctagtacaacggccaacgtacccgtaggaaccgtcccgtaaggaaacgttactttttggaaactttacggttttaacttaacgtggttacctaggacctaggtacgtacgacgttaaacgtcggacccttaaacgtaccggttacggaaccgtaacgggactaacgtacgaggaaatacgttaaaacgcgtaggtgctacgactaccgatcgtacgtccttacncttcccg

SEQ ID NO: 228951 - DNA, 840 bp, Homo sapiens
  misc_feature: GYAE6OF02INPQU.33.85.H08.1.454.CMB.1.raw
tcagtacacacactcacgaccggtgctcgatttagtatcactcaggtcggcggggagaactgctcagttaggacccagagggaaccatggaagccccagctcagcttctcttcctcctgctactctggcctccgagactaccaccggagtaaattgtgttgacacagtctccggcctaccctgtctttcgtcctccgaggggaaacacgccacccgtctcctgccgacgggcctagtccgaggtagttcggttacggaccgggttaacctacggcccgttacggtaacccaagacgaacgtacccgtggaccgtaggtccttacccgacggtcctccttcgttctaagtcgtactcgacctacgtacccgaaacggtacggggtacctaacggttcggtacctaaccgtcccgacggtacccgttaacggtttcgaacgggttcggggtaccgggttcggggtccgtacgggggtaaccgtacggtaccctttaccgaccgttccgttacctaaccgtacgtaccgacggtacctaacgtacccgttaaggaccggtaccgttaaggtaacggtttacgttttacggaacgttttaacgttttaactttaccgttacgttacgtacgtacgtacggtacgttaacgtacgtaacggttcggttacgttacgggtaaccggtttaccgggaaccggtaacggggtaaccgtaacgggttaaaccgggaaacgttaaaccggtaaacgtaacggttcggtaacggaccgtacgtaacccgtacgttacgttccgttagttacccttacgtccgttacccgttacccgtaccgttacttaacg

SEQ ID NO: 228952 - DNA, 545 bp, Homo sapiens
  misc_feature: GYAE6OF02FPRR4.33.85.H08.1.454.CMB.1.raw
  modified_base (475)..(475): a, c, t, g, unknown or other
  misc_feature (475)..(475): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
tcagtacacacactcacgaccggtgctcgatttagtatcactcagttcggcggggggggaggaactcgctcagttaggaccccagagggtaaccatggaagccccagctcagcttctcttcctcctgctactctggctcccaggggaagagccacccgttctcctgcagggccagttcagagtgttagcgggtacctagcctggtaccaacagagaccgtggccagggctcccagggcctcctcttctatgatgcatccaacagggccactggcactcccagccaggttcagtggcggtgggtctggacgaggacttcactcgtcaccatacagcagcctagagctgaagtattttgctagtttattactgtacagtcagtcgtagactaacgtgttacgttggaacgttcggccgtaaagggtacgaaggtagaaagtacaaacgacgtagtacggctgcacatcttgtctacnctccttccgctatctgagtgtcgtgtacgtggacgtcgggctggcgtaaggcgtacgtgtacggnanncg

SEQ ID NO: 228953 - DNA, 726 bp, Homo sapiens
  misc_feature: GYAE6OF02GM53S.33.85.H08.1.454.CMB.1.raw
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
tcagtacacacactcacgaccggtgctcgatttagtatcactcagtcgcgggggggaggaactgctcagttaggacccagagggaaccatggaagccccagctcagcttctcttcctcctgctactctggcctcccgaaggggaaagacgccaccctctcctgcagggccagtcagagtgttagcggtacctagcctggtaccaangagacctggccaggcctcccgaggcctcctcttcatgatgcatccgaaacgngggtcccagtggcactcccacgcctaggttcagttggcggtgggtctgggacagtacttcgactcctacacctactcgagcacgacctagacgaccgtagtaaggttattttacgactttagttttattacgttgtacgtagtacacgtcgttaacgacctaacgtttcggttacgttacgggttaaccggttccggacccggtaaacggggtacccgtaaagggttaacggaaaacttaaccggaaaacgtacggttaggtcggtaccgtttagaccctaaccgttacgtaccgttacgttcccgttacgttaacccgtttccgttaccccgtaccttaagtttacccgtaggtttaaacgttcgggtttacgttacgttaacggttacgggtacgggttaccggggtcgttaaccgggtacggtaaaccgggtccgtaaccgtaaggttaacggcttacgcgtacg

SEQ ID NO: 228954 - DNA, 545 bp, Homo sapiens
  misc_feature: GYAE6OF02GHLAD.33.85.H08.1.454.CMB.1.raw
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcactcccagccaggttcagtggcggtgggtcgtggacagacttcactctcaccatcagcagcctagacgcctagaagtattttgactagtttattactgtcagtcagcgtagctaacgtggtcttggtaccgttcgaccgaagggacctaagggtacggaaatacgaaacgacgtggtcggctgacactatctgttctctactccttcccgcctatctaggaagttgtgttcgttacgtggacggtcggtcgtgggaccgaacgggcgacgtagtacgncngc

SEQ ID NO: 228955 - DNA, 706 bp, Homo sapiens
  misc_feature: GYAE6OF02GWEVB.33.85.H08.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccagataccaccggagaagttgtgttgacgcagtctccaggcaccctgtctttgtctccaggggaanagccacctctcctgcagggccaatcagtagtgttagcagtaacttagtctggtaccaacatagacctgaccaggcctcccgaggcctccncatcctacgatcgcgtaccaacgacgggccaacgtcggccaactccccgaagtcccgtagggtttccaagggttcggaccgtagggttcggggtcctgggggaacctagggtaccctttacgaccgttcctacctaaccctagttacccaacgaccctaaacccgtagtaaaccgtttaggtaaacgttttaactttttttacgttaactttttttaacttaccgttactaacctaaacgtattcccggtaacggtaccgtaagtccgttaccggtacccttccttaccgttaccggtttcgggacggggtaacggtaccgtaagggtcggacgtactaaccgaacgtacgtgtacggctacggacctacgtcgttacttcgttacccttcgtaccttccgtaccccgtctacgg

SEQ ID NO: 228956 - DNA, 657 bp, Homo sapiens
  misc_feature: GYAE6OF02HTHU7.33.85.H08.1.454.CMB.1.raw
  modified_base (198)..(198): a, c, t, g, unknown or other
  misc_feature (198)..(198): n is a, c, g, or t
  modified_base (263)..(263): a, c, t, g, unknown or other
  misc_feature (263)..(263): n is a, c, g, or t
  modified_base (329)..(329): a, c, t, g, unknown or other
  misc_feature (329)..(329): n is a, c, g, or t
tcagtacacacactcacgaccggtgctcgatttagtatcactcagtcgcggggaggaactgctcagttaggacccagagggaaccatggaagccccagctcagcttctcttcctcctgctactctggcctccagatacccaccggagtaaattgtgttgacacagtcgtccgccacctgtctttgtctcgagggaaanacgccaccctctcctgcgacgggccagtcagtagtgtacgcgggtactagcctaggtaaccaagngacgacgtcggaccacggcctccgagtcctcgtcttgatgatcgacactaaccacggacggcacgngaccactcccagtccgtaggtcaggtgggtcggtggtacgtgggactacgtacgttacacttcacaccatacacgtcacgcgtaagcgtccgtaagtaagttatttacgtagtttaagtttattacgtagttacacgtacgtacggtacgtacgtacgtacggtacgttcgttaaccggggttacgttaccggaaccggtaaaggtaaaccggtaagggtaaacgtaaactaaaccggaaactaacggtaggtccgtacgaacgtacctacgtaacgttcgttaccgttcgttaaccgtaccttacccgtccgtactacgttaaccgg

SEQ ID NO: 228957 - DNA, 565 bp, Homo sapiens
  misc_feature: GYAE6OF02GYPYA.33.85.H08.1.454.CMB.1.raw
  modified_base (147)..(147): a, c, t, g, unknown or other
  misc_feature (147)..(147): n is a, c, g, or t
  modified_base (208)..(208): a, c, t, g, unknown or other
  misc_feature (208)..(208): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (487)..(487): a, c, t, g, unknown or other
  misc_feature (487)..(487): n is a, c, g, or t
tcagtacacacactcacgaccggtgctcgatttagtatcactcagtcggcggggggggaggaactgctcagttaggacccaggagggaacctatggaagccccagctcagcttctcttcctcctgctactctggctccaggggaaangcctaccctctcctgcagggtccagtcagagtgttagcgggtacctagcctggtaccaacngaggacctggccaggctcccaggcctcctcttctatgatcgcatcccaaacgcgggccacgtggctactcccagccaggttcagtggcggtgggtcgtgggacagcttcgactctcaccgatcgagcagtctagancctgaagtntttgcttagtttatactgtcagcagcgtagacgtaactggtcgtggtaccgttcggaccgaaagggaccaaagggtacgaaactacgaaacgactggttgactcgacacactctgtcttacactcctccgactnttactagtaagttcgtagtacggtacgtcggacggtccggtagtcggacgtacggtcgtacgtagtaggcgcgtgtcg

SEQ ID NO: 228958 - DNA, 528 bp, Homo sapiens
  misc_feature: GYAE6OF02FNYRP.33.85.H08.1.454.CMB.1.raw
  modified_base (335)..(335): a, c, t, g, unknown or other
  misc_feature (335)..(335): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgctggcagcaacttagcctggtaccaacaaaaacctggccagactcccaggctcctcatctatgatgcatccaccagggccactggcactcccagccaggttcagtggcaggtgggtctggggacaggcctttcgactctcaccatcagcagcctagngcctgaatatttgctagtttactactgtctgcagccgtanctacgtggacctaacnccgttacggaccgagggacacgactggataagtaaacgactgtagctgccacatcgtgtcttcacttcctcccgctactcgtatacggtgtcggtattctggacgtcgggcttcgggacgaacgggcgacgtagtcg

SEQ ID NO: 228959 - DNA, 534 bp, Homo sapiens
  misc_feature: GYAE6OF02GPHLA.33.85.H08.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (370)..(370): a, c, t, g, unknown or other
  misc_feature (370)..(370): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgtagcagcaactacttagcctggtaccagcagacactggccaggctccaggctcctcatccatggngcatcccaccgagggccacgtggcactcccagacaggttcaggtggcaggtgggtctgggacagtacttcattccncaccatcagcagacgtggacgcctagaagtatttgcgtagttgtattacgtgtcagctagtacggttattctacttcgtccgtacgttcggaccgtaagggaccgtaagggtagaactacgaaacgaacgtggtacggcgtacgacactatcgtgttctactcg

SEQ ID NO: 228960 - DNA, 598 bp, Homo sapiens
  misc_feature: GYAE6OF02GSEOE.33.85.H08.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (596)..(597): a, c, t, g, unknown or other
  misc_feature (596)..(597): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccaggggaaagagccaccctctcctgcagggccagtcagagtgttagcgggtactagcctggtaccaanagagacctggccagggcctcccgaggcctcctcctctatggtncatcccacgagggccacgtggcatcccagacaggttcagtggcagtgggtcgtgggcagcttcgactctcacatcgacagacgtgacgcctgaagattttgcacgttactattactgtactagctagttatacggtagggagacggttcgggaccgaacgggaccgtaaagggtaggaaactaacgaaacgaacgtaggtaggtacttggacctaccgtattccttagtcctttacacttccttaccccgtacccgtactttccgtagttaacggttgttcggttacgtacgttgacgggttcgggacgttggggactaacgggcgaccgtagtaacggtgcgactagnnc

SEQ ID NO: 228961 - DNA, 669 bp, Homo sapiens
  misc_feature: GYAE6OF02H2XG3.33.85.H08.1.454.CMB.1.raw
  modified_base (664)..(664): a, c, t, g, unknown or other
  misc_feature (664)..(664): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccagggaaagagccaccctctcctgcaggccagtcagagtgttagcgggtacctagcctggtaccaacagagacctggccaggcctcccgaggcctcctcttctatgatgcatcccaaacgagggccacgtggccatccccacgcctaggttcaggtgggcggtgggtctggggacaggtaccttcgactcctacaaccatcagccacgcctagacgccttaggaagttattttgactttaagttttacttacgtagtcgaagcaggcgttagactaacgttcggttaccgtttagggtaccggtttccgggacccgtaaacggggaccgtaaagggtacggaaaacgttaaccgaaacgtaacgtaggtacggactacggcctaaccgtacttccgttcgttaccttaccactttacccgttccccgacctacgttaccgttaggtaacggttgttacgttacgttacgtacgggaacgggttccgggtacgtacgggtaaccgaacgggcggacctaaggacgtcgntagtc

SEQ ID NO: 228962 - DNA, 647 bp, Homo sapiens
  misc_feature: GYAE6OF02I7JLJ.33.85.H08.1.454.CMB.1.raw
  modified_base (265)..(265): a, c, t, g, unknown or other
  misc_feature (265)..(265): n is a, c, g, or t
  modified_base (358)..(358): a, c, t, g, unknown or other
  misc_feature (358)..(358): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctcccagataccaccggagaaattgtgttgacacagtctccagccaccctgtctttgtctccgaggagaaagagcccaccctctcatgcagggccagtcagtagtattagcgggtacctagcctggtaccaanagagacctggccaggcctaccgaggcctcctcttctatagatcgctatcccaagcgggaccacgtggaccactcccgacgccgtacggttacncggtaggtcgggtcgggtcgtacggggacacgtacttcactcctacgacccatcgacgcgacgaccgtagacgtacctagaagtacttttacgacttagttttaacgttacttacggtacacggtacacgtcgttaacggactaaccggttggttacgttcgggacggtttccgggaccgaacgggtaccgtaagggtaacggtaaacaccgtaaacggtacgtgggtacgacgtacgacctaaccgtcgttaccgttacgtccctttacgtaccgttaccctaccccg

SEQ ID NO: 228963 - DNA, 761 bp, Homo sapiens
  misc_feature: GYAE6OF02IELJ5.33.85.H08.1.454.CMB.1.raw
  modified_base (200)..(200): a, c, t, g, unknown or other
  misc_feature (200)..(200): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattggtgttgacacagtcctccggccaccctgtctttgtctccgaggggaangccaccctctctgcgagggccagtcaggagtgttagcgggtactagcctggtaccaacagacgaccgtggccagggtcctccgaggcctcctacactcctagtggtagcactaccgaccgacgggccctacgtcggcacctcccgaagaccgtaggttcgagggttcggaccgtagggttcggggtcgttagggggaactaacggtacctttacgtaaccttaccgttacccaacctagttccaaacggcctaacggcccgtaacggaccggtacccttaaggtaaacggtttacgtttttacggtaacctttaacggttttaaactttacgtttacgttccgttaacgtacgtaacgggttaccggttaacgtaccgtaaaccgttccgggtaaaccccttaaaccgtaccccgtttaccgggaaccgggtaaacgggtaacccgtaacggtaaaccggtaggtaaacgtaacggtttaaacccggaacgttacggtaacggtctacggaccttaactacggttcgttacgttccttaccgtacttcccgtacccgtccg

SEQ ID NO: 228964 - DNA, 769 bp, Homo sapiens
  misc_feature: GYAE6OF02IHZ6F.33.85.H08.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccgaggggaaangccaccctctcctgcgagggccagtcagagttgttagcggtactagcctggtaccangagacctggccaggctccaggctctcttctatgatgacactaccaacgacggggaccacgtcggactacgtcccaggtcccgtaggtttccagggttcgggtccgggtaggggtccgtacggggactacggttactttcgtaactttcccgtaccaaccctagttaccgaacggtccgaaggtaccgtagggacccgtacggtaaggtaacgttaacggttttcgaccgttaagggtttattaaacgttttaccggtacgttaaccgtaacggtacgttaacgggtttaaaccgggttctttaccgtacgtttccccgttaccggttaaccgggtttacccgggaaacccgggtaaaccggggtaaccgtaaaggggtaacggtaaaaccgtaacgaaaaaccggttacgttacgggttaacggtccgtaacggacccttaacgtaacgttttccgtaacgtttacccttacgttaccctttaccccgttacccgtcccgttaacggttacgg

SEQ ID NO: 228965 - DNA, 651 bp, Homo sapiens
  misc_feature: GYAE6OF02GA9SB.33.85.H08.1.454.CMB.1.raw
  modified_base (311)..(311): a, c, t, g, unknown or other
  misc_feature (311)..(311): n is a, c, g, or t
  modified_base (474)..(474): a, c, t, g, unknown or other
  misc_feature (474)..(474): n is a, c, g, or t
  modified_base (530)..(530): a, c, t, g, unknown or other
  misc_feature (530)..(530): n is a, c, g, or t
tcagtacacacactcacgaccggtgctcgatttagtatcactcagtcgcgggtgcagctgcaggagtcgggcccaggactggtgaagccttcggagactctgtccctcacctgcactgtctctgattgtctccattcggttatttctactggagttggatccggcacgcccccgaggggaggggtactgggagtggaatttgggttatgtctttcgacaagtggtacaactaccgacctaccgaaccccctcctacaagacgtacgagtccaccacactcaggtacacaccgtaccaagaacctagttccncccgtagaacttctcgtaccttcgtgtacgaccgcgtgccggacgaccggccgtactagttactggtgacggagacgtcctgacgcgtaggtgggttcgttacgttacgttgtaccgttacggtcgggaccagggtcctccgtggtacctccgtctctacgcnccctccacgaccgcctactccggttccctcccgcgcctacccgtcctaccagaccnccgtaccgtcggtcgggacctcggacgccggtaccgtcgggtctcggtccgttacggtacgtaacggtaccgttaccgtacggttacgttcggtacgttacggttacggtacggtaccggg

SEQ ID NO: 228966 - DNA, 577 bp, Homo sapiens
  misc_feature: GYAE6OF02IZDCD.33.85.H08.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctctcctgcagggccagtcagagtgttagcgggtacctagcctggtaccagcagacactggccaggcctccaggctcctcatccatggtncactccaccagggccacgtggcactcccgagacctgggttcaggtcggcaggtgggtctgggacagtcttcaattctacacctatcacgcagacgtaggagcgtagaagtatttcgactagttgtattacgtgtacagtcgtagtacggtagttctatccgtaccgtacgttccggaccgaacgggtacgtaacggtaagaaacgtaccgaacgtaacgtaggtaacgtccgtacgacctaccgtacgttcgtcgttacttacctacgttccgtccctacccg

SEQ ID NO: 228967 - DNA, 614 bp, Homo sapiens
  misc_feature: GYAE6OF02IH7AP.33.85.H08.1.454.CMB.1.raw
  modified_base (256)..(256): a, c, t, g, unknown or other
  misc_feature (256)..(256): n is a, c, g, or t
  modified_base (612)..(612): a, c, t, g, unknown or other
  misc_feature (612)..(612): n is a, c, g, or t
tcagtacacacactcacgaccggtgctcgatttagtatcactcagtcgcggggggggagaactgctcagttaggacccagagggaaccatggaagccccagctcagcttctctttcctcctgctactctggctcccgaggggaaagagccaccctctcctgcagggccagtcagagtgttagcgggtacctagcctggtaccaacagagacctggccaggcctccaggcttccctcttctatgatcgcatccaagngggccacgtggcactccagccaggttcgaggtggcggtgggtcgtgggacagtacttcgactctcaccatcagtcacgctagacgtcctagaacgtagttttagacgtttaagtttacttacttcgtacgagtcgaagcgttagactaacgtggttacttagggtaccggtttacggaccggtaaagggaaccgaagggtagaaaactacgaaaacgtacgtggtaggtctacgaccacctagtcgtagttccttacgtactttcccgtccgactacttcgtaggaacgttgtgtacgttacgtaggtacggtccgggtcgtagggaccgtaagggtcgaacgtacgtagcacgtncg

SEQ ID NO: 228968 - DNA, 710 bp, Homo sapiens
  misc_feature: GYAE6OF02GSS9J.33.85.H08.1.454.CMB.1.raw
  modified_base (701)..(701): a, c, t, g, unknown or other
  misc_feature (701)..(701): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggcctcccgaggggaaagagcccaccctctcctgcagggccagtcagagtgttagcggtacctagcctggtaccaagagagacctggccaggcctcccgaggcctcctcttcatgatgacctatcccgaacgacgggacccacgtcggaccacctcccgacgtacccgacggttcgaggtcgggtcggggtggggtccggtggggaacgacgtaccgttccaccgtctccaaccactcagcacgcctaggacgcctagaagttattttcgacgttagtttacttacgtgtacgtagcaacggtctacgtacgtaacgttcggttacgttcgggtaacggtttccgggaccggtaaacgggtaaccgtaagggtaacgtaaacgtaaccgaaaacgtacgtacggtggtacgtagacccgaacgtagttccttaggttaccttaccgtactttcccgttaccccgtaccgttacgttaccggtacgttaacggttagttaccgggtttagtacccggtggtaaccgggtcgggttacgtaccgggtacggtaacggcggtacgtaacggtanagtactgac

SEQ ID NO: 228969 - DNA, 794 bp, Homo sapiens
  misc_feature: GYAE6OF02HY4UD.33.85.H08.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctccagataccaccggagaaattgtgttgacacagtctccggccacctgtctttgctcgagggaaancgccaccctctccgtgcgagggccagtcagtagtgttagcggtactagcctggaccaanagacgacctggaccaggactcccgaggcctctcttctatgatgctataccgaacgacgggcctacgtacggcctaaccgtccccgaggtaccccgtaagggtttaccgaacggggttcgggggtccggggtttagggggttacccggttaggggggaaacctacggttaacccgtttcaaacccgtttcctaaacccgaaccgtaactcgaacggtccgaacggttacccgtaaggaccggtaccgttaaggtaaaggtttacttttttacggaaccgtttaaggtttttaacttaccgttggtaacgaaccggtaacgtaacgggtacggttaacgaccgttaaacggttcgggtttaccgtttaggggtaaccgtttaccggggaaccggtaaaacggggaccgttaaagggttaacgggaaaaacttaaccggtaaaaaccgtacgttacgggtaacggtcgtaacgaccctaacggtacgtttaccgtagttacctttaccgaccgtttaccctaccccggtacctaagttaccgg

SEQ ID NO: 228970 - DNA, 536 bp, Homo sapiens
  misc_feature: GYAE6OF02GWRQG.33.85.H08.1.454.CMB.1.raw
  modified_base (197)..(197): a, c, t, g, unknown or other
  misc_feature (197)..(197): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgctccaggggaaangccaccctctcctgcagggccagtcagagtgttagcgggtacctagcctggaccaacagagacctggccaggctcccaggctcctcttctatgatgcatccaacagggccactggcatcccagccagttcagtggcggtggtctggggacagcttcactctcacatcagcagcctagacgcctgaagtatttgctagtttattactgtcagcagcgtagctaacgtggtcttgggtacgttcggaccgtaagggaccgtaaggtaggaaactacgaaacgacgtggtacggacgtggacctaccagttcgttgtacttcacttcctcccgactacttcg

SEQ ID NO: 228971 - DNA, 633 bp, Homo sapiens
  misc_feature: GYAE6OF02HMLQ5.33.85.H08.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (595)..(595): a, c, t, g, unknown or other
  misc_feature (595)..(595): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangcccaccctctcctgcagggccagtcagagtgttagcggtactagcctggtaccaanagacgacctggcccaggcctcccgaggtctcctcttctatgactgcactcccaacgacgggccagtcggccactcccgagcccgtaggttcaggtgggacgggttggtcgtcgggacaggtccttcactccgtaccaacctatcacggtaccacgccgtacgacgaccgtagaacgttagttttgacttaagtttacgttactgttacagactagtacgttacgactaacgtcgggttcgttcggtacggttccggaccgaaaggggtaaccgaacgggttacggaaacgtacgaaaccgtacgttacgtacggtacgtacggacctacgacttaccgtnttaccgttactacctttccgtacccgtactagttaccg

SEQ ID NO: 228972 - DNA, 663 bp, Homo sapiens
  misc_feature: GYAE6OF02HNQ5Q.33.85.H08.1.454.CMB.1.raw
  modified_base (655)..(655): a, c, t, g, unknown or other
  misc_feature (655)..(655): n is a, c, g, or t
  modified_base (661)..(662): a, c, t, g, unknown or other
  misc_feature (661)..(662): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggcctcccgaggctcctcttctatgatgcatccaacgagggccactggcactcccagccaggttcagtggcggtgggtctgggacagacttcacgtctcaccatcagcagcctagacgtcctgaagtattttgacttagtttattactgtcagtctagtcgtagctaaacgtcggttcgttgggtaccggtttccggaccgtaaaacggggacccgtaaagggttagggtaaaactaaccggtaaaaccggtaacgtggttacgggtccgttcggacctaacctacttaccgttgttcctttacgtacttacccgttccccggtacccttacgttccgttacggtaaaggttcggttacggttacggttaccgttacgggtaaccgggtccggggtcctacggggtaccgaaacgggtccgaacgtacggttaacggntacggnng

SEQ ID NO: 228973 - DNA, 690 bp, Homo sapiens
  misc_feature: GYAE6OF02F60O1.33.85.H08.1.454.CMB.1.raw
  modified_base (207)..(207): a, c, t, g, unknown or other
  misc_feature (207)..(207): n is a, c, g, or t
  modified_base (685)..(685): a, c, t, g, unknown or other
  misc_feature (685)..(685): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacngagacctggccaggcctcccgaggcctcctcttctatgatgcatccaacgagggccatggcactcccagccaggttcaggtggcggtgggtcgtgggacagacttcactctcaccatcagcagcctagacgcctagaagtattttgacttagtttacttacgtgtacacgtcacgtcgttacgccgtaacgtttgggttcgtttacgggtaccgtttccgggacccgtaacggggtaacccgtaaagggttacggaaactaccggaaaaccgtacgttgggtacggacgtacggacctaccgtactcgttcggttaccttaccgtactttccccgttacccgtacccttacgttaccgtacggttaacgtttcgggttacgttacgtttacccgtaggggtaaccggggtccggggttaccggtacgggtaaccggtaacccggggtccggtaaccgtaacggttacgggcttacggntacgg

SEQ ID NO: 228974 - DNA, 698 bp, Homo sapiens
  misc_feature: GYAE6OF02IGVNG.33.85.H08.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
tcagtacacacactcacgaccggtgctcgatttagtatcactcagtcgcgggaggaactgctcagttaggacccagagggaaccagtggaacgccccagctcagcttcgtcttcctcctgctactctggctcccagataccacccggagaattgtgttgacacagtctccggccaccctgtctttgtctccgaggggaancgccaccctctcctgcgaggccagtcagngtgttagcggtactgcctggtaccanganacctggccaggcnccnggcncctctctatgntncnctaccacgacgggccacgtcggacctactcccgacgccgtaggtttacaggttcggggtacggtacggggtaccgtcggggtactacggtaccgtttcaacccgtttccgacctaccgtactacgtacgtccgaacggtccccgtaagtacgtaccgttaggaacgttaacgtttcgacgtttaagttttacttacgttacgttaccgagtaccgtacgtacggtagtaccgagttacgggttccgttacgggttacggtcccgggtaacgaaccggggtaacgtaaacgggtaggtaaaacctaacgtaaacggtacttacggtaggtaccgtacggacgtaccgtaacgttccgttaggttctttaccgtaccgtttacccgtacccggtaccctagttccgg

SEQ ID NO: 228975 - DNA, 631 bp, Homo sapiens
  misc_feature: GYAE6OF02IW9KO.33.85.H08.1.454.CMB.1.raw
  modified_base (202)..(202): a, c, t, g, unknown or other
  misc_feature (202)..(202): n is a, c, g, or t
tcagtacacacactcacgaccggtgctcgatttagtatcactcagtcgcggggaggaactgctcacgttaggacccagagggaacccatggaagccccagctcagcttctcttcctcctgctactctggcctcccagataccaccggagaaattgtgtttgacacagtctccggccaccctttctttgtctccaggggaaanagccaccctctcctgcagggccagtcagagtgttagcgggtacctagcctggtaccaacagacgacctggcccagggcctcccgaggccttcctcttcctatcggatgcatacccaacgcgggccacgtggcacgtccccgagtacccgtaggttccaggtcgggacggttgggtccgtagggactagtacttcactctcactatcgagcagtcctagacgcctagaagtattttcgactagtttatacttgtacagtcagtcgtacactaacgtggtcgttaggtacggttaccggaccgtaagggaccgtaagggtacgtaaacgtacgaaacgttaacgtggtacggacgtacggtaccgacctagtaccgttcggttaccttacgtaccttcccgtttaccccggaccgttacgtccgttaacgg

SEQ ID NO: 228976 - DNA, 723 bp, Homo sapiens
  misc_feature: GYAE6OF02IA321.33.85.H08.1.454.CMB.1.raw
  modified_base (715)..(715): a, c, t, g, unknown or other
  misc_feature (715)..(715): n is a, c, g, or t
  modified_base (718)..(718): a, c, t, g, unknown or other
  misc_feature (718)..(718): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctcccgaggggaaagacgccaccctctcctgcagggccagtcagagtgttagcggtacctagcctggtaccaacagacgaccgtggccagggcctcccgaggcctccgtcttctactgatgaccaactcccaaagacgggcccaacgttcggaccaactcccccgaagcccgaagggtttccaagggtcgggtcgggttacggggttcgtacgggaaccgacggtaccctttaccggaccgttccaccctaaccctagttaccaacggccaacggtccttaaggacgtcccgtaaggaaaccgttagttttcggacttacgttttattacgttcgttcaagtcgtacgtaccggtagccctaaacgtttggttacgttacgggtaccggtttacccgggaccgtaaaacggggacctaagggtagtaaactaaccggaaaccgttaacgtggttaggccgtacgtaccacctattccgtagttccgttacctacttcccgttaccgaccttgttcctagtagttgtcgttacgttacgtcggacggtccgggagttcggaaccgaggtcgacgttaacgtagngtnggtac

SEQ ID NO: 228977 - DNA, 600 bp, Homo sapiens
  misc_feature: GYAE6OF02HKP5T.33.85.H08.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
  modified_base (371)..(371): a, c, t, g, unknown or other
  misc_feature (371)..(371): n is a, c, g, or t
  modified_base (573)..(573): a, c, t, g, unknown or other
  misc_feature (573)..(573): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtagttgacacagtctccggccaccctgtctttgctccgaggggaaancgccaccctctcctgcagggccagtcagngtgttagcggtacctagcctggtaccaangacgacctgcctaggcctccaggcctcctcttcgtatgactgccactaccgaacgtacgggccagtggccaacgtcccgagtcctaggttacaggtcgggcggtggcgtggacngtacttcactctacaccatcagccacgtcctaagacgaccgtagtaacgtacgtttacgtcttaagtttacttacgtcgtacgtagtacgtagtacgtacgcgtaacgtgttacgtggtaccgttcggacgtaacgggtaccgtaaggtacgtaaacgtacgaaacgtacgtaggtcgtacgtacgacgtacctactcgttntcgtactccgtcctccgtactcgtacg

SEQ ID NO: 228978 - DNA, 714 bp, Homo sapiens
  misc_feature: GYAE6OF02HYQPI.33.85.H08.1.454.CMB.1.raw
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
  modified_base (396)..(396): a, c, t, g, unknown or other
  misc_feature (396)..(396): n is a, c, g, or t
  modified_base (691)..(691): a, c, t, g, unknown or other
  misc_feature (691)..(691): n is a, c, g, or t
  modified_base (709)..(709): a, c, t, g, unknown or other
  misc_feature (709)..(709): n is a, c, g, or t
  modified_base (713)..(713): a, c, t, g, unknown or other
  misc_feature (713)..(713): n is a, c, g, or t
tcagtacacacactcacgaccggtgctcgatttagtatcactcagtcggcggggggggagggaacgtgctcagttaggacccagagggaaccatggaagcccagctcagccttctcttcctcctgctactctggctccaggggaagagccaccctcctcctgcgaggccagtcagagtgttaggcggtacctagcctggaccaanagacgaccgtggccaggcctccgaggctcctcttctagtnatgcatccaaacgcggggtacccacgtcggacaactccccagacccgtaggtactacggtgggccgggttgggtcgtggggaactaggaccttactacctctaccaccactacacgcgaacggcctaagacgcccgtagaacgtagttttnacgtacggtacttacgttactgtacctagactagcgtaagacctaagttcggtacgttggtaccggttcgggaaccgaaacgggaacccgtaaagggtaacggaaaacgttacgaaaaccggtaacgtacgggttcgaatcggaacccgtaccgtaacttcgttacggttcccttactaaaccgtttcccgtccccgtaacccttcgtacgtttaaacggaacgttggttaaccggttgttaaccggttggtaccggtcgggggttccgtagggtaacccggacggggtaacccnccgggttaaagaaccggngtang

SEQ ID NO: 228979 - DNA, 687 bp, Homo sapiens
  misc_feature: GYAE6OF02FGZYP.33.85.H08.1.454.CMB.1.raw
  modified_base (676)..(676): a, c, t, g, unknown or other
  misc_feature (676)..(676): n is a, c, g, or t
tcagtacacacactcacgaccggtgctcgatttagtatcactcagtcgcggggggggagaactgctcagttaggacccagagggaaccatggaagccccagctcagcttctcttcctcctgctactctggctcccaggggaagagccacctctcctgccagggccagtcagagtgttagcgggtacctagcctggtaaccaacagacgacctgggccaggcctcccgaggccttcctcttctatcgatcgcatcccaaccgagggtccacgtggccactcccagccaggttcagtggcggtgggtctggacagacttcactctcaccatcagcagtcctagacgcctaggtaagtcttttggactagtttactactgtcagtcgaagtcgtaacgccttaacgttcggttaccgtttacgggtaccggttcggtacccggaaacggggtaacccgtaaagggttaacggtaaaacgttaccgaaaaccggtacgttacgggtacggtaccttacggaacctaacctacttaccgttacggtttaccctaccgttaacgtttccccgtttaccccgaacgttacgtacttacgggttaaacgttcgttacgggttacgtaaccgtgggtaaccggccggggtacctacggaccgtaaagggtcccgaagaccgttancggtactacgc

SEQ ID NO: 228980 - DNA, 531 bp, Homo sapiens
  misc_feature: GYAE6OF02G0DTH.33.85.H08.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
  modified_base (505)..(505): a, c, t, g, unknown or other
  misc_feature (505)..(505): n is a, c, g, or t
  modified_base (525)..(525): a, c, t, g, unknown or other
  misc_feature (525)..(525): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaangccaccctntcctgcagggccagtcagagtgttagcgggtacctagcctggtaccaacagagacctggccaggctcccaggcctcctcttctatgatgcatccaacngggccactggcactcccagcccaggttcaggtggcggtgggtctggggacagacttcactctcaccatcagcagcctagacgcctgaagtnttttgcttagtttattacgtgtcagcagcgtagactactggtcgttggacgttcggaccgaagggactaaggtacggaaatacgaaacgtacgtagtaggctgacaccnttctgtcttcacttcctccnctatcg

SEQ ID NO: 228981 - DNA, 756 bp, Homo sapiens
  misc_feature: GYAE6OF02H956R.33.85.H08.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctcgagggaangccaccctctctgcgaggccagtcagacgtgttagcgggtactagcctggtaccaanagagacctggccaggctacccgaggctcctcttcatgatcgctactaccaacgtcggccacgtggacctacgtcccgaggaccctagggttccaagggtccggggtaccgggttgggggttacctcggggggtaacctaacgggtacctttaccgacccgtttacgacccgaacccgtagttcgaaaccggcccgtaagtccccgtaagtaacggtccgtaacggtaaagtttacggttttacgtacgtttaaacggtttttaactttaaccgtttacggtaccgtaacggtaccgtacgggttaccggttaacgtaccgttaaccggtcggttttcggtttaaccggggttaccggtttaccggaacccgggtaacgggtaacccggtaacgggtaaggtaaaacgttaccgtaaaacggtaccgttagtcgggtactacggacctaacgtacgttaccttgttacccttcgtaacctttcccgtacccgtacctcgttacg

SEQ ID NO: 228982 - DNA, 710 bp, Homo sapiens
  misc_feature: GYAE6OF02G2XQ6.33.85.H08.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
tcagtacacacactcacgaccggtgctcgatttagtatcactcagtcgcggggagaactgctcagttaggacccagagggaaccatggaagccccagctcagcttctcttcctcctgctactctggctcccagactaccaccggagaaattgtgttgacacagtctccggccacctgtctttgctcaggggaangccaccctctcctgcagggccagtcagagtgttagcggtacctagcctggtaccaanagacgacctggccaggcctccgaggcctcctcttctatgatcgactataccaacgacgggcccaacggtcggacctacgtcccacgtaccgtaggttcagggtcgggtacgggttggggttccgtaggggaactaggtacctttccgaacttccgtaccaaccgtattaccgaacggccaacgtcccttaacggacgtacccgttaaggtaaacgttagtttttcgaccgttttaagttttaactttacgtacgttacgagtaccgtaggtacgtacgaacgttaccggttcggttacgtttacgggtaccggttaccgggacccggtaaacgggtaaccgtaaggggtaacggtaaactaaccggaaaccgtaggttggtacggtaccgtcgaacccgtactacgttccgttacgttacctttacctccgttaccccgttacccgtacttactaccgg

SEQ ID NO: 228983 - DNA, 641 bp, Homo sapiens
  misc_feature: GYAE6OF02HB804.33.85.H08.1.454.CMB.1.raw
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
tcagtacacacactcacgaccggtgctcgatttagtatcactcagtcgcgggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagaaacctggccaggctcccaggctcctcatccagaatgcattcaacacgggccactggcatcccagccaggttcagtgcagtggtctgggacagcttcncnctcaccntccancagcctagngaccctggacggtattcgngtactaggtttattcgtgtacctagctaggtcgttctaccgaacgtcggtaccctccggtcggaccctaccggtttcggacccgtaaacggggacctacggtaagttgggaagttacgttaacgggacgtaacttggtacggtactcggtaccgtacccgttcgttcgttacctttctaccgtttccgttccccctacgtcgttccgttagtaacggtttggttcggttacggttacgtagggtaccggtccgggtacgtccgggtacggaaccgggtccggtacgtagtacgg

SEQ ID NO: 228984 - DNA, 1033 bp, Homo sapiens
  misc_feature: GYAE6OF02HGAB7.33.85.H08.1.454.CMB.1.raw
  modified_base (147)..(147): a, c, t, g, unknown or other
  misc_feature (147)..(147): n is a, c, g, or t
tcagtacacacactcacgaccggtgctcgatttagtatcactcagtcgcggtgggggaggaactgctcagttaggacccagagggaaccatggaagccccagctcagcttctcttcctcctgctactctggctcccaaggggaaagngccaccctctcctgcgagggccagtcagagtgttagcgggtacctagcctggtaaccaacagacgacctgggccaggcctacccgaggcctccttcttctatgatcgcactacccgaaacgacgggcccaacgttcggaccaaccttcccccgaacggtaccccgtaacgggtttccgaacgggttcgggggtaccggggttcgggggttccggtacgggggaaccgtaacgggtaacccttttaccgaccgttaccccttaccgaaccccgtaacttacccgaacggaccgtaaccgtaccccgttaaggaccgtacccgttaaggtaaaacggtttacgttttttacggaccgttaaggtttacggtttaaacttttaaccgttaggttaaccgtaacggtaaccgttaaacggggtttaaccggggttttaacgttttacccgttaacgtttccccggttacccgggttaaccgggttttacccgggaaacccgggtaaaacgggggtaaacccggtaaagggggttaaaccggtaaaaaccggttaacccgtaaaaaaccgggtaacggtttacgggttaccgggtaaccggttacggtaacccgtaaacccgttaacggtttacccgttacggttttacccgtttaacccgtttaccgttttacccccggttttacccccggtaaccctttaaacggtttacccgttaaacggggttaaccgtttttacggggttaccgggttttaaccggtttaaacccgggttcggggtaacccggggggttacccggggggttaacccgggttaccggggggtaaaccccgggtttaacgggggcccccggtaacggttaaacggtacgggttagacccgttaaccgg

SEQ ID NO: 228985 - DNA, 733 bp, Homo sapiens
  misc_feature: GYAE6OF02HT4JN.33.85.H08.1.454.CMB.1.raw
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
tcagtacacacactcacgaccggtgctcgatttagtatcactcagtcgcggggaggaactgctcagttaggacccagagggaaccatggaagccccagctcagcttctcttcctcctgctactctggcctccagactaccaccggagaagttgtgttgacgcagtctccaggcacctgtctttgtctcgagggaancnccacctcnctgcaggccaatcagacgtgtagactaagtaacttagtctacggtaaccaaacatacgtacctaggaaccaggtcctaccgaacggtccttaccctactacttacctacgtacgtacgacccgtaaccaaacggcgggaccctacgtcggaccactaccccgagtaccgtagggttccaaggtcgggtcggggttacggcggttaagggacaacggttacttacgtactttccacaaccgtatacggacgtaagccggtacgggtacgtaccgtaagtaaacgttacgttttacggacttaacggttacttaacttaacgtcggtaaccagtaaacgttaggtaacgttaagggtacgggtaacggtaccggttaccgggaacggtaaacgggaaccgtaaagggtaacggtaaaactaaccggaaaacgtaacggtcggtaacggtcgtaacgaccgtaacctaagttcgttaccgttaccgttactaccgttacccgtacccactaaccgtccgttaagtaacgg

SEQ ID NO: 228986 - DNA, 535 bp, Homo sapiens
  misc_feature: GYAE6OF02FXHAZ.33.85.H08.1.454.CMB.1.raw
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (510)..(510): a, c, t, g, unknown or other
  misc_feature (510)..(510): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (534)..(535): a, c, t, g, unknown or other
  misc_feature (534)..(535): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacgagggccactggcactcccagccaggttcaggtggcggtgggtctgggacagacttcactctccaccatcagcagcctagagcctgaagtatttgctagtttattactgtcagcagcgtagactacgtgtcgttggtacgtttcggaccgaacgggaccgtaaggtaggaaataccgaaacgaacgtggtagcgtgcaaccntctgtctacntccttccgctactctagtagtgtagtcgtacgtggacggtccgggtntcggacgaggcgacgtagngntcnn

SEQ ID NO: 228987 - DNA, 623 bp, Homo sapiens
  misc_feature: GYAE6OF02GVG14.33.85.H08.1.454.CMB.1.raw
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
tcagtacacacactcacgaccggtgctcgatttagtatcactcagtcgcgggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccagttcagtggcggtggtctggacagcttcactctcaccatcagcacgcctagacgcctagaagttatttgcttaagtttacttactgtactagcagtcgtagctaacgttggttcgttggtaccgttcggaccgaagggtacccgaagggtaggaaactacgaaaacgacgttaggtggaccgttcgacctaaccgtattccttcgttaccttaccgtactttcccgttaccccgtaccttaccgttacgttacggtaaagttcggttacggttacgtttaacgtcgggtacgggaccgggttccggtagggaaccggtacgggacgtaccggtagtacgggtntgagng

SEQ ID NO: 228988 - DNA, 431 bp, Homo sapiens
  misc_feature: GYAE6OF02H3B56.33.85.H08.1.454.CMB.1.raw
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (346)..(346): a, c, t, g, unknown or other
  misc_feature (346)..(346): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (407)..(431): a, c, t, g, unknown or other
  misc_feature (407)..(431): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggcctcccaggggaaagacgccaccctctcctgcgagggccagtcagagtgttagcgggtacctagcctggtaccaacngagacctggccaggcctcccaggcctctcttactatgatgcatccaaancgggccatggcactcccagccaaggttcaggtggcggtgggtctaggggacagtacttcaacgttcctcaccatcagctagcctagancctagaagcttttgacttagtttattaccgngttcaancgtaatcgtaacactacggttannnnnnnnnnnnnnnnnnnnnnnnn

SEQ ID NO: 228989 - DNA, 571 bp, Homo sapiens
  misc_feature: GYAE6OF02HSO88.33.85.H08.1.454.CMB.1.raw
  modified_base (338)..(338): a, c, t, g, unknown or other
  misc_feature (338)..(338): n is a, c, g, or t
  modified_base (568)..(568): a, c, t, g, unknown or other
  misc_feature (568)..(568): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctccaggggaaagagccaccctctcctgcagggccagtcagagtgttagcgggtacctagcctggtaccaacagagacctggccaggctcccaggctcctcttctatgatgcatccaccagggccatggcatcccagccaggttcagtggcagtgggtctgggacagacttcactctcaccatcagcacgcctagagcctagaagtnttttcgctagttttactactgtctgtcagcgtagactacgtcggtacctaacaccgttcggaccgaacgggacaacgtacgtgggaagtacttaaaacggacgttgtaggtactggaccaaccgtattcttgttaccttactacttcccttcccgcctattccgtagtaacgttgttacgtcgtacgtcggacggccgggtgtacggcgtaacgggccgacgtagtacgntcg

SEQ ID NO: 228990 - DNA, 695 bp, Homo sapiens
  misc_feature: GYAE6OF02FGJR9.33.85.H08.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtcttgctccaggggaaangcccaccctntcctgcagggccagtccagagtgttagccgggtacctagccttggtaccaacgngacgacctggccaggctcccaggcctcctcttctatgatgctactaccaacacgggtccacgtggacacgtcccgagcctaggttcgaggttcggcgggttgggtctaggggacagtacctttcacttcctaccacctatcagtccacgtccctaagacgtcctagtaacgtattttcgactagttttaacttacgtcgtactacgctacggtcgtaacgtactaaaccgttgggttaccgtttacgggaccggtttaccgggaccgaaacggggtaacccgtaaaggggtaaccgtaaaacgttaccgaaaaccggtacgttacgggtacggtaccgttaacggacccgtaacccttacggttaccgttacggtttacccgtttacccgtaacccgtttccccgtttacccccggtacccttacgtttacccgg

SEQ ID NO: 228991 - DNA, 864 bp, Homo sapiens
  misc_feature: GYAE6OF02I0WQT.33.85.H08.1.454.CMB.1.raw
  modified_base (210)..(210): a, c, t, g, unknown or other
  misc_feature (210)..(210): n is a, c, g, or t
  modified_base (817)..(817): a, c, t, g, unknown or other
  misc_feature (817)..(817): n is a, c, g, or t
tcagtacacacactcacgaccggtgctcgatttagtatcactcagtcgcgggggggagaactgctcagttaggacccagagggaaccatggaacgccccagctcagcttctcttcctcctgctactctggctccagactaccgaccgggaattgtgttgacacagtcctccacgcccacccttgttctttgtccgtccgaagggggaaancgccccacccgttctacccgtcggacgaacgggccctagtccgagacgttcgctgggacctacgaccgtaaccgtttcggacccgttagggtaacccaacgtaacgttaaccgaaccccttcgaaccccgtacggtccctaccccggacgggtacccttcccgtacaccgttacgtaaccgtagtaccggtaccgtaccgaaaccggtacgggaccctaacggtcggacctacccgtaccccacggtacccgtacggtaccagggttaccgcgttacgggttcggggttaccggacgggtaaccgtaacgttacctttaccgaaccgtttcccgaccctaaaccggactttacccggaagtaacccctaaacggttaaccgtaaccgttacgttaaacgttttacgtttttaaccttaacgtttttaaccgttaacgtttacgtaacccttaaccgttaacgttcccggaaccggtacgtaccgtaccgtaccggtccttacgttaccgtttccggtttaccggcgggtaacggtaaccgtagggtaccgacgtaccgtaaacgtaccgtacggttacggcggtaccgtaccggacttaacccggtntttaccgttacggtttccctaaggtcccgttacccgttccggtaacc

SEQ ID NO: 228992 - DNA, 708 bp, Homo sapiens
  misc_feature: GYAE6OF02HWAY1.33.85.H08.1.454.CMB.1.raw
tcagtacacacactcacgaccggtgctcgatttagtatcactcagtcgcggggaggaactgctcagttaggacccagagggaaccatggaagcccagctcagcttctcttcctcctgctactctggctccagataccaccggagaaattgtgttgacacagtctccggccaccctgtctttgtctcgaggggaaagcgcctaccctctccgtgcgagggccagtcagtgttgttaggcggtactacgcctggtaccaagagaggaccgtggccgaggcctccgacggtctccgtctctatcgatcgacactaccaacgcggcacgtcggcactcccgagccaggttcgaggtcggcgggtggtcgtgggactcgaccgttctaactcgtacacctactacgtacgcgaacgtccgtaacggacgtaccggtagtaaacgtttgtttacggtacgtttaagttttacgttaacgttcgttaactagtacgttaggtacgtacgtacgtaacgttcgggtttacggttacggttaccggttaccgggtaccgtaaacgggtaccggttaaacggttaacgggaaacgtaaccgtaaacggtaaccgttaggtacgtacggtacgtacccgttaaacctcgtttaacccgttgttaacccgtttaccgttaccgtttacccccggtacccgttaccgttaccggttaaccg

SEQ ID NO: 228993 - DNA, 657 bp, Homo sapiens
  misc_feature: GYAE6OF02IJU3J.33.85.H08.1.454.CMB.1.raw
  modified_base (201)..(201): a, c, t, g, unknown or other
  misc_feature (201)..(201): n is a, c, g, or t
  modified_base (651)..(651): a, c, t, g, unknown or other
  misc_feature (651)..(651): n is a, c, g, or t
tcagtacacacactcacgaccggtgctcgatttagtatcactcagtcgcggggggggagaactgctcagttaggacccagagggaaccatggaagccccagctcagcttctcttcctcctgctactctggctcccgaggggaaagagccaccctctcctgcagggccagtcagagtgttagcggtactagcctggtaccanagagacctggccaggcctcccaggcttccctcttctatgatcgaccattcccgaaagcgggcccagtggccatccccagccgaggttcaggtggcggtgggtctgggactagacttcgactcctcacctatcacgcacgcctagacgcctaggaattagtttgactttagtttacttacgtgtctagctagtacgtacgacctacgtcgttacgttacggtaccggttacggaccgtaaacgggtaaccgtaagggttaagggaaacctaccgaaaacggtacgttacggtagtccgtacggaccaccgttacgtcttacgtttccttacgttaccttttacccgttaccggtaccctacgttacgttacggttacgttacgtggttacgtacggttaggtacgggtccgggtagtccgggtacgtaacgggccgtaggtaacgtcgtanctgacg

SEQ ID NO: 228994 - DNA, 1138 bp, Homo sapiens
  misc_feature: GYAE6OF02HG7HT.33.85.H08.1.454.CMB.1.raw
  modified_base (149)..(149): a, c, t, g, unknown or other
  misc_feature (149)..(149): n is a, c, g, or t
  modified_base (322)..(322): a, c, t, g, unknown or other
  misc_feature (322)..(322): n is a, c, g, or t
tcagtacacacactcacgaccggtgctcgatttagtatcactcagtcgcggggaggaacgtgctcagttaggacccagagggaaccatggaagccccagctcagcttctcttcctcctgcctactctggctcccagatacccaccgganaaattgtgttgacacacgtcctccggccacccgtgttcctttgtcctacccgaagggggaaactcgaccctaccccttcgtcccgtaggccgaacggggcccaaggtccaaggtacgttcggttaacggcccggggttaacccttaggccccgttagggtaaaccctaaacgngggtaaccgtacccgtacggacccgtaacggggtcccttacccccggtacgggttcccttccccggttactttaccgttaacgtacggtaacgttccggtacctaaccgtttaaccccgaaaccggtaccgggggtacccctaaccggtttacgggaacccttaaccgttaccccccggaaacggtaccccggtttaaacggggttttccccgtaaaaccgggggtttccgggggggttaacccgggggttttccgggggttaccccgggtttaacgggggggtaaccccgttaaacggggtttaacccccctttttacccggtaaacccccgttttacccggttaacccccgtaaaacccctttaaccggtttacccggtaaaccgggaacccccgtaaaccgggtccccgtttaaaacgggaaccccgggttacccgttaaacggggttaaaaccgttttacggttttttaacccgggtaaccggttttaaaccggtttttaaccggtttaaccggtttaaccggttaccgggtaaaccggttaccgggttaacccggttaacgggtttaaccggtaaaccgtttaaccgggtttacgggtttaccggttttaccgggggtaacccggtttacccggggaccgggtaaaaccgggggtaacccggtaaacggggttaaccgggtaaaacctaccgggtaaaacggttaccggttacgggttaccgggtaccgtaacggaaccctaacggtaccgttacgttaccgttcgtaccgttaccgttaccccgtaccccgtaccggtacgttaacccgg

SEQ ID NO: 228995 - DNA, 680 bp, Homo sapiens
  misc_feature: GYAE6OF02GHXOW.33.85.H08.1.454.CMB.1.raw
  modified_base (203)..(203): a, c, t, g, unknown or other
  misc_feature (203)..(203): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctctcctgcagggccagtcagagtgctggcagcaacttgcctaggtaccaaacaaaacctggaccagacctcccaggcctcctcactccatggtgcactccaccgacgggcccacgtcggccactccccaagacgtacggttcaggtcggacgtaggtcgggtcgtagggacaggtacttctacttcctaccacctatcgagacgagaccgtagggacgtaccgtaaggtaagttacttttcggaccgttaggttacggttaactttaaccgttggttacctaaggtcgtaacgggtcgttaacgaccgttaaccggttgggtttaccgttacgggtaccggtttaccgggaccggtaaacgggaccgtaaagggtacgtaaacgtaccgtaaacggtacggtggtacggacgttacggacctaccgtacgttccgttacgttaccttaccttaccgttcccgttaccccg

SEQ ID NO: 228996 - DNA, 677 bp, Homo sapiens
  misc_feature: GYAE6OF02FQ5VE.33.85.H08.1.454.CMB.1.raw
  modified_base (335)..(335): a, c, t, g, unknown or other
  misc_feature (335)..(335): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcggtacctagcctggtaccaacagagacctggccaggctcccaggcctcctcactctatgatcgcactcccaccgacggggcccacgtcggcactccccgacgcctaggttcaggtggcgtaggttgggtcgtgggacagtaccttcaccttcnccaaccatcgacgcacgtccgtaagacgtccgtagaagtgttttgcttagttttacttacgttgtctgacgtaggtcggtagaccgtaacgtccgtaaccctaaaccgtccgttaccgggaccgtaaacggggaccgtaaccggaacggtacgggaaacgttaaacgtttaaaacccggattcgggtacggtaccgtacgtaccaccgttaactccgtttcgtacctttacctaccgtttccctacccgtaccttacgttccgtagtaggttcgttaggttacgtaccggtacggacgggttcccgggtacgtacgggacgtaagggccgtacgtagtagcg

SEQ ID NO: 228997 - DNA, 779 bp, Homo sapiens
  misc_feature: GYAE6OF02GSLTH.33.85.H08.1.454.CMB.1.raw
  modified_base (569)..(569): a, c, t, g, unknown or other
  misc_feature (569)..(569): n is a, c, g, or t
tcagtacacacactcacgaccggtgctcgatttagtatcactcagtcgcggggggggagggaacgtgctcagttaggacccagagggaaccatggaagccccagctcagcttctcttcctcctgctactctggcctcccagactaccgaccggggtaaattgtgttagacacacgtctccacgccctacccttgtccttttgtcctccggaagggaaagacgcccacccttctccgtgcgacggccagtcagagtgctaggcacgacgtaacttggcctacggtaaaccaaaacaaaacccgtggacccaagtaccctaccggacgtccgttaccctctactacctatggtactagcctacctcccgaacgccggtaccctacgtggacccacctaccccgagtcccgtaacggtcgagggtcggtaccggtaggtcgggttcggaagggaccgtacgttacctacgacctttcgaaccctaaccgacgtcgaaccggtactaccgacgttaaccggacgttaccggagtaggttacctcgttcgtaacgtttagttttaaccgttcgngttaccgaacgtgtaaccgtcctacgtaccgggttaccttccggttacccgtcccgtaaccggtacccgttacccggacccgggttaaacccgagggttaacccgtaggtacggttaaccggtaaataccggtttaaccgtaacgggaaccgtttacgtacgggttaccttacccggtaccccggtccgtttttaccgtaccggtttccc

SEQ ID NO: 228998 - DNA, 583 bp, Homo sapiens
  misc_feature: GYAE6OF02FU1BY.33.85.H08.1.454.CMB.1.raw
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaagagccaccctctcctgcagggccagtcagagtgttagcgggtacctagcctggtaccaacagacgacctggccaggctcccaggctcctcttctatgatgcatccaacagggccactggcactccagccaggttcagtggcggtggtctggacagacttcactctcaccatcagcacgcctagacgtcctagagtattttgcttagtttattacgtgtacagtacagtcgtagctaacgtggtcttggtacgttcggaccgaagggacgtaaggtaggaaatacgaaacgtacgtaggtcgcgtcgacacctatctcgttccttacacgttcccttccccgtacctacgttcctaggttaacgttgttaggttacgttacgtacggtacgggccgggtacgtcgggaccgaacgggccggtacgtaggtacgntagntcg

SEQ ID NO: 228999 - DNA, 837 bp, Homo sapiens
  misc_feature: GYAE6OF02GCWU5.33.85.H08.1.454.CMB.1.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
tcagtacacacactcacgaccggtgctcgatttagtatcactcagtcgcgggggggggaggaactgctcagttaggacccagagggaaccatggaagccccagctcagcttctcttcctcctgctactctggcctccgaggggaaagacgcccacctctcctgacagggccagtcagactgtagcagcgtcttcttagccgtggtaccagcagacaccgtggaccaggcctccgagctccncatccagtggtcncactcccaccgacggaccacgtcggacaccgtacccgacgtactaggttcgaggtagacgtagggttcgggtacggtacgggactagtaccttactacgttcaccacctataccgagtacagtacggtggtaacgacttacggtaagtttacgttttacgtacgtttaaagtttttacttaacgttgttaccgtaaggtacgtacggttacgtacggtaccgtaacggtttcgggttacgtttaccggggttaaccgggttacccgggaaacggggtaaacggggttaaacccggtaaaggggttaaccgtaaaacggtaacccgttaaaacggtaacggttacgggtacgtaccggtacgtacccgtaacgtaccggtttaccgttgtttaaccccgtttaccgtttacccggttaccccgtttacccggtacctttaacccggttaccggtttaccggtaagggtttttacccgggttcggtttaacggggttaccggttaacggggtccgggggttaccggggttacccggggttaaacccggggtaccggggtaaccggggttaccccgtaagggtaac

SEQ ID NO: 229000 - DNA, 670 bp, Homo sapiens
  misc_feature: GYAE6OF02FURF7.33.85.H08.1.454.CMB.1.raw
  modified_base (529)..(529): a, c, t, g, unknown or other
  misc_feature (529)..(529): n is a, c, g, or t
  modified_base (662)..(662): a, c, t, g, unknown or other
  misc_feature (662)..(662): n is a, c, g, or t
tcagtacacacactcacgaccggtgctcgatttagtatcactcagtcggcggggggggagaactgctcagttacggacccagacgggaaccagtggaacgccccagctcagcttctcttcctcctgctactctcggcctcccgaaggggaaacgagcccaaccctctcctgccagggccagtcacgagtgttacgccgggtacctagcctggtaccaacgagacgacctggtcacggcctcccgagggcctcctcttcgtatggatcgcactaccgaacgcgggccacgtcggacacgtcccagtccgtaggttccaggtcgggcgggttgggtctacgggactacgtacttcactcctcacctagtcacggtccacggtccgtacgtacggtcctaggtaaattacgttttcggactttacggtttactcgtcgtacagtcgagtcgtacgctaacttgggtaccgtggacgttcgacggtaacgggacgtaaggacggaaactacgtaacgtacgtggtcgtccgtnacctacgtatcgttacgtccttacgtccttacccgtaccgtcctacgttccgacggttaacgttcggttacgtacggtacctgggtaccggtccgggtacgtacggtaccggtaagggcctacgtacgtacgntctagtcg

SEQ ID NO: 229001 - DNA, 579 bp, Homo sapiens
  misc_feature: GYAE6OF02GVHEK.33.85.H08.1.454.CMB.1.raw
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
tcagtacacacactcacgaccggtgctcgatttagtatcactcagtcgcgggggggggaggaactgctcagttaggacccagagggaaccatggaagccccagctcagcttctcttcctcctgctactctggctccgaggggaaagagccaccctctcctgcagggccagtcagagtgctggcagcaacttagccttaggtaaccaaacaaaaaccgtcggaccacgacctcccaggcctcctcatcctatgatgctactccacgacgggccacgtcggcactaccgacgccgtaggttcaggtggactaggtgggtcgnggggacagtacttcactcctacacatcagcagcctagcgtacctagaagtntttcgattagtttattactgtactgcgagtcgtagctacgtcgactactccgtacggaccgaaggacaggtacgtaggacgtaagtaacgagtcgtacgtctagactactagtcgtgttcttacgcttccgttaccgtctactacgtagtacgttacgtggttacgtacgcggtaggtcggtacgtcggacggtacggcgtatgtacg

SEQ ID NO: 229002 - DNA, 737 bp, Homo sapiens
  misc_feature: GYAE6OF02IYRE3.33.85.H08.1.454.CMB.1.raw
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggcctcccgaaggggaaagacgcccaccctctcctgccgagggccagtcagaggtgttagcgggtacctgcctaggtaccaanagacgacctggccaggcctccgaggctcctcttctatgatcncaccacgaggcgacnggcactccnccgacgtcgtacgtcgagggtcggtcgggtcgtcggcggagtacgttactccgtaccgttcctaccaccttacgacgacgacgtacgacgtacgaccgtctaaggttacgttacttcggtaagttttacgttaacgtttacgtcgtacggtacgtactacggtacgtaaccgaacgttacgggtttccgtttcggggtaaccgttccggggtaacccggaaccgggtaaacgggtaaccgggtaagggtaaacggaaacgtaaaccggtaaacggtcgggtaacggttcggtacgtaccgtaccgaacgttacgttacgtttacgtaccgttacctaccgttaccccgttacccgtaccgttacttacggtaacggtaccgttaggttacgtacgttacggtacgggtccggtccgggtcggtacggacggttacggactacggtcgtagtcggatgc

SEQ ID NO: 229003 - DNA, 674 bp, Homo sapiens
  misc_feature: GYAE6OF02GFN3Q.33.85.H08.1.454.CMB.1.raw
  modified_base (144)..(144): a, c, t, g, unknown or other
  misc_feature (144)..(144): n is a, c, g, or t
  modified_base (172)..(172): a, c, t, g, unknown or other
  misc_feature (172)..(172): n is a, c, g, or t
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
tcagtacacacactcacgaccggtgctcgatttagtatcactcagtcgcggggggggagaactgctcagttaggacccagagggaaccatggaagccccagctcagcttctcttcctcctgctactctggctcccaggggaaangccaccctctcctgcagggccagtcagngtgttagcggtaccagcctggaccaangagacctggccaggcctccgaggtcctcctcttcatgatgcatccaacgnggccagtggcactcccagccgtaggttcaggtcggcgggttagggtccgtggggactacggtactttcgacttcgtaccaccatccacgcaacgtccgtaagacgtccgtagtaaagttcttttacgactttaagtttacttacgtgtcaggtcaagtcgtagacctaacgtggttcgttacgggtacgttaccggaccggaaacgggtaccgtaaagggtacggaaacttaacggaaaaccgtacggttgtacggtctacgaccgtaacctcgtccgttacgtaccttccgtaaccttcccgttcccctaaccgttagttaccgtagttaacggtcgttaacggttcgttacggttacggccgggtaccgggttcgaaccgggttacgtacgggtaccgtaacggtaagtacggcgtcacgtcc

SEQ ID NO: 229004 - DNA, 576 bp, Homo sapiens
  misc_feature: GYAE6OF02F9UT0.33.85.H08.1.454.CMB.1.raw
  modified_base (208)..(208): a, c, t, g, unknown or other
  misc_feature (208)..(208): n is a, c, g, or t
  modified_base (571)..(571): a, c, t, g, unknown or other
  misc_feature (571)..(571): n is a, c, g, or t
  modified_base (575)..(576): a, c, t, g, unknown or other
  misc_feature (575)..(576): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacaganacctggccaggctcccaggctcctcttctatgatgcatccaacgagggccacgtggcatcccagccaggttcagtggcggtgggtctgggacagacttcactctcaccatcagcacgcctagagcctagaagtacttttgactagttttattactgtacagacagcgtacgactaacgtggttccgttgggtaccgttcggaccgaacgggaacctaagggtaggaaactacgaaaccgtacgtaggttcggctacggaccaccgtatacgttcgttcttactacttcccgttcccgtcctatctagtaatgttgtacgtacgtaggcggtcggcggtaggacgtaacggcgtacgagtacgntagnn

SEQ ID NO: 229005 - DNA, 672 bp, Homo sapiens
  misc_feature: GYAE6OF02JF5JZ.33.85.H08.1.454.CMB.1.raw
  modified_base (544)..(544): a, c, t, g, unknown or other
  misc_feature (544)..(544): n is a, c, g, or t
  modified_base (666)..(666): a, c, t, g, unknown or other
  misc_feature (666)..(666): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaagggaaagacgcccaccctctccgtgcgagggccagtcagagtgttagcggtactagcctggtaaccaacagagaccgtggccaggcctcccgaggtcctccttcttctatgatcgacaactaccaacgaggccacgtggcactcccagccaggttcaggtggcggtgggtcgtagggactagtaacttcacttctaccaccatcagcacgcctagacgtcctagaacgttatttcgacgtaaggttgttaaactttacgtcgtactaacgacgtaaacggttaacggttagttacctacttccgtacccggtaccggtttcggaaccggtaaacgggaaccggtaaagggtaaggtaaaactaaccgaaaacgtaaccgtaggttacggacgtacgacctaaccnttaccggttacttcgttaccactttcccgttacccgaccgttaactccgtaaagttagttaggttcgtagttacgacggtaagggccgggtacgttaggaccaagggtccgtacgagttagngatcga

SEQ ID NO: 229006 - DNA, 731 bp, Homo sapiens
  misc_feature: GYAE6OF02HED2A.33.85.H08.1.454.CMB.1.raw
  modified_base (209)..(209): a, c, t, g, unknown or other
  misc_feature (209)..(209): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggcctccgaaggggaaagacgcccaccctctcctgcagggccagtcagagtgttagcgggtacctagcctggtaaccaanagagacctggaccaggcctcccgaggtcctcctcttctatgatcgccataccaacgcggccagtcggcactcccacgcctaggttcaggtgggcgggtggtcgtagggacagtacttcgactctaccaccatcagccagcctagactccgtagagttagttttgactttagtttacttacgtcgtacgtacgcgtaagtccggtagaccgtaaacggtttcgggtttaccgttacgggtaccgggtttacccgggtaccgggtaaagggtaacccggtaaagggttaaccgggtaaaacgttaacggtaaaaaccgtaacgttcgggtacggtaccgtacggtaccctaaccgtactttaccgttacgttaccctttcctaacgttttcccctacccggttaccctaacgtttccgtaaaggttacgggttacgtttcggttacgtttaacgtcggggtacggtaccgggggtactacggggtaaccgaacgggtccgaacggttagtacggactgactacg

SEQ ID NO: 229007 - DNA, 689 bp, Homo sapiens
  misc_feature: GYAE6OF02IP6PC.33.85.H08.1.454.CMB.1.raw
  modified_base (213)..(213): a, c, t, g, unknown or other
  misc_feature (213)..(213): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (682)..(682): a, c, t, g, unknown or other
  misc_feature (682)..(682): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagtacacacactcacgaccggtgctcgatttagtatcactcagtcgcggggggggaggaactgctcagttaggacccagagggaccatggaagccccagctcagcttctcttccctcctgctactctggcctcccgaggggaaagacgcccaccctctcctgcgagggccaggtcagagttgttagcgggtacctagcctaggtaccaagngagacctggcccaggcctacccgagcctcctnttcatgatgcatcccaagnggcccagngcactcccagaccgtaggttacaggtcgggcgggtagggtgtacggggactacggacttaccacctcaccaccactccgaagccacggaccctagacgtacgtaggtaacttagtttacgactttaaggtttaactacgtgtacagtacgaagtcgtaaggccgttaaacttgggttaccgttacgggtaccggtttaccgggaacccgtaaaggggaacccgtaaaggggtaacggtaaacgtaccggtaaaaccgtaaccggtaggttacggtacgtacgacctaacccgtacgttccgtacgttactttaccgtaccttccgttcccgtacttaccttacgacgtaagttcggtacgttacgttacgcggtacgggcggtacgtacggacgtacgggcgtacgtagngtcnang

SEQ ID NO: 229008 - DNA, 601 bp, Homo sapiens
  misc_feature: GYAE6OF02GSPKT.33.85.H08.1.454.CMB.1.raw
  modified_base (325)..(325): a, c, t, g, unknown or other
  misc_feature (325)..(325): n is a, c, g, or t
  modified_base (500)..(500): a, c, t, g, unknown or other
  misc_feature (500)..(500): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacagagacctggccaggcctcccaggctcctcttctatgatgcatcccgacagggccctacgtggcactcccagccaggttcacgtggcaggtgggtctgggacagacttcgactctcaccntcagcagcctagacgcctagaacgtattttggactagttttacttacgtgttcagcagcgtagcaagttggtcttggacgtttcggaccgaagggtaccaaggtaggaaacttacgaaacgtaacctggtcggtctgcaaccagttcctggttaccttctacttccgttaccccnccgtaacttcggtacgtaaggtgtttacggtcgttaacgtggttaacgggcccgggggttgtacgggtaccgaaacggggcggtacctaaggtcgagngng

SEQ ID NO: 229009 - DNA, 657 bp, Homo sapiens
  misc_feature: GYAE6OF02HX97V.33.85.H08.1.454.CMB.1.raw
  modified_base (440)..(440): a, c, t, g, unknown or other
  misc_feature (440)..(440): n is a, c, g, or t
  modified_base (615)..(615): a, c, t, g, unknown or other
  misc_feature (615)..(615): n is a, c, g, or t
tcagtacacacactcacgaccggtgctcgatttagtatcactcagtcgcgggggaggaactgctcagttagaacccagagggaaccatggaagccccagctcagcttctcttcctcctgctactctggcctcccagactaccaccggaataattgtgtgacacagtctccggccacctgttctttgctccaggggacagacgcccaccctctcctgcgagggccagtcagactgttagcaggcgcttctgcctggtaccacgcgacgaaacctcggccgacggcctcccgaggcccttcccgtccgttactagtcggtcactcgtaccaccgacggccacgtcggcactcccgagacgtcggttcaggtacggcgtcggtgggtcgtcggggaacacggttactccgacctcctacgaccctatccgaacacggtaccgngggacgtccgtaggtaacgttcgtttaacgcgtaacttacttagttacgtgtcaacgctaagtacgtacgggtaggtacggtaccggttaacggaccggaaacgggtaccgaaagggtaacgtaaacgtaacgtaacgtaacgtggtaggtaacctcggaaccgtactaccgttnttaccggttacttacgtaaccgtttccctacccgtactacgg

SEQ ID NO: 229010 - DNA, 639 bp, Homo sapiens
  misc_feature: GYAE6OF02HI48S.33.85.H08.1.454.CMB.1.raw
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
  modified_base (635)..(639): a, c, t, g, unknown or other
  misc_feature (635)..(639): n is a, c, g, or t
tcagtacacacactcacgaccggtgctcgatttagtatcactcagtcggcgggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacagacgacctggcccaggcctcccgaggcctcctcttctatgatagaactccaacgacgggaccctacgtggaccactccccacgaccgtaggttcaggtcgggccgggttgggtccgtagggacaggtaccttccacttacctccaacctataccacgcacgtaccagacgtcctaggtaagttnttttgacttaagtttttatatcgtanagtaccgagtcgtacactagttcggtcgttacggaccgttcggaccgtaagggtaacggaaggtagtaaactacgaaacggtactgggtaggctaggcctaacgattccgtgttcctatccttcccgtcccgactacgttcgtacggtaagttgttacgttactacggtgggaccggtcggggtcctaagggaccgaggacccgtagtaatacggtnnnnn

SEQ ID NO: 229011 - DNA, 864 bp, Homo sapiens
  misc_feature: GYAE6OF02HL47I.33.85.H08.1.454.CMB.1.raw
  modified_base (810)..(810): a, c, t, g, unknown or other
  misc_feature (810)..(810): n is a, c, g, or t
  modified_base (821)..(821): a, c, t, g, unknown or other
  misc_feature (821)..(821): n is a, c, g, or t
  modified_base (857)..(857): a, c, t, g, unknown or other
  misc_feature (857)..(857): n is a, c, g, or t
tcagtacacacactcacgaccggtgctcgatttagtatcactcagtcggcgggggggagaactgctcagttaggacccagagggaaccatggaagccccagctcagcttctcttcctcctgctactctggcctcccgaggggaaagacgccaccctctcctggcgagggccagtccagtagtcgttagcgggtacctagcccgttaggtaacccaaacgagaacgtacctcgggacccaacgggcccttaccccgaggccttccctctttacagttcgactcggacctaacgttcccgaaacggtacgggaccccaacgttacggaccctaacgttaccccgaacgtaccccggtaacggtttaccgtaacgggtcggggtaccggggtttccgggggttacggtttacgggggaacctaacggtaaccgtttacccgttaaccgttaccgttacccgaaccctaacgttaccaacggactaaccggtacccgttaaggaccgtaccgtaacggtaacgttacgttttacgaccgtttaaggtttaactttacgtacgtccgaagtaccgtaggtacgtaagtacccgtaacggtttcggttacgtttaccgggtaacggtttcgggaacccggtaaacggggtaaaccccgtaaaaggggttaaaccggtaaaacgtaaccggtaaaacgtaacggtacgggtaggtaccgtacgtacccgaactacgttaccgtcgttaaccgttactaccgttaccgttacccgaccttacgtcgtacggtagttcgttagtacgtaaggttacggnggttaccgggnttaccggaacggtacggacgtacgttaagaccgtancgtatag

SEQ ID NO: 229012 - DNA, 609 bp, Homo sapiens
  misc_feature: GYAE6OF02FJR9C.33.85.H08.1.454.CMB.1.raw
  modified_base (603)..(603): a, c, t, g, unknown or other
  misc_feature (603)..(603): n is a, c, g, or t
  modified_base (609)..(609): a, c, t, g, unknown or other
  misc_feature (609)..(609): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagacgacctggccaggcctcccgaggcctcctcttctatgatgcactccaacgagggcccactggcatcccagccaggttcagtggcggtgggtcgtgggacagacttcactctacaccatcagcagcctagacgcctagaacgtattttgctagttttattacgtgtacagctagtcgtagcctaacgtggtcgttggtacggttcggaccgaagggacccgaagggtacggaaatacgaaaaccgaacgttggacggtcgtacgactacctatcttcgttacttcctacgtccctttcccgaccctagttcctaggtaacgttcggttcgttacggttacgtggtaacgggtcgggtaccgtcgggtaaccgaagggtccgacgtaacgttaacggngagtgn

SEQ ID NO: 229013 - DNA, 762 bp, Homo sapiens
  misc_feature: GYAE6OF02F70UV.33.85.H08.1.454.CMB.1.raw
  modified_base (198)..(198): a, c, t, g, unknown or other
  misc_feature (198)..(198): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcgggtactagcctaggtaccacagacgacctggccaggcctcccgaggcctcctcttcatcgatgctactaccgaaacgcgggcccacggtggcctaacgtccccgaagcccgtagggtttcaggttcgggcgggttaggtcgtaggggacctagtacctttccgaacttcctacgaccctaatcccaaggccgacgtcccgtaggtaccgtcctacggtaagttacgttttacggacctttaaggttttaactttaccgttacggttaccttacggtaccgtacgtaccggttacggtacctaaaccggtaccgggtaacccttaaacccgtaccccggttttaccgggaacccggtaaacggggtaacccgtaccgggtaacgtacgggtaaacgttaaaccgttaaaccggttaccgtgggttaccgggtaccgtaccgttaacccgacccgtttacgttacccggtttacggtttaccctttaccgtacccgttttaccccgtttaccccggacctttaacccg

SEQ ID NO: 229014 - DNA, 801 bp, Homo sapiens
  misc_feature: GYAE6OF02HIDB6.33.85.H08.1.454.CMB.1.raw
  modified_base (199)..(199): a, c, t, g, unknown or other
  misc_feature (199)..(199): n is a, c, g, or t
tcagtacacacactcacgaccggtgctcgatttagtatcactcagtcgcggggaggaactgctcagttaggacccagagggaaccatggaagccccagctcagcttctcttcctcctgctactctggcctcccagataccaccggagaattgtgttgacacagtctccggccacctgttctttgtctccgaggggaaangccaccctctcctgcacgggccacgtcagtagttgttacgcgggtacctacggccttaggtaccaacgagacgtaccgttcggccaggcctccccgacgggtcctcccttcgtttccttaagtcggtattcggcctaacgttcccgaaccggacggggccctaccggtcggggacctaccgtccccgaacggcccgttaagggttccgtaagggtcggaccgtagggttcgggtccgttacgggggacctacgggttacctttaccggacctttccgtaaccgaacccttacgtacgtaaccgtcgaccgtacccgttaaggtacccgtaccgtaagttaacggtttagttttaccgacgttttaagtttaactttacgttcggttacttacggtacctacgggttccgtaacgtaccaccggttccgaacccgttaaccgtacccggttaacccgggaccggtaaacgggtaccgaacggtaccgaacgggtaacggttaacgttaaccggtaaggttcggtcgggtactaaccgggtcctaaccgtacggtttacgtacggtttacccttacggtaccctttcccgtcccggttaacccg

SEQ ID NO: 229015 - DNA, 710 bp, Homo sapiens
  misc_feature: GYAE6OF02I303S.33.85.H08.1.454.CMB.1.raw
  modified_base (704)..(704): a, c, t, g, unknown or other
  misc_feature (704)..(704): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctcccaggggaagagccaccctctcctgcaggccagtcagagtgttagcggtacctagcctggtaccaacagacgacctggccaggcctcccaggctcctcttctatgatgcataccaacgacgggccacgtggcactcccacgcctaggtcagtggacgggtgggtcgtgggacagtacctctactctccaccatcacgcacgtcctacgacgtccgtaggtaagtagtttcgacgtttagtttatttaacgttgtacacgtacgtacggtcgtacgtactacgttcggttacgttacgggtaccgtttaccgggaaccgtaaacggggacccgtaaagggtaaggtaaaacgtaccgaaaacggtaacgtcgggttacgtacgtaccggaccctaaccttagttccttacggttaccttactaccgtttcccgttaccccgtacccttgttaccctaaggttaacgtttcggttacgttcggtttaaccgtaggggtaccggggtacgggtaccggttaacgggacccgggtaacgggtcccgttaggtaaacgttaccgggattaccgngtaacc

SEQ ID NO: 229016 - DNA, 839 bp, Homo sapiens
  misc_feature: GYAE6OF02IXR8W.33.85.H08.1.454.CMB.1.raw
  modified_base (156)..(156): a, c, t, g, unknown or other
  misc_feature (156)..(156): n is a, c, g, or t
tcagtacacacactcacgaccggtgctcgatttagtatcactcagtcggcggggggggagaactgctcagttaggacccagagggaaccatggaacgccccagctcagcttctcttcctcctgctactctgctccgagggaagcgccacctctccngcacgggcctagtcagagtgttacgcgggtacctagcctacggtaaccacagactaccgtcggaccaggcctacccgagggtccttccgttcttacctaagtcgacgtcgacctacgtaccaaacggtcggccagtacggacaccgtcccacgccgtaacgtcgacggtcgggcgggtgggttacgtcgggtaacacggtaccttcgaccgttaccgtacctaccgtacgtaccgacgaccgtaaccggtcctaacggtaccggtaccgtacgggttaacggttacccgtttacgttacgggttaaccttaaggtttttaaccgtttaaccggtttcggtttaccgaacggtaccggtaaccggttccggttaccgtaaccggtaaccggttccggtaaccccggttcccgttacggtaccccgttaccggttacccgggaaccgggtaaacgggtaccacggttaacggtcgggtaaacggttacgttaacgggaaccgtaacggttcgggtacgcgttaccgaccgttacccggtttagttccgttaccgttacccgttaccgttacccggttccctaaccgttaccggttactacggttaaccgtttcggttaacggttccgtacggtacggtacgggtccgtaacgggtccgtaaccggtagggtcctacggtagtcgg

SEQ ID NO: 229017 - DNA, 653 bp, Homo sapiens
  misc_feature: GYAE6OF02FNCGW.33.85.H08.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccaccggagaaattgtgttgacacagtctcccggccaccctgtctttgtctccgaggggaaagngccaccctctcctgcagggccagtcagagtgttagcgggtacctagcctggtaccaacagacgacctggccaggcctcccaaggcctcctcttctactgactgctatccaacgngggccacgtggcactcccagccaggttcaggtcggngggtgggtcgnggggaacngaccgttcacgtctcgaccaatccacgctacgccgtagacgccgtaggtaacgtacgttttagaccttaagttttacgttacgttcgttacgtacgtacgaggttacgttagacctaacgttcggttcgttcgggtacgtttacggaccgtaacgggtaccggtaaacgttacgggtaaactaacgaaaccggtacgttacgggttacggtaccgtacgaccgtaacctacggttaccgttcgttaccgttacctacttcccgttcccgtccctacgtttccg

SEQ ID NO: 229018 - DNA, 803 bp, Homo sapiens
  misc_feature: GYAE6OF02J1T9Y.33.85.H08.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
tcagtacacacactcacgaccggtgctcgatttagtatcactcagtcgcggggaggaactgctcagttaggacccagagggaaccatggaagccccagctcagcttctcttcctcctgctactctgctcccagataccaccggagaattgtgttgacacagtctccggccaccctgtctttgcctaccgagggaangcccaccctctccngcacggccagtcagngtgttagcggtaccngcctaggtaccacgagacgacctcggccaggcctcccgaaggtccttaccgtcttacgtatgacttacgctacgtacccgaaacgaccgggcctaacgtcgggacctaccgttaccccgaggtaccccgtaaggggtttccgaacgggggtttccgggtaccggggtttcggggttacccggtacgggggttaaaccctaacgggttaacccgtttacctaacgtcccgttaacccaaccgtacgttacccgagggtaaccctacgggtaccccgtaagggtacccgttacccgttaagggtaaaacggttttctttttaccggtacgtttaaaccggttttaaacgttaccggtttagtaacccgtaacggtacccgttacggtaacgttaaccgttaccgtaaccggtttcgtttaacgtcgggttaacgtcccgggtaacgaacggttaccgtaaggtaacgaacgttaacgaaaccgtaggtcgacggttacgcgtacccaggttaccttaggtttccgtaccgttactcccgtttacccggcccgttacttacgtcgg

SEQ ID NO: 229019 - DNA, 625 bp, Homo sapiens
  misc_feature: GYAE6OF02FGU6D.33.85.H08.1.454.CMB.1.raw
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
  modified_base (618)..(618): a, c, t, g, unknown or other
  misc_feature (618)..(618): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctcccgaggggaaagagccaccctctcctgcagggccagtcagagtgttagcgggtacctagcctggtaccaacgagacgacctggccaggcctcccgaggcctcctctctatgatgctatccaacgagggccacgtggcactcccagccaggtttccaggtcggcggtgggtctgggacagtacttcacttctcacctntcagcacgcctgacgctaggaattntttgactagtttattagtctcgtagacagtacgtagctaacgtggtacgttcggacgttcggacgtaacgggtaaccgtaagggtacgaaactacgaaacggacgtcggtacggtctacgaccgtaacctcttcgttcgttaccttcgtaccgtttcccttccccgacttagtcttaacggtaacgttgtacgttacgtacggttcggaacgggtcgggtaccgtacgggtaccgaacgggtaccgtacgtacggtaacggnagtgacg

SEQ ID NO: 229020 - DNA, 717 bp, Homo sapiens
  misc_feature: GYAE6OF02IJHGE.33.85.H08.1.454.CMB.1.raw
  modified_base (205)..(205): a, c, t, g, unknown or other
  misc_feature (205)..(205): n is a, c, g, or t
  modified_base (347)..(347): a, c, t, g, unknown or other
  misc_feature (347)..(347): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggctcccagataccacggagaaattgtgttgacacagtcctccggccacccttgttctttgtcctaccgagggggaaanacgcctacccttctccgtgcgacgggccagtcaggagttgttagcagacaacttacttacgcgtaggtaaccagcacgacaccgtggacccaggcctaccgaggtccctcctactaacttcccgagtcggtacacgtaaccncccgaacgacggaccctacggtcgacctacgtacccgaagtaacggtacggtacgaggtcggtacgtacgggttcgggtacggtacggacgtacgttacttacgtactttaccgacccgtactacgttaccgacgtacgtacggtacggttacgggtacgtaccgttaaggtaacgtttacgttttcggaacgttacggttagtttaacgttcgtacgtacgtagtacgttaaggttacgtttactacgtacttccgtaccgtaccggttaccggaacgaacgggtacgtaagggaacgttaacgaacgaacggttaacgtcgtacgtcgtaacgccgtaacgttcgtacggtttctacttaccgtaccg

SEQ ID NO: 229021 - DNA, 763 bp, Homo sapiens
  misc_feature: GYAE6OF02H0HHS.33.85.H08.1.454.CMB.1.raw
  modified_base (730)..(730): a, c, t, g, unknown or other
  misc_feature (730)..(730): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctccagataccaccggagaaattgtgttcgacacagtctccgacgccaccctgtctttgtctcgaggggaagcgcccacctctctcgcgagggccagtcagagtcgctggcagctaacgttgccgttaggaaccaaacaaaaccgtcggaaccacgacctacccgacggtacctccgtactacttacgtaatacgacgttacggacctaccgtacccaaccggacgggtaccctaacggtcggacctaaccgtaccccgtacggtacccgtacgggtttaccgacgggttacggtaccgtagggttccggggtacgtacggggaaccgtacgtaccgttaccgacctttaccctaccgtaacccgtaacgttaccgaacggtaccgtaaccggtacccgttaaggaacccgttaccgtaagggttaaccgttttacgtttaccggaacgttttaacggtttttacttaaccggttacgttacggtacgtacgtacggtacggttacgtaaccgtaaccggttaccgtaccttaaccgtaccggttaccgaaccggtacggaaccacgtacgtacgacgttaacgtaacgtacgtggtacgtcncggtactcggtaacttcgtacttcctactaccg

SEQ ID NO: 229022 - DNA, 918 bp, Homo sapiens
  misc_feature: GYAE6OF02IZH96.33.85.H08.1.454.CMB.1.raw
  modified_base (917)..(917): a, c, t, g, unknown or other
  misc_feature (917)..(917): n is a, c, g, or t
tcagtacacacactcacgaccggtgctcgatttagtatcactcagtcgcggggggggaggaactgctcagttacggacccagagggaaccatggaagccccagctcagcttctcttcctcctgctactctggctcccaaggggaaagagcccaccctctcctgcgagggccaggtcagtagtgttagccgggtacctagcctagggtaccaacgagacgcctggccgaggcctcccaaggcctaccttcttcctaatcgagtcgactaacgtacccaaacggtacgggccctacgtcgaccgaccgtacccacgtaccgtacggtttacgacggtacggggtcgggttcggggtcgtacggggaacgaacgttaaccgttccgtaaccgttcccttaaccgaaccctaacgttaccgtaacgaccgtaaccggtaacccgttaacggaccggtaccgttaacggtaaaccggtttattttttacgaaccggttttaaagtttttaaacggtttaacttacggttacgtaacggaccgtaacggtaacggttaacggaacccgttaaaccggtttaccgggtttacgggttttacggggtttaaccgggttttaccgggaaaccccgggtaaaacccggggtaaaccggtaaaacgggggtttaaccgggaaaaacggttaaaccggtaaaaaaccggtaaacgttaacggggttaacggttaccggttaccgtacccgttaaaccctaccggtttccgttacgttacctttacccggttacctttaccccgtttacccgtaccgttacctttaaccggttacgttaaagggttccggttgttaccgggttaacgttacggtaacgggtcccgggacgttaccggaccggtaacgggcgtaccggagtacggatcgang

SEQ ID NO: 229023 - DNA, 724 bp, Homo sapiens
  misc_feature: GYAE6OF02H9N3U.33.85.H08.1.454.CMB.1.raw
  modified_base (145)..(145): a, c, t, g, unknown or other
  misc_feature (145)..(145): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (390)..(390): a, c, t, g, unknown or other
  misc_feature (390)..(390): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
tcagtacacacactcacgaccggtgctcgatttagtatcactcagtcgcggggggggagaactgctcagttaggacccagagggaaccatggaagccccagctcagcttctcttcctcctgctactctggctcccgaggggaaancgcccaccctctcctgcgacgggccagtcaggtagttgttacgcagcctaaacttacttacgccgttcggtacccagtccaagaccaccgtcgccaggcctacccgagccttccncactccagttcggncactccgaccgacggaccacgtcggcctaaccgtcccgaagtacggtacgttacgacggtcgacgtcgggttacgggtcgtacgggactaggtcttacgtaccttcctacacgtanacgtacacgaagtacgtacggacgtacttaagagtttcgtttacgacgtagtnttaacttcgtcgtanacgtcgtagttacgtacgttacgtacgtccgtccgtacggttaccggacgtaacggtaacggtaacggtaacgttaaacgtaaccgtaaacggtacgtaggtaccgtacgtaccgtaccgtaactacgtcgtttaccgttacgttcccgttaaccttccgtacccgtacgttaccgtaccgttaaggttacggttggttaccgttcggtaaccggtcgggtaacggtccggggtcgtagggtaaccgtacggtaccggtataacgg

SEQ ID NO: 229024 - DNA, 654 bp, Homo sapiens
  misc_feature: GYAE6OF02I97MY.33.85.H08.1.454.CMB.1.raw
  modified_base (158)..(158): a, c, t, g, unknown or other
  misc_feature (158)..(158): n is a, c, g, or t
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (256)..(256): a, c, t, g, unknown or other
  misc_feature (256)..(256): n is a, c, g, or t
tcagtacacacactcacgaccggtgctcgatttagtatcactcagtcgcggggaggaactgctcagttaggacccagagggaaccatggaagccccagctcagcttctcttcctcctgctactctggctcccagataccacggagaattgtgttgacncagtctccggccaccctgtctttgtctccgagggaangcctaccctntcctgcagggccagtcagcgtgttagccggtacctagccgtaggtaccaanagacgaccgtggccaggtctcccgaggcctcctcttcatgatcgctactaccgaactcgggccagtcggctaacctccccaacgtggttcaggtcggaccggttgggtcttgggactgtacttccgaacttcctaccgacctatcgagcctagtcccaagcgtcctaaggtacttagttttcgacgttatttacgttactacgtacagtctagccgttagtaccgtaacgttcggttcgttacgggtaccgtttacggaaccgtaacggggtaaccgtaaggggttaacgtaaaaccgtaccgtaaaacggtaaccgttagggtacgtccgtacgtccaaccgtagttaccttacgttcttaccgtacttccccgttaccgaccttacgtcgtaacgg

SEQ ID NO: 229025 - DNA, 656 bp, Homo sapiens
  misc_feature: GYAE6OF02IO6KI.33.85.H08.1.454.CMB.1.raw
  modified_base (213)..(213): a, c, t, g, unknown or other
  misc_feature (213)..(213): n is a, c, g, or t
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
tcagtacacacactcacgaccggtgctcgatttagtatcactcagtcgcgggggggggaggaactgctcagttaggacccagagggaaccatggaacgccccagctcagcttctcttcctcctgctactctggcctcccgaggggaaagacgcccacccgtctcctgcgacgggccagtcagagtgttacgcggtacctagcctggtaccaanagcacctggccaggtcctcccgaggtcctcctcttacgtatcgatcgccactccgaacgtcgggcctagtggccactcccagccgaaggttcgaaggtcggngggttcggtcgtgggacgtagtaccttcaacgtcctacacatcagctagacctagcgtcgaactaagttntttcgactttagttacttcgtagttacaagtctacggtacgtacgtacgtaacgtttcgtacgtttacggtaccggtttaccgaacccgggtaacggtaaaccggtagggttaacggtaaactaccggtaaaccggtaagttcggtacgtccgttacgaccctaccgatccgttacgttacttctacgttcctcccgtactactcgtagaacgttgtagtacgtacgtggtcggtcggcgtacgaccggaggtccgtagagtagtcagtac

SEQ ID NO: 229026 - DNA, 788 bp, Homo sapiens
  misc_feature: GYAE6OF02GOKHL.33.85.H08.1.454.CMB.1.raw
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (582)..(582): a, c, t, g, unknown or other
  misc_feature (582)..(582): n is a, c, g, or t
tcagtacacacactcacgaccggtgctcgatttagtatcactcagtcgcggggaggaactgctcagttaggacccagagggaaccatggaagccccagctcagcttctcttcctcctgctactctggcctcccagataccaccggagtaaattgtgttgacacagtctccggccacctgtctttgtctccgagggaangccaccctctcgtgcgacggccagtcgagtagttggtacggccggtacncgtccgtacggtaaccaacgagacgtaccgtcggaccacggtcctaccgacggtcccttaccgtactacttaccgttacgtagtacgttacgaccctaaccgtacccgaaccggacgggtaccctacggtcggacctcccgtacccgacggtacccgtaggttaccgtacggtcggtacgtacgggttcgggtacgggtacggacgtaacggttacccttaccgtacgtcctaccgtaccctacgtacgtacgaccgtacgcccgtaaggtacctccggtaaggtaaacgtttctttacggacgtttaacgtttattacggttcgacgttacggnttaaccgggacgttaccacggtaccctagggttaaccctacccgttaccgggtaccgaaccggaacggaccgttacgtaacggtaacgggtaaacttaaccgtaaccggttaacgggtcggaccgggttaaccctaggtaacccttaccggtagttcccgttttacctaccggtttacccgttaaccgtaccccggttttccccgg

SEQ ID NO: 229027 - DNA, 944 bp, Homo sapiens
  misc_feature: GYAE6OF02GF8M1.33.85.H08.1.454.CMB.1.raw
  modified_base (752)..(752): a, c, t, g, unknown or other
  misc_feature (752)..(752): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctgcctcccagactaccaccggaagaaacttggtgttcgacactagtctaccgacgcccacccttgttccttttgtcctaccgaagggaagaaaacgacgccccaaccccttctactacgtacggcgaccgggaccaaggtaccgaacggtaagttaattaacggtctaacgtttccgtttaccgttcgggaccccgttaccgggttaaaccaaaccgaaccggaaaacccggtcggaccgacggtacctaccccgagggtccctcccgtaccaacgtaccccgaagtaacgtaccgtacgtaacttttaccgaaaccggtcgggaacccctacggttaccggacctaaccgtaccccgtaaccgtacccggttacgggttacccgaaggttccgggtaccgggttaacggggttccggggttacgggtacccggggtaacgtaaccggggttaaccctttaccgtaacccgttaccgttacccgacccgggtaacttccgaaccgtacgaccgtaccgaacggtaaccgtacccggttaagtaacgtttagttcggtaaccgttttaacggtttaacttttacccgtaggttaccgaacgttaccgtaacgggtaccggttaanaacggtttaccgttacgggtttacccgtttaacggggttaccggtttacccgggaaacccggtaaacgggttaacccgggaaagggttaccgaaaacgtttaacccggaaaccggtaacgtttaccggcggtttaaccgacgtacccggtaactaacccgtttacgtacgtttacccgttactttaccccgg

SEQ ID NO: 229028 - DNA, 686 bp, Homo sapiens
  misc_feature: GYAE6OF02IEB2M.33.85.H08.1.454.CMB.1.raw
  modified_base (449)..(449): a, c, t, g, unknown or other
  misc_feature (449)..(449): n is a, c, g, or t
  modified_base (489)..(489): a, c, t, g, unknown or other
  misc_feature (489)..(489): n is a, c, g, or t
  modified_base (518)..(518): a, c, t, g, unknown or other
  misc_feature (518)..(518): n is a, c, g, or t
tcagtacacacactcacgaccggtgctcgatttagtatcactcagtcgcggggggggagaactgctcagttaggacccagagggaacatggaagccccagctcagcttctcttcctcctgctactctggctccagataccgaccggggaaattgtgttgacacagtctccagccacccttgtctttgtctaccgaaggggaagacgccaccctctcctgacgacgggccacgtcagagtcgtctggcagctaacttcgaccgttcggtaaccaaaacaaaaccgtcggaccaacgacctaccccgaggcctacctacattcttagtgatcgacactccgacggacggcctacgtggcctacgtacccgacgtaccgtacggttacgaggtcggactaggggttcgggtaccggtggggaactacgttacttccgacttccaccacctancgacgaccgtagacccgttagaacgtcctagtaacgtttnttcgtacttagttttattaccgtcggttntacgaccggtagtccggtaataccgtaaccgtaggtaccccttaaccgttacccgttacgggaaccgtaaacggaccgacgaacggttaagacgttaaacgtaaccgttggtacgttcggcccgttagacccacggtctttaccgtcgttcttaccgcctttccccgg

SEQ ID NO: 229029 - DNA, 834 bp, Homo sapiens
  misc_feature: GYAE6OF02GZX55.33.85.H08.1.454.CMB.1.raw
  modified_base (146)..(146): a, c, t, g, unknown or other
  misc_feature (146)..(146): n is a, c, g, or t
  modified_base (830)..(830): a, c, t, g, unknown or other
  misc_feature (830)..(830): n is a, c, g, or t
tcagtacacacactcacgaccggtgctcgatttagtatcactcagtcgcggggggggagaactgctcagttaggacccagagggaaccatggaagccccagctcagcttctcttcctcctgctactctggcctcccgaggggaaanagccaccctctcctgcagggccagtcagagtgttagcgggtacctagcctaggtaccaacagacgacctggaccaggcctacccgaggccttccgttcttctatgactcgctactacccgaaacgcgggaccctacgtcggtacctacgtccccaacgtcccgtaagggttaccgtacgggtcggggtaccgggttcggggttaccggtagggggaaccttaacggtaccgtttaccgtaccgttccctaccgtaccctaacgttcgaacgccgtacgtacccgttaggaaccgtccgtaaggtaagtttacctttggtaacgtttacgttttaacgttacgtacgtacgtacgtacgtacggtaaccgtacgaccgtttaacgttcgggtttaccggtttacgggttaccgtttaccgggaaccggtaaacgggaaccggtaaacgggttacgaaaacgttaaccggaaaaccggtacgttacgggttacggtaccgtacggacccgtaacgtacctttcgttaccgttcctttaccgtacccgttcccgttacccgtaccttacgtaccgtttacgggttaacgttcggtaaggtttacgttaccgggtacgggtaaccgggttcgggacggttaacggggacccggtaacgggtaccggtaacccgtagtacgggtcaggntacg

SEQ ID NO: 229030 - DNA, 813 bp, Homo sapiens
  misc_feature: GYAE6OF02GG8WC.33.85.H08.1.454.CMB.1.raw
  modified_base (664)..(664): a, c, t, g, unknown or other
  misc_feature (664)..(664): n is a, c, g, or t
  modified_base (756)..(756): a, c, t, g, unknown or other
  misc_feature (756)..(756): n is a, c, g, or t
tcagtacacacactcacgaccggtgctcgatttagtatcactcagtcggcggggggggaggaactgctcagttaggacccagagggaaccatggaagccccagctcagcttctcttcctcctgctactctggctccagactaccgaccgggaaattggtgttgacacgagtctccacgccaccgtgttcgtttggtccgtaccgaagggggaaacgacggtaccctaccccgttccctcggtaccggaccggaccggtaccgtacgacgtaggtcgtcgtcggtcgacgacgtaacgttaccgttaccgtaccggtaccgtaaaccctaaaaaccgtaaccggtccgaccgtacgtaccccgtaccggcctaccctccgtacgtacgttacgttacggtagtaccggtcgtaccgtacccgtaaccgaaccgggtacccgaccgtacgggtcgtacccgacccgtaaccgtaccggtacgttcggtaacggtcggtacggtacgggttcgggtacggtacgggacggaaccgtacgttaccgttacctaccgtacccgtaccgtaacctcgtaacgtcccgacgttaggtaaccgtcgaactttaggacggttatttacggtaccgttaatttacggttctacgggttatccgtagttaaccgngtaacggtccaacggttcggaacccgttaacacccgggttacgaccgggtaacgacgacggtacgtaagaacgtacggttaccacggttcgnggttaacccccgtacaccgtaacttccggttgtaacctccttacgttacccctcggg

SEQ ID NO: 229031 - DNA, 859 bp, Homo sapiens
  misc_feature: GYAE6OF02IOEE4.33.85.H08.1.454.CMB.1.raw
  modified_base (149)..(149): a, c, t, g, unknown or other
  misc_feature (149)..(149): n is a, c, g, or t
  modified_base (848)..(848): a, c, t, g, unknown or other
  misc_feature (848)..(848): n is a, c, g, or t
  modified_base (855)..(855): a, c, t, g, unknown or other
  misc_feature (855)..(855): n is a, c, g, or t
tcagtacacacactcacgaccggtgctcgatttagtatcactcagtcggcggggggggggaggaactgctcagttaggacccagagggaaccatggaagccccagctcagcttctcttcctcctgctactctggcctccgaggggaaanacgccaccctctcctgcagggccagtcagagtgttaggcgggtacctagcctggtaaccaacagacaccgtggccaggcctccgaggccttccctcttctatgatcgcactaccaacgacgggccacgtggaccactccccacggtccgtaggttcgaaggtcggggtccggggttgggttccggtaggggacctacggtaaccttccaccgttcctacccaacctactcgaacgcctacgtaccgtacggacgacccgttaaggtaaaggttactttttcgggaacctttaaaggttttaaccttaacgtttacggtacgtaacggtcctaagggtaccgttaacggtcccgttaaaaccgggttttcgggttaccgggtttacggggttaacccggggtttacccgggaaacccgggtaaaacgggggtaacccggtaaaaagggggttaaccggtaaaaaccggttaaacggaaaaaccggtaaaccggttagggttaccgggtaccttaccgggtaccctaaacccgtacgtttaccgtttacgtttacctttaccgtacccgttttccccttaaccccggacctttaccttaccgggtaacgttaacggttcgggttacggttacggttaacggtcgggtaaccgggtccggggtacgtacgggacccgggtaagggccgtaaagtggtaacgntacggtnacgg

SEQ ID NO: 229032 - DNA, 1196 bp, Homo sapiens
  misc_feature: GYAE6OF02FL8F4.33.85.H08.1.454.CMB.1.raw
tcagtacacacactcacgaccggtgctcgatttagtatcactcagtcgcggggaggaactgctcagttaggacccagagggaaccatggaagccccagctcagcttctcttcctccttgcttactctggcctcccagactaccccgaaccgggaagtaaagtttggttggttacgaaccaaccgtacggttccgtccccgggaccctaaccccgttggttcctttttacggtcccgttacccggaaaggggggaaaaacgaccggaccccctaacccccgtttccttacccgtcggaaccggaaccgggggtaccctaacgggttaccgtaaacgggtacggtttacggttttaaccggggtacccgggggtttaacccccgtttaacggtacccccgttttaagggggttaaaaccccccgaaaaaccggaaacggtaaacccggggttaaccccggtaccgggggtaacccccgtaaaaccgggggtttcccccgttacccccccggggtaaaggggtcccccccttttttaccccgtttaccggttttttaacccgtttaaacggtttaaccggggttaacgtttcccgggtaaacccttaaaacccgtttaaaccccccgggttaaaaacccggaaccggggggttaaccccccccggtaaacccggttacccgggggtaccccgtttaaaccccccggtttaccccccggtaaaccggggttaccccccgttttaaaagggggggtttaccccgggttaaccgggggggtttaccgggggggtttaacccccgggggggtttttaggggggggtttaccccccgggttaaaggggggtaaaccccggtttaccgggtttaaccccttttaacccggtaaacccccgttttacccggtttaaaccccccgggaaaaccccgtttatttaaaccccgggaacccgggttaccggttaaaacccgttaccccgggttaaaccgggaacccggtttaacccggttaacggtttaaaaacgggttttttacgggtttttaccgtttaaaccgggttttaaacgtttttaaccgtttaccgttacccggtttaaccggaacgttccgggttaaacggttaccggttaaaccgggtaacccgtttacggtttaaccgggggttttaaccggtttaacggggttccccgggtttaaacc

SEQ ID NO: 229033 - DNA, 734 bp, Homo sapiens
  misc_feature: GYAE6OF02GVDX7.33.85.H08.1.454.CMB.1.raw
  modified_base (144)..(144): a, c, t, g, unknown or other
  misc_feature (144)..(144): n is a, c, g, or t
  modified_base (267)..(267): a, c, t, g, unknown or other
  misc_feature (267)..(267): n is a, c, g, or t
tcagtacacacactcacgaccggtgctcgatttagtatcactcagtcgcggggggggaggaactgctcagttaggacccagagggaaccatggaagccccagctcagcttctcttcctcctgctactctggctccaggggaaanacgcccaccctctcctgcacgggccagtcagagtgttagcgggtacctagcctggtaccaacgaggagacctggccagggtcctacccgaggccttcctcttcctatgatgcactccaaacgnggccagtggcactccagccgtacggttcaggtggcggtcgggtcgtgggactacgcttcactacctcaccatcacgcacgctacgacgtacctaggaagttacttttcgcttacgtttattaccgtgtactagtacgagtcgtaacggtactaacgtcggtttaccggtttcgggtacccgggtttacccgggaccggtaaacggggtaacccgtaaacggggtaacggtaaaacgttaaccggaaaaaccggtaaccggttaacgggttcggtacgtaccggtacccaaccgttacggtaccttcgggttacctttactaccgtttcccgttacccgtaccctattaccgttcggtaaacgttcgttaaggttccggttaacgttccgggtaacgggtccggggttaccggccgggtaacggtaaccgggtacggtaccgaaggttaccggacggtttagcgtacg

SEQ ID NO: 229034 - DNA, 794 bp, Homo sapiens
  misc_feature: GYAE6OF02IKGZ7.33.85.H08.1.454.CMB.1.raw
tcagtacacacactcacgaccggtgctcgatttagtatcactcagtcgcggggaggaactgctcagttaggacccagagggaaccatggaagccccagctcagcttctcttcctcctgctactctggctccagactaccaccggagaaattgtgttgacacacgtctcccggcctacccttgtctttgtcctccgaagggaaagcgaccctaccctcctacctcgacgacgggcctaggtactaaggtaggttggttacggacccgggttaaccgtacgtcccggttacggtaaaccccaaacgacggaacggtacccgtcggacccgaacgggtccctacccggacggtacccttccttcccgtttacttagtagtacgtcgaacctactaaccccgaacggtaccgggtaccacgttacggacctacctacccgtacgtaccgtaagggttaccgtagggttcgggtcgggttgggtcggtagggtaacgacgttaccgttctaaccgttcctaaccgtaccgtaacgtacgtacgaccgtaccggtacgtaacgtaccgtaccgttaaggtaaacgttagttttacgtactttaacgtttagttaacgtcgtacgtacgtacgtacgtacgtaacgtacgtacgtggttacgttcggtacgttaccgggaaccgtaacgggtaaccgtaaggtaacgaaactaaccggtaacgtacgtagtacgtccgtaacgaccgttacaagttccgtacgttcctttacaccgttcccgtaccgtacctacgttacgg

SEQ ID NO: 229035 - DNA, 849 bp, Homo sapiens
  misc_feature: GYAE6OF02GRFJ2.33.85.H08.1.454.CMB.1.raw
  modified_base (840)..(840): a, c, t, g, unknown or other
  misc_feature (840)..(840): n is a, c, g, or t
tcagtacacacactcacgaccggtgctcgatttagtatcactcagtcgcgggggggagaactgctcagttaggacccagagggaaccatggaagccccagctcagcttctcttcctcctgctactctggctcccgaggggaaagcgccaccctctccgtgcgaggccagtcagagtgttagcggttacctagcctggtacccaagagagacctggcccaggcctacccgaggccttaccctcgtttactagtcggaacttcggcctaacgttaccccgaaacggacgggtacccctaacgtcgggacctaaccgttacccccgaaggtaccccgtaacgggttttcaacgggggtttcggggacccgggtttggggtccgttacggggtacctaacgggttacttttcccgaaccttccgttaccaacccgtaacgttccgaacggacctaccggtaacccgtttaaggaccgtacccgttaaggtaaaacgtttcgtttttaggaaccttttaacgggtttttaaactacggtttacggtacaaggtcccgtaaggtacccgttagtaacctacgggtttaggttccggtttacggttacccggtttaccggaccgggtaaacgggtaaccgtaaggggttaacggaaacttaaccggaaaccggtacgtttagggacgtacgtacgaccgtaacctcttccgttcgtacttaccgtacctttcccggttaccctacccgtaacgtttcgtaaaccggttagttcgtacggttttacgacggttacgggacggttaccgggtcgtaacgggtaccggtacggccgtaagtccggtaagngacgtgtac

SEQ ID NO: 229036 - DNA, 714 bp, Homo sapiens
  misc_feature: GYAE6OF02FKGY5.33.85.H08.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (668)..(668): a, c, t, g, unknown or other
  misc_feature (668)..(668): n is a, c, g, or t
tcagtacacacactcacgaccggtgctcgatttagtatcactcagtcgcggggaggaactgctcagttaggacccagagggaaccatggaagcccagctcagcttctcttcctctgctactctggctccagataccaccggagaaattgtgttgacacagtctccggccaccctgtctttgtctaccaggggaanagcccaccctctcctgacgacgggcagtcagntggttagacgggtacctacgcgtcggtaaccaagagacgacctcggccaggcctccgaggtcctccttcttcgtactagtactcgtaccaacttccgaaacgacggggacccacgtcggccaacgttccccgaaggtccccgtaagggttcgtaacggggtcgggtacggggttggggttaccgtagggggactacgggtaacctttccgtaactcgtaacctacctaataccgcggacacgtaccgtaacgacgtacctacggtaacgttagttttgacgttaggttttaaattaccgtagtccctaagacgacgtcgtacgtacgtacgtacggtttacgttacgggtaaccggttcggaaccggtaaacgggtaacccggtaaaggtaggtaaactaacgtaaccggtaagtacggttacggtcttaacggactaacnccgtttacgtagtccgtactaacgttccgtacccgactagttacgg

SEQ ID NO: 229037 - DNA, 606 bp, Homo sapiens
  misc_feature: GYAE6OF02GUII4.33.85.H08.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagtacacacactcacgaccggtgctcgatttagtatcactcagtcgcggggaggaactgctcagttaggacccagagggaaccatggaagccccagctcagcttctcttcctcctgctactctggcctccagactaccaccggagaaattgtgttgacacagtctccggccaccctgttctttgcctccgaaggggaaancgccacccttctcctgcagggccagtcagtagtgttagcggtacctagcctggtaccaangtacgcctggccaggcctcccgaggtccttcctcttactatgatcgactactcccaacgagggccctacgtcggccaactccccagcccgtaagttcaggtcgcgtggttcggtcgacgggactacgttaccttcgaccttctaccacgtatacgacgcgtaacgaccgtagtacgctagtaagttagtttacgcgttagtttacttacgtcgtcggtatcgagtaccgtagcctacgcgtacctaacgtcgtccgacgaacgaccacgtaggagaacgttaacgtaacgtgtcggtacgtcacgcctaactgtacttccgttacttactacttccctaccgtc

SEQ ID NO: 229038 - DNA, 560 bp, Homo sapiens
  misc_feature: GYAE6OF02JH0SQ.33.85.H08.1.454.CMB.1.raw
  modified_base (112)..(112): a, c, t, g, unknown or other
  misc_feature (112)..(112): n is a, c, g, or t
  modified_base (144)..(144): a, c, t, g, unknown or other
  misc_feature (144)..(144): n is a, c, g, or t
  modified_base (154)..(154): a, c, t, g, unknown or other
  misc_feature (154)..(154): n is a, c, g, or t
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (319)..(320): a, c, t, g, unknown or other
  misc_feature (319)..(320): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
  modified_base (478)..(478): a, c, t, g, unknown or other
  misc_feature (478)..(478): n is a, c, g, or t
  modified_base (553)..(553): a, c, t, g, unknown or other
  misc_feature (553)..(553): n is a, c, g, or t
tcagtacacacactcacgaccggtgctcgatttagtatcactcagtcgcggggggggaggaactgctcagttaggacccagagggaaccatggaagccccagctcagcttcncttcctcctgctactctggctcccagggaaangccaccctcncctgcagggccagtccagagtgttagcggtacctagccgtaggtaccaacgngagacctggaccaggcctccgaggctcctnttcatcgatgacatcccaancgggccagtggcactcccagccaggttcagtggcggtggtctggacngtactcgactcncacnncancgtagacnggacgctacgagtatttcgattagccgtataccgtnacgtacgcagtacggtctcaacgtctcgacgtccgacgaggtccaaggtagactacgaacgtactgacgggtctacggctacagtactcgtaactcgtactcccgttaccncctagcttacgacgtcgtagttcgtactacggtcgtcgggaactcgggacgttaagccgttaacaggttacgcgnattccgg

SEQ ID NO: 229039 - DNA, 752 bp, Homo sapiens
  misc_feature: GYAE6OF02I4UZL.33.85.H08.1.454.CMB.1.raw
  modified_base (234)..(234): a, c, t, g, unknown or other
  misc_feature (234)..(234): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (475)..(475): a, c, t, g, unknown or other
  misc_feature (475)..(475): n is a, c, g, or t
  modified_base (748)..(748): a, c, t, g, unknown or other
  misc_feature (748)..(748): n is a, c, g, or t
tcagtacacacactcacgaccggtgctcgatttagtatcactcagtcgcggggggggaggaactgctcagttaggacccagagggaaccatggaacgccccagcctcagcttctcttcctcctgcttactctggcctccgaaggggaaagagcccaccctctcccgtgccgacgggcctaggtccaggagttagttacggacgggttaacctagcccttagggtaaccaaacgngacgtaccctgggacccaggtccctacccgaggtccttccttcgttactatcgatcgacacgtacccaaacgcgggaccctacgtcggactaaccgtaccgacgaccgtagggttacacggcgggtcggtcggtacgacgggacaaggtccttcgacgtcaccactatccnacgtacgacctaagngtcctagatttcgtttacgacgttttaatttacgtaccgttgaccgagtacgtanacggtaacaccggtaacgtttcggtacggttacgggtaccgggttaccggaacggtaaacgggtaaccggaaaagggtaacggtaaaacgtaccgtaaaaggtaaccgtacggttacgacgttaacgacccgtaactacgttcggttacttcgttacttacttaccgttccctacttaccgtttactaagttagttagttacgttacgttacgttaacgggtacggtcggacgggtacgtaacggaaggtaccggtagtaacgtcgacgagtntacg

SEQ ID NO: 229040 - DNA, 746 bp, Homo sapiens
  misc_feature: GYAE6OF02IPQYB.33.85.H08.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (386)..(386): a, c, t, g, unknown or other
  misc_feature (386)..(386): n is a, c, g, or t
tcagtacacacactcacgaccggtgctcgatttagtatcactcagtcgcgggggaggaactgctcagttaggacccagagggaaccatggaagccccagctcagcttctcttcctcctgctactctggcctccagactaccgaccggagaaattgtgttgacacagtctccggccaccctgttctttgtctccgaaggggaaancgcccaccctctccgtgcgacgggccagtcgaggngttggttacggccgggtacctacgccttaggacccaaacgacgacgaccgtggcccagggcctcccgaggcctccgttcttctatgatcgactactacccgaaacggacgggccacggtcgacctactcccacggccctaggttcgnggtcgggtcgggttggtcggtggggacctacggttaccttaccaccgttcctacctaacgtactcgaacgtccgaacggtccctaagacgtccgtaaggtaacgtttcgtttagacgttttaagtttattacgtacgtacgtacgtagtaacgttacgggtttacttcgtacgttccggtaccggttacccgggttacggaacccggtaaacgggtaaccggtaaacggggttaacgtaaaacgtaaaccgtaaaaccgggttacgttcgggtacgtacgtaccggtacctaacgtacggtttccgttacctttaccgttccgtttacccgttccgttacccgcgttaccttcggtaacg

SEQ ID NO: 229041 - DNA, 807 bp, Homo sapiens
  misc_feature: GYAE6OF02I1UQ6.33.85.H08.1.454.CMB.1.raw
tcagtacacacactcacgaccggtgctcgatttagtatcactcagtcgcggggaggaactgctcagttaggacccagagggaaccatggaagccccagctcagcttctcttccctcctgctactctggcctcccagactaccgaaccggggaaattgtgttgacacagtctccacgccaccctgtctttgtcctccgaaggggaaagacggcccaccctctcctgcgacgggccacgtcaggacgtcgcttcggcacgactaacgttacgccgttacggtaaaccaaaccgtaaaaccgtcggaacctaacggacctacccgacggtaccttcccgtacacttctagtcgagtcgtactacctacccgaccggaccggaccctacgtcggtacctaccgtaccccgacgtccggttaacggttacgacggttacgggaccgttaggggttaccggggtacggtacgggacgtaaccggttaccgtttaccaaccgttcctacccgtaacctacgttaaccgacgtaccgtaaccggtcgtaacgaccggttacccgtaaagttaagttcgttttacgacgttttaacgttttacgtttaaccgttcggttaaccgttcggaaccgtacggttacggtaactacgttacccgttaacccggttaaacccgtaccgttaacccggtacccgggaaacggtaaccggaccgtaacccgggtgtaaaccggtagttaaaaccgttacggaaagttcggacgtacgtaccgtaccgacgttcgttattcggtacctaccttaaccgttcccg

SEQ ID NO: 229042 - DNA, 798 bp, Homo sapiens
  misc_feature: GYAE6OF02GGOE2.33.85.H08.1.454.CMB.1.raw
  modified_base (207)..(207): a, c, t, g, unknown or other
  misc_feature (207)..(207): n is a, c, g, or t
  modified_base (796)..(797): a, c, t, g, unknown or other
  misc_feature (796)..(797): n is a, c, g, or t
tcagtacacacactcacgaccggtgctcgatttagtatcactcagtcgcggggggggagaactgctcagttaggacccagagggaaccatggaagccccagctcagcttctcttcctcctgctactctggcctcccgaaggggaaagcgccaccctctcctgcgaggccagtcagagtgttaggcggtacctagcctaggaccaagngacgaccgtggccgaggcctccgaggccttcctcgtttctaagtgtatcgacactaccgaacgacggacctaagtcggacgtacaccccgagaccgtagggtttaccagggtgggtccgggttcggggtaccgttaggggactaagtaccgtttaccactttccctacccgacctaagtccgaacgtaccgacggttacccgttaaggaccgtaccgttacggaaaacggttttacgttttcgtaaccgttttaacgtttttaaactttcgtttaacgttacgagttaccgtaaggttcgtaacgtccttaaaccggtttcgggtttaccggtttcgggttaaccggttcccgggtaaaccggaaacgggttaaccggtaaacgggttaacggaaaacgttaaccgtaaacgtaacggttacggaacggttccgttacggaccctaaccgtacgtttacgtacgtttaccttccttaaccgttcccgtacccgttaccgtacttacgtacgttaagtttcggtaacgttcgtacgtagggtccggtacggtcggtacggaccggttaggacttaccggaagtgtcgacnng

SEQ ID NO: 229043 - DNA, 874 bp, Homo sapiens
  misc_feature: GYAE6OF02GTHSI.33.85.H08.1.454.CMB.1.raw
  modified_base (869)..(869): a, c, t, g, unknown or other
  misc_feature (869)..(869): n is a, c, g, or t
tcagtacacacactcacgaccggtgctcgatttagtatcactcagtcgcgggggggggaggaactgctcagttaggacccagagggaaccatggaagccccagctcagcttctcttcctcctgctactctggcctccgaggggaaagacgcccaccctctcctgcgacgggccagtcagagttggttaggcgggtacctagccgtaggtaaccaacgagacgaccgtggaccagggccctcccgaggtccttcctcgttactatcggatcgactactaccgaaacggtaccgggccacgttcgggacctaccgtacccccaaggtacccgttagggtttaccacgggttcggggggtaccgggggttacgggggtttccggtaacggggggaacctaacgggttacccttttaccgtacccgtttacccctaccgaaacccgtaacttcgaaccggtccgtaacccggtaccgtaacgggaccgtacccgttaggttaaacggtttacgtttttagggtaaaccttttaacggtttttaactttacgttacggttacgaacggtacctaacggggttacgtaaacgtaccgtaacgggtttacggtttccggttacgggttaccgggttacccgggtaccgggtaaaccggggtaaccggtaaacgggtaacggtaaacgttaaccgtaaacggtacggttacggtacggtacgtaccggtacctacgtaccttcgttacgttccgttacgttacccttacccgttcccgtaccgttacgtcgttacgtaggttcgttagttcggttacgtacggtcgggtacggtccggtacggtacggtacggaccggtacgaacggttcgacgcgngtacg

SEQ ID NO: 229044 - DNA, 533 bp, Homo sapiens
  misc_feature: GYAE6OF01CEUUW.8.37.D04.1.454.CMB.1.raw
  modified_base (310)..(310): a, c, t, g, unknown or other
  misc_feature (310)..(310): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaatttggctgcgacaggcccctggacaagggcctgagtggatggggagaatcaaccgagtggaggtggtgcagagtacgccagaggttcagggcagagtctccatgaccagtgacacgtccgcgagcactgtctatatgganatgaggagcctgagacttgacgacacggccgtatatactgtgcgagaatcgaagaaggtgactacaatcacggagctttgaattttggggaccaagggacaatggtcatcgtctctcagcctccaccaacgggcccactcggtcttccccctcggccaccctcctaccaacgtacgcaccctccgtcggggccacgacgcggacccgtgggccgtggtcccgg

SEQ ID NO: 229045 - DNA, 555 bp, Homo sapiens
  misc_feature: GYAE6OF01D88TR.8.37.D04.1.454.CMB.1.raw
  modified_base (352)..(352): a, c, t, g, unknown or other
  misc_feature (352)..(352): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattacngtgcgagaatcgaaagaaggtggactacaatacacggagtcttttagaagttttggggaccgaagggacaagtggtcatcgtctcctcacgcctccaccgaacgggcccacgtccggtccttcccccgtcggccctaccctccctacccaacgacgcacccgtcgtcgggggccacgacgccggcccgtcgggcgtcgtcccg

SEQ ID NO: 229046 - DNA, 535 bp, Homo sapiens
  misc_feature: GYAE6OF01B36DC.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggactacaatcacggagctttgaagttttggggaccaagggacaatggtacatcgtctcctcacgcctccaccaagggcccagtcggtccttccccctggcctaccctcctacccaacgcgccaccgtcgtcggggcacgcgccggccctcgggctggtcccg

SEQ ID NO: 229047 - DNA, 536 bp, Homo sapiens
  misc_feature: GYAE6OF01BILAA.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggcctatattactgtgcgagaatcgaagaaggtggctacaatcacggagcttttgaattttggggcaagggacaagtggtcatcgtctcctcagcctccaccaacgggcccagttcggtccttccccctggccacccctcctacccaacgacgccacccgtctcgggggcacgacgccggccctcgggcgtggtcccg

SEQ ID NO: 229048 - DNA, 591 bp, Homo sapiens
  misc_feature: GYAE6OF01E3LLQ.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggtttcagggcagagtctccatgaccagtgacacgtccgcgagcactgtctatatggagatgaggagcctgagacttgacgacacggccgtatattactgtgcgagaatcgaagaggtgactacgaatcacggagtcttttagaagttttggggcctaagggacaagtggtacacgtcgtctcctcacgtcctaccaccgaacgggccctacgttccggtcccttccccccgtcggtccctaccccctccctacccgtaaacgaccgacctaccccggtccggtcgggggtacccaccgtacggcccgggaccccgttcggggcccgttcggtccccgg

SEQ ID NO: 229049 - DNA, 144 bp, Homo sapiens
  misc_feature: GYAE6OF01CLL5M.8.37.D04.1.454.CMB.1.raw
  modified_base (144)..(144): a, c, t, g, unknown or other
  misc_feature (144)..(144): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggn

SEQ ID NO: 229050 - DNA, 570 bp, Homo sapiens
  misc_feature: GYAE6OF01C3AZE.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggttcagggcagagtctccatgaccagtgacacgtccgcgagcactgtctatatggagatgaggagcctgagacttgacgacacggccgtatattactgtgcgagaatcggaaagaaggtggctaacaatcaacggagtcgttttagtaagttttggggaccgaagggacaagtggtacatcgtctcctcacgcctccaccgaacgggcccagttccggttacccttcccccgtcggtccctacccctccctacccaacgacgccacccgtccgtcgggggccaccgacggccggacccgtcgggccgtggtcccgg

SEQ ID NO: 229051 - DNA, 557 bp, Homo sapiens
  misc_feature: GYAE6OF01AFSQS.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaggtgactacaatcacggagtcttttagaagttttggggacctaaagggactaagtggtacatccgtactcctcacgccctaccaccgaacggggtccccagtccggtacccttcccccgtcggccgccctcgcctcccgacggacgccaccctcccgaagacgccacgaggccggtcccgtgggtcccg

SEQ ID NO: 229052 - DNA, 556 bp, Homo sapiens
  misc_feature: GYAE6OF01AX7IK.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggttcagggcagagtctccatgaccagtgacacgtccgcgagcactgtctatatggagatgaggagcctgagacttgacgacacggccgtatattactgtgcgagaatcgaagaggtggactacaatcacggagtcttttagaagttttggggaccaagggacaatggtcagtcgtactcctcacgccctaccaccgaacgggcccatccggtccttcccccgtggcccaccctccctcccaacgcgccacccgtcgtcgggggccaccgacggccggaccccgtcggggccgtcggtcccgg

SEQ ID NO: 229053 - DNA, 631 bp, Homo sapiens
  misc_feature: GYAE6OF01AB9MR.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggttcagggcagagtctccatgaccagtgacacgtccgcgagcactgtctatatggagatgaggagcctgagacttgacgacgacggccgtatattacgtgtgcgagaatacggaagaaggtgctacaatacgacggagtcttttagtaagttttggggaccgtaagggactaagtggtactagtccgtctcctccacgccctaccacccgaacgggcccctaacgttcccggttacccttccccccgtacgggtcccctaccccttccccgtacccgaaacggtccgacccgtaaccccgttccgggtaccggggggacccaaccggacccgggtacccgggtcccccggttcggggtcccgtcgggtacccccggg

SEQ ID NO: 229054 - DNA, 527 bp, Homo sapiens
  misc_feature: GYAE6OF01A1W5T.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagtctttgaattttggggaccaagggacaatggtcatcgtctcctcagcctccaccaacgggcccatccggtccttccccctggccaccctcctccaagcgcacctcgtggggccacgacgccggccctgggctggtcccg

SEQ ID NO: 229055 - DNA, 585 bp, Homo sapiens
  misc_feature: GYAE6OF01BP2EH.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaaccgagtggaggtggtgcagagtacgcccagaggttcagggcagagtctccatgaccagtgacacgtccgcgagcactgtctatatggagatgaggagcctgagacttgacgacacggccgtatattactgtgcgagaatcgaagaggtggactacaatcgaacggtagtcttttagtaagttttggggaccgtaagggacaagtggtctagtcgtctcctcacgccctaccgaccgaacgggtcccacgtccggttaccttcccccgtcggtcccaccccttccctacccgaacggaccgccgaacccgtccgggacggggaccaccgacggcccgggaccccgtcggggcccgtcggtcccgg

SEQ ID NO: 229056 - DNA, 573 bp, Homo sapiens
  misc_feature: GYAE6OF01AG08N.8.37.D04.1.454.CMB.1.raw
  modified_base (319)..(319): a, c, t, g, unknown or other
  misc_feature (319)..(319): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggngcctgagacttgacgacacggccgtatattacgtgtgcgagaatcgaagaggtgactacatcacggtagtctttagtaatttggggacgaagggtacaagtggtcatcgtctctccacgccctaccaccgaacgggccctacgttccgtcccgttccccctcggccctacccctccctacccaacgacgacccgtaccgtcccggtcggggaccaccggacggcccggaccccgtcggggtccgtcggtcccgg

SEQ ID NO: 229057 - DNA, 539 bp, Homo sapiens
  misc_feature: GYAE6OF01A86F1.8.37.D04.1.454.CMB.1.raw
tcagctcgcgtgtccacgaccggtgctcgatttagtagcatactgttgggtttggggatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcagtgaagatttcctgcaaggcgtccggatacaggttcaccgccgtctatattaattggctgcgacaggcccctggacaagggcctgagtggagtggggagaatcgaacccgagtggaggtggtgcgagagtacgcccagaggttcagggcagagtctcatgaccagtgacacgtccgcgagcactgtctatagtggagagtgaggagccgtgacgtactaggacgacgacggaccgtatacgttactgtgacgaagaagtcggaaggaagggtcgactaacgaactacgaacggagttacgtttgtaagtttacggggg

SEQ ID NO: 229058 - DNA, 666 bp, Homo sapiens
  misc_feature: GYAE6OF01AZH51.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggttcagggcagagtctccatgaccagtgacacgtccgcgagcactgtctatatggagatgaggagcctgagacttgacgacacggcctatatactgtgcgagaatcggaagaaggtggactacaatcgaacggtagtcgttttagtaagtttttgggggacccgtaaaggggtaacctaaagttacgggtacctaagttccgttccttccctaccgtacgtccccttacccgacccgaaaccggggtccccctaagttccccgggttacccgtttcccccccgttcgggacccccgtacccccttaccccgttaccccgaaacgaccgtacccgaaccccgttccggtaccggggggtacccaaccggtaacggtcccgggaccccgtacggggtcccgtcggtaccccggg

SEQ ID NO: 229059 - DNA, 574 bp, Homo sapiens
  misc_feature: GYAE6OF01CKOE5.8.37.D04.1.454.CMB.1.raw
  modified_base (215)..(215): a, c, t, g, unknown or other
  misc_feature (215)..(215): n is a, c, g, or t
  modified_base (382)..(382): a, c, t, g, unknown or other
  misc_feature (382)..(382): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgccagaggttcagggcagagtctccatgaccagtgacacgtccgcgagcactgtctatatggagatggaggagcctagagacgttgacgacacggccgtaatatactgtgacgagaagtcgaaggaggtgactaanaatcgaacggtagtacgtttagtaagttttacggggaacgtaagggacgtaagttacggtacagttccgtctcctcgacgccctacccaccgaacgggccctaacgttccgtccctccccgtcgcctaccctcctaccaacgtccgacaccgtcgcggggaccacgtacggccgccgtcgggctcggtaccg

SEQ ID NO: 229060 - DNA, 593 bp, Homo sapiens
  misc_feature: GYAE6OF01B3J1T.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtgatggggagaatcaacccgagtggaggtggtgcagagtacgcccagaggtttcaggcagagtctccatgaccagtgacacgtccgcgagcactgtctatatggagatgaggagcctaggagacttgaccgacacggccgtaatattactgtgcgagaatacggaagtaggtggactaacagtacgaggtagtcgtttagtaacgttttggggaccgtaagggacgaattacggtactactccgttctacctcgacgcccgtaccgaccgaacgggtccctacgtacccgttccttcccccgtggtccctaccctcccctaccaacgaccgtcccacctccggtacggggcctaccgaaccggccggcccgtcggggcctcggtcccgg

SEQ ID NO: 229061 - DNA, 524 bp, Homo sapiens
  misc_feature: GYAE6OF01A7E81.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatgtagatgagagcctgagacttgacgacacggccgtatatactgtgcgagaatcgaaagaaggtggctacaatcacggagcttttgaattttggggaccaaggggacaagtggtcatcgtctcctcagcctccaccaacgggcccattcggtcttcccctggccacctcctccaaacgcgcacctcgtggggcacgagcggaccctcgggctgcccg

SEQ ID NO: 229062 - DNA, 779 bp, Homo sapiens
  misc_feature: GYAE6OF01BYF1L.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtccgtggggcctcagtgaagatttcctgcaaggcgtccggatacaggttcaccgccgtctatattaattggctgcgacaggcccctggacaagggcctgagtggagtggggagaatccaaccgaggtggaggtggtgcgagagtacgccaggtaggttcgagggcaggacgtcctaccatcgaccgagtcgacgaccgtccggacgagctacgtcgtactatagtaggagtagtggaggacgtcgtagacgtactacggaacgaccggtaccggtacgttaacttacgttacgtggtacgacggtaagtaacgtaaggtaaacgggtaagggtacggaactaacgtaacggttacggaacgggttacgttttacggttttaaggtttaacggggtttacgggaaaccgggtaaacgggtaacgtaacggttacggttaccgttacgttacccgttcccttacccgtaccgtacccgtaccccgtaacccggaacccggtaacccgggtaccccgttaccggttaccccggtttcccccttaccccggtaccgtacccccgttacccctcccgtaaccggtaaccggcccgttacccgtacccgggttccgggaccgggtacccgaccgggtaccgggcccgggtacccgggtcggtcccggtccggtaacccggg

SEQ ID NO: 229063 - DNA, 635 bp, Homo sapiens
  misc_feature: GYAE6OF01BWJCI.8.37.D04.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacacggcccctggacaacgggcctgaggtggagtaggggagaactcgaaccgagtgggaggtggtgcgaggagtaccgcccgagtacggtttccgaggggccaggacgttcctccatcgaccagtgaccacgtccgcgagcactgtctatcnggangtgaggacgccgtgacgtacttggacgacgacggctatacgttctgtcgacgagaagtacggaaagtaagggtcgactaacgaactacgaacggtagttcgttttaggtaacggttttcggggaccgtaaaggggaactaaggtcggtacacgttacgtctacccgtcacgtcccgtacccacccgaacgggtcccacgttcccggtcccttccccgcgtcccacccctccgtaccgaacgtcgcccacccggtcggtacgggcaacccggagcccggtcccgcggtccgtcggtaccgg

SEQ ID NO: 229064 - DNA, 602 bp, Homo sapiens
  misc_feature: GYAE6OF01A16GD.8.37.D04.1.454.CMB.1.raw
  modified_base (378)..(378): a, c, t, g, unknown or other
  misc_feature (378)..(378): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaaccgagtgggaggtggtgcagagtacgcccaggaggtttcagggcagagtctccatgaccagtgacacggtccgcgagcactgtctatatggagatggaggagctgagacttgacacgacggcctatatactgtgcgagaatcgaagaaggtgactanaactcgacgtagtacgttttgtaagttttggggacctaagggacgtaagtggtacagtccgtctcctcacgtccctccgaaccgtaacgggcccacgttccggttcccttcccccgtcggccctaccccgttcccgtacccgaaacgtaccgacctaccccggtccgttccgggggaccacgggtaaccggcccggccccggtcgggccgtccgggtacccggg

SEQ ID NO: 229065 - DNA, 795 bp, Homo sapiens
  misc_feature: GYAE6OF01EABW4.8.37.D04.1.454.CMB.1.raw
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccgatacaggttcaccgccgtctatattaattggctgcgacncggcccctggacaagggcctgagtggagtgggganaactccgaacccggaggtgggaggtggtgcgagacgtacgccgaggtaggttcgagggcagagtcctccatcgaccagtcgacacggtccgcgagccacgttgtactatagtgggagtatagggaggagccgtaggacgtacgttagaccggaaccgtaccgggacccttaattaacgtttacgtggttacggacgtaaggtaaacgtacgggaaaaaggtacgggttacggaaccttaaaccgaagttaccgtaacggggttacgtttaccgtttttaagggttaacgggtttttacgggggaaccggtaaaggggtaccgtaaaggttcgggtacctacgttacccgttcccttaccctccgtacgtaccccgtaacccggaacccggtaaccgggtaccccgtaccggtttccccggttaccccgttccccccggtaccgtacccctacccccgttaccccgtaacccgaaccggtaccgtaccccgtaccggttcccgggaccgggggtacccaacccgggtcccgggacccggtacccccgggttacgggtcccggtccccggttaacccgggg

SEQ ID NO: 229066 - DNA, 558 bp, Homo sapiens
  misc_feature: GYAE6OF01BBJ55.8.37.D04.1.454.CMB.1.raw
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtgggaggtggtgcagagtacgcccagaggtttcagggcagagtctccatgaccagtgacacgtccgcgagcactggtctatatggagatgaggagcctgacgtacttgacgacacggcccgtatagttactggtgacgagaatcgaaacggaaggtggactactaatcgaaggagtacttttaggtaagtttggggacgtaagggacaagtggtcatcgtctctcngcctccaccgacggcccacgttccgtccttccccgcgccnccctcctaccgaacgngcccnccgtcgcggggccacgacggccggacccgtgggcgtcgtcccgg

SEQ ID NO: 229067 - DNA, 818 bp, Homo sapiens
  misc_feature: GYAE6OF01DQ3VW.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacacggcccctggacaagggcctggagtggagtggggagaatccaacccggagtgggaggtggtgcagagtaccgcccaggtaggttcgaggggcagacgtctccatgacctagtcgacgaccgtccgcgagcactgtactatagtggagagttaggacggtagcctagacgtacttgacgacgacggacttatattacgtggtagacgagtaaagtcggaaaggtaagggtacggactaacgtaaactaccggtaaccgggtagtttaccggtttttaaggttaacggttttttaacggggggaaccggtaacggggtaaccgtaaaggttacgggttaccttaacggtttcccggttacccgtttaccctacccggtaaccgtacccccgttaaccccgtaaccccggaaaacccggggttccccaaccggttttacccgggtttccccccgtttaccccccgtccggggtaacccccttaccccccggttccccgttaaaccccgaaccgggtaacccgtaccccgttaacccggtttcccggggtacccgggggggtaccccaacccgggtaaccccggggtaccccggggtccccccggttacgggggtccccgttccgggttaacccccgggg

SEQ ID NO: 229068 - DNA, 681 bp, Homo sapiens
  misc_feature: GYAE6OF01CODQ6.8.37.D04.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (320)..(320): a, c, t, g, unknown or other
  misc_feature (320)..(320): n is a, c, g, or t
tcagctcgcgtgtccacgaccggtgctcgatttagtagcatactgttgggtttgggtgcccaagctgctggagggcacggtcaccacgctgctgagatgaagagtccgtggggcctcagtgaagatttcctgcaaggcgtccggatacaggttccaccgccgtctatattaattggctgcgacacggcccctggacaagggcctgagtggagtggganaatcgaaccgngtggaggtggtgcagagtaccgcccaggtaggttcgagggcagagtctccatgaccagtgacacgtccgcgagcactgtctatagtggagngtagaggacgccgtgacgtacttcgaactaacgaccggtacgtaattacttacgtgtggacgagaaagtacggaaaggaaggtcgactaacgtaacgtccgaacgggtacgttcgttttagttaacggttttcggggaccgtaaagggaacgtaagttggtaccacgttccgtcttccctacgtacgacccctacccgaacccggtaaccgggtccccgtacgttccccggtttccccttaccccccggtcggacccctacccccgttccctacccgaaaccggccgtacccgaccccgtcgggtaccggggccaaccggtccgggcccggaccccgtcgggtaccgtccggtaccccggg

SEQ ID NO: 229069 - DNA, 678 bp, Homo sapiens
  misc_feature: GYAE6OF01AGQ1R.8.37.D04.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacacggcccctggacaagggcctgagtggatggganaatcaaccgngtggaggtggtgcagagtaccgcccagtaggtttcgagggcagagtcctccatgaccagtgacacgtccgcgagcactgtctatacgtggagagttggaggacgtacctaggacgtactttcggaaccggaccgaaccgggtccctaagttacgttacgtgttcgaccgtagtaaagtcggaagtaagggtggactaacgaacgtacgaacggtacgttcgttttagtaaggttttacgggaccgtaaagggtactaagttggtctagtaccgttctaccgtcctacgtccctaccgaaccgtaccgggtaccctacgttcccgttcccgttcccccggtccgtacccctaccccgtacccgtaccgaaccgtaccgacccgtacccggtcggttaccggggaccgtaaccgtaccgggcccggtacccggtcgggtccgtccgtaccccggg

SEQ ID NO: 229070 - DNA, 609 bp, Homo sapiens
  misc_feature: GYAE6OF01DCFNM.8.37.D04.1.454.CMB.1.raw
  modified_base (253)..(253): a, c, t, g, unknown or other
  misc_feature (253)..(253): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagnggtttcaagggcagagtctccatgaccagtgacacgtccgcgagcactgtctatatggagatgaggagccgtagagtacgttgacgacgaccggtaccgtattacttactggtcgacggaagaagtacggaaaggtaagggtcggactaacgaactcgaacgggtagtcgtttttaggtaagtttttcggggacgtaagggactaagtcggtacgattccgtctcctcacgtcctcccgaaccgaacgggtcccagttccgtcccttcccccgtaggccctaccctccctaccgaacgcgtaccacccgtcggcggggtaccacgacggaccggcccgtcgggccgtcggtcccgg

SEQ ID NO: 229071 - DNA, 781 bp, Homo sapiens
  misc_feature: GYAE6OF01DB5JN.8.37.D04.1.454.CMB.1.raw
  modified_base (228)..(228): a, c, t, g, unknown or other
  misc_feature (228)..(228): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacacggcccctggacaagggcctgagtggagtggggagaatcaacccgngtggaggtggtgcagagtaccgccgagtggttgaggcaggagtctcatcgacagtgaccacgtccgcgagcactgtctagtagtggagtagtagaggaacgccgtaggacgtaacgttacggaacggaaccggtaccgggtaccgttaagttaacgtttaaccgtaggttacggaccggtaaaggtaaacgtacgggtaaaaggtaaacggggtcgggaacctaacgtaactaccggtaacgggtacgttacgttttaggttaacgttttacgggaacggtaacgggtaactaagtcggtactagttccgttaccgtacctaccgacgtcccgtaacccgaacccgtaaccggggtccctaacggttccccggttaccccgttccccccggttacggtaccccgtaaccccccgttacccgttaacccggaaaccggtacccgtacccgttaaccccggtttccggttaccgggttaccgggtaaccccggtaccggtaaaccgggtcccccggggttaccccggtcccgggggtcccgtttaaccccggggg

SEQ ID NO: 229072 - DNA, 700 bp, Homo sapiens
  misc_feature: GYAE6OF01ESWUB.8.37.D04.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
tcagctcgcgtgtccacgaccggtgctcgatttagtagcatactgttgggtttgggtgcccaagctgctggacgggcacggtcaccacgctgctgagatgaagagtcctggggcctcagtgaagactttcctgcaaggcgtccggatacagttcaccgccgtctatattatggctgcgacacggccctggacaagggcctgagtggagtggganaatccaaccgngtggaggtggtgacagacgtaccgcccgtaggtaggtttccgagggccaagacgtcctccatcgaccaggtcgaccgacggtcccggacgacgcctaacgttgtacctaagtacgtagggacgtagtggaggtacgccctaggactacgttagaccgacgacggtccgttaatcttacgtgtaggcgaagtacgacggtaaagagggttcaacctaacgtaactaccgaacgggtatttacgttttaggtaaacggtttcgggaaccgtaaaggtacctaggtcggtactacgtccgtactccctacgacgtccccgtaaccgaaccggacccgggtaccctaccggtttccccggttacccttcccccggtcggtaccccctaccccgtaccctaacccgaacgtcccgtaccgtacccggttcgggtccggactacccggacggtcccggaccggtcgtccgtcgtacccggg

SEQ ID NO: 229073 - DNA, 648 bp, Homo sapiens
  misc_feature: GYAE6OF01A2YX8.8.37.D04.1.454.CMB.1.raw
  modified_base (131)..(131): a, c, t, g, unknown or other
  misc_feature (131)..(131): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
tcagctcgcgtgtccacgaccggtgctcgatttagtagcatactgttgggtttgggtgcccaagctgctggagggcacggtcaccacgctgctgagatgaagagtccgtggggcctcagtgaagatttccngcaaggcgtccggatacaggttcaccgccgtctatattaattggctgcgacacggccccgtggacgaagggcctgagtggagtgggagaataccaacccgagtggaggtggtgcgagacgtaccgccgagtaggttcgagggtcgagngtcnccgagtcgaccagtcgacncggtccgcgagcactgtctatagtggatagngagncgtagagtacgtgacgaacgccggtacgtatacgttactgtgagaagagtaacggaaggtaggtacgactaacgatacgacgagttagtttagtaagtttcgggaaccgtaaggaacgtaagttacgtcacgtttccgtacctccgtcaccgtacccacccgtaaccgtaaccgggtacccctacggtttccgtacccccgtttccccgacgtacccctaaccccttccgtacccgaaccgtaccgaccctacccggtccggtacggggacctaccggcccggccggtacccggcggtcgtcggtacccgg

SEQ ID NO: 229074 - DNA, 877 bp, Homo sapiens
  misc_feature: GYAE6OF01BLMH8.8.37.D04.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
tcagctcgcgtgtccacgaccggtgctcgatttagtagcatactgttgggtttgggtgcccaagctgctggagggcacggtcaccacgctgctgagatgaagagtccgtgggcctcagtgaagatttcctgcgaaggcgtccggatacaggttcaccgcgtctatattaattggctgcgacaggccctggacaagggcctgacgtggacgtgggganaactccgaaaccgngtggaggtgtgcagagtacgaccgagtagttcgaggtcagacgtcgtaccagtacgtaaccagttcgaacgtaccggtccgacgtacgactactacggtactaacgtagtacggagtaagtggaacggtacgtccgtagaacgtaacgttcggaaaccgaaccgtacggtaccgttaattacgtttaacgtaggttacgacggtaaaggtaaacttaacgggaaaagggtaaagggtcggtaaccgttaaaccgtaacgttacccgtaaacggggttaacgtttaccggttttttaagggtaaaccgggtttttacggggggaaacccggtaaaaacggggttaaccgttaaacggttcggggttaaacccttaacgtttacccgggttaccgttaccccgtaaccgtaacccggtaaccccgttaccccggaaaccccggttaaaccgggggtacccccctaacgggtttccccgggtttaccccgttaccccccggtaccgggtaccccttaaacccccgttaccggtaaacccgaaaccggttccgtaaccccggtaccggttccggggaacccggggtaccaaacccgggtaccgggtacccggaccccggtttacggggaccctccgggttaaaccccggg

SEQ ID NO: 229075 - DNA, 748 bp, Homo sapiens
  misc_feature: GYAE6OF01CULWS.8.37.D04.1.454.CMB.1.raw
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaatggctgcgacnggcccctggacgaagggcctggagtggagtggggagaatcgaacccggngtggaggtggtgcgagacgtaccgcccgaggtacggttcgagggcagacgtctccatgaccagtcgacacggtccgcgagccacgtcgtactagtagtggagagtaggaggacgccgtaggacgtacgttcgacgtaccgaccggtaccgttaattacgtttacgtggtcgacgagtaagtacggaaggtagggtcgactaacgtaacgtcgaacggttacgttacgttttacggttaaggtttcggggaaccgtaagggtactaaggttcgtacctacgttccgttacctcccgtacgtaccgtacccctacccggaacccggtaaccgggtcccctaccggtttccccggttacccccgtttcccccggtaccgtaccccctacccccgttaccccgtacccgtaaccggtacccgtaccccgttaccccggttaccgggtcccgggggaccctaacccgggaccccggggtaccccggtccccgggttccgggtcccgtcccgggttaccccggg

SEQ ID NO: 229076 - DNA, 754 bp, Homo sapiens
  misc_feature: GYAE6OF01EOVKI.8.37.D04.1.454.CMB.1.raw
  modified_base (310)..(310): a, c, t, g, unknown or other
  misc_feature (310)..(310): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacacggcccctggacgaagggcctgagtggagtggggagaactcaaccgagtggaggtggtgcgagacgtacgcccgtagtaggttcgagggcagtagtcctccatcgaccagtcgactccgtccgcgganccacttgtactagttagtggagagtggaggacgtcgtaggagtaccgttggaacgtacgttaccggaccgtttaatactttacgtggtacgacggaaagtaacgtacggaaaaggtaagggtacggaccgttaacgtaagtcccggtaacgggtacgtttaccgtttttaggttaaacgggttttcggggaacccgtaaaggggtaactaaggttacggttaccgtacgttccgtccgttccctaccgtaccgacccgttacccgaacccggaccgggtcccgtaccggttccccggtttcccccgttacccccgtaccggtccccttaccccccgttacccgtacccgtaaccgtcccgtacccggtacccggttcggggtacccggggaccctaccggcccgggtacccgggccccggtcggggtcccgtccggtacccggg

SEQ ID NO: 229077 - DNA, 747 bp, Homo sapiens
  misc_feature: GYAE6OF01A7VUN.8.37.D04.1.454.CMB.1.raw
  modified_base (131)..(131): a, c, t, g, unknown or other
  misc_feature (131)..(131): n is a, c, g, or t
  modified_base (246)..(246): a, c, t, g, unknown or other
  misc_feature (246)..(246): n is a, c, g, or t
  modified_base (373)..(373): a, c, t, g, unknown or other
  misc_feature (373)..(373): n is a, c, g, or t
  modified_base (458)..(458): a, c, t, g, unknown or other
  misc_feature (458)..(458): n is a, c, g, or t
tcagctcgcgtgtccacgaccggtgctcgatttagtagcatactgttgggtttgggtgcccaagctgctggaggcacggtcaccacgctgctgagatgaagagtccgtggggcctcgagtgaagatttccngacgaacggccgttaccggatacgacggttccacccggtccgtattaatattaacgttggcttggacgacgacggtccccgtaggacaagggccttggaacggtggagtgggganaacgtccgaaccggtaggtgggtaacggttggacgacgagtacggtaccgaccgaaggtaggttccgaggggcaggtaacgtcctaccgagtccggaccacggttacgacgaccggtccgacggacncgtaactcggtactagtagtggagtagtggagacgccgtgaacgtacgttggacgaccgtacggtacccggtattacgttaccgngttacggacgtaacgacgttaaggaaagtaccgggtagactaacagtaccggacggtacgttcgtttaagttacgggtttcgggacgtaaacgggtacgtagttacgactagtccgtactcccgtacgcgtacccgtacccaacggtaccgtacccgtaacgtccgttacccgttcccccggtacgccccgtacccgtacccgttaccgaaccgtaccgtacccgtaaccgtcggtaccgggtaccaccggttacgccccgggtacccgcgggtccgtcggtaccccgg

SEQ ID NO: 229078 - DNA, 773 bp, Homo sapiens
  misc_feature: GYAE6OF01B1701.8.37.D04.1.454.CMB.1.raw
tcagctcgcgtgtccacgaccggtgctcgatttagtagcatactgtttgggtttgggtgcccaagctgctggagggcacggtcaccacgctgctgagatgaagagtccgtgggcctcagtagaagtatttcctgacgaaggcgtaccggatacgaggttccaccgccgtatatattagttggctgcgacacggcccctaggacgaaggcctaggaggtggaggtaggggagaataccgaaacccggaggtagggagggtggtagacgaggacgtaccgaccgaggtaaggttcgaggacgagacgtacgtactatacgaaccgagtacgacgaccgtaccggacgacgacctacgttacgtactatagtaggagagtaggaggacgacgtagagtagtaccccccccccccccccccccccccccgaagaccgacggtacgtaacgttacttacgtagtagacgaagtaaagtaacggaaaggtaagggtacggtaccgtaacgtaacgtaccgtacggttagttacgttttacggttaacggtttaacgggtaaccgtaacggaacgtaagtacggttacgtacgttacgttaccgttaccgtaccgtaccgtaccgtacccgtaacccgaaccggtacccgtaccgttacccgttacccgttccccgtacccgtacccgtaccctaccctaccgaaccgtaccgtaccgtaccggtaccggtaccgggaccgaccgaccggaccggacccggtcgggtccgtcggtaccgg

SEQ ID NO: 229079 - DNA, 916 bp, Homo sapiens
  misc_feature: GYAE6OF01CVF1O.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtccgtggggcctcgagtgaagtactttcctgcgaaggcgtaccggatacgaggttccaccgtccgtacttattattaagttggctgacgtaccgacggtccccgtaggaacgaacgggtcctaggtaggtagggtaggtaggggaagtaaccgtaaccgaaaccggtagggtagggtaagggtgggtacggcgaacggtaacggtaccggacccgtagggtacggttacggagggacgacgtacgtcctaaccgtagtacgaccgtagtacgaaccgtaccggaccgacgacgtactacgtcgttacttagtaggtaggtagtaacgtggaacggtacggcgttaaggacgtacggttaccgaaccggtaacgacgggttaccgttaaagttacgttacggtaggtacggtacgggaaacgtaaacgttaacgggaaaggtaacgggttacggtaaacctaacgtaaacgtaccggggttaaccggtaaggtttttacggtttaaagggtttaacgggtttaaccggggaaacggtaaacgggtaacgttaacggttacggttaccgtacgttacccgttaccgttacggaaccctaccgttacccctaaccgggtaacccgaacccggttacccgttaaccggttccccgtttaccccgttaccccggtaccggtacccctaacccccggtacccgttaaacccggaaccggtaacccgttacccgggtacccggtcccggggtacccgggaacccgtacccggacccgggtaccccgtaccgggtcgggccgttcccgggttaacccggg

SEQ ID NO: 229080 - DNA, 602 bp, Homo sapiens
  misc_feature: GYAE6OF01ADHZI.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcgagagtacgcccagaggtttcagggcagagtctccatgaccagtgacacgtccgcgagcactgtctatatggagatggaggagcctgagacttgacgacacggccgtatattacgtgtgcgagaactacggaagaaggtggactaacgaatcgaacggtagtcgttttagtaagtttttacggggaccgtaaagggactaagtggtctagtccgtctcctacacgtccctacccaccgaacggtccctacgttccggttacccttcccccgtacggtccctacccctcccgtaccgaacgaccgtacccaccgtcggtcggggaccaccgtacggcccggacccgtcgggtcctcggtcccgg

SEQ ID NO: 229081 - DNA, 813 bp, Homo sapiens
  misc_feature: GYAE6OF01C12IO.8.37.D04.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
tcagctcgcgtgtccacgaccggtgctcgatttagtagcatactgttgggtttgggtgcccaagctgctggagggcacggtcaccacgctgctgagatgaagagtccgtggggccctcagtgaagtatttcctgcaacggcgtccggatacaggttccaccgccgtctatattattggctgcgacacggcccctggacaggcctgagtggagtggganaagtccaaccggngtcggaggtggtgacgagacgtaccggacccaggtacggttacgagggtcgaagacgtcctacccgagtcgaaccgtaggtacgaccgtaaccggtccgcggacgcctacgtcgttactagtagtacggaagtagtaggaagggtacgcccgtaggacgttacgttacggacccggtaaccgtaccggtacccgttaattacttaaccgttggtaccggtacggtaaggtacgttaacgggaaagggtaacgggtacggaccttaaacaaggtaccgtaacggggttacgtttacgttttaacgggttaacgggttttacggggaaccggtaacgggtaccgtaaggttcggaacttcgttaccgttacgtaccccgtacgaccgtacccctaacccggttaacccggaccgggttaccccaccggtttccccggtttccccccgttaccccggttacccggacccccttacccccgtacccgttacccgtaacgggaccgttacccgtaccccgggttacggtccggggaaccgtccgaccggggtaccccggtacccgtcgggtccgtcgggtaccccgg

SEQ ID NO: 229082 - DNA, 754 bp, Homo sapiens
  misc_feature: GYAE6OF01BPSFV.8.37.D04.1.454.CMB.1.raw
tcagctcgcgtgtccacgaccggtgctcgatttagtagcatactgttgggtttgggtgcccaagctgctggaggcacggtcaccacgctgctgagatgaagagtccgtgggcctcagtgaagatttcctgcaaggcgtccggatacgaggttcaccgccgtctatattaattggctgcgacacggcccctggacaagggcctgagtggagtgggagaagtccgaacccgagtggaggtggtgcgagacgtacgcccgtaggtacggtttcgagggcaaggacgttcctccagtacgaaccgtagtacgacctaccggtcccgacgacgccgtacgtgtaccttaagtagtaggaagtagtaggaaggacgtaccgtagaacgtaccgttacgaaccggaaccgaccggtaccgttaagttacgttaacgtgtacggacgtaagtaacgtacggaaaggtaaggtcgaactaacgtaacgtacggtaaccggttagttacgttttaggttaacggtttacgggaaccggtaaacgggtacgtaaggttcggtaacctcgttaccgtccgttaccctaccgacgtacccctacccgaacccggaaccggtacccctacggttacccggttcccccgttaccccgtccggtaccctacccccttcccgtaacccgaagcccgtacccgtaccggtccgggaccggggtaccgaccgtaccgggcccggaccccggtcggtcccgtcggtaccccggg

SEQ ID NO: 229083 - DNA, 802 bp, Homo sapiens
  misc_feature: GYAE6OF01B82U1.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtccgtgggcctcagtgaagtactttccgtgacgaacgggcgtaccggatacaggttccacccgtccgtactataattaagttggctggaccgaccgaccggccccgtaggaaccgaagggtcctggaggtaggaggtggggaagtaacgtaccgaaacccggtagggtcgggagggtggtgacgtaaggacggtaccgccgaggtacggttcgagggcgtagacgttccaccgatacgacagtacgaccgtccgacgacgacgtcctaccgtgttactagtacggtaggagtaggtgacggacggtaccgtaggtacgtaccgttacggaccgtaccggtacggtacgtaacttacgttacgtggtacgagtaacgtaaagaccggaaggtacggtacggtacctaacacgtaccgtaaggtacgtttacgttttacggtaagggtttaccgggaacggaacggtaacgtaagttaccgggtactacggttccgttccgtacctaccgtaccgaccccgttaacccgtaacccggacccggtaacccgtaccggtttccccgttaccccgtcccggtacccgtcccctacccgttacccgtaacccggtaccgtaaccggtaccgtacccggtaccgggtccggacccgaacccggtaccggccccgggtaccggtaccggtcggtccggtacccggg

SEQ ID NO: 229084 - DNA, 549 bp, Homo sapiens
  misc_feature: GYAE6OF02H4JZ2.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggtttcagggcagagtctccatgaccagtgacacgtccgcgagcactgtctatatggagatgaggagcctgagacttgacgacacggccgtatattactgtgcgagaatcgaagaaggtggactacaatcacggagcttttgaattttggggacctaagggacaagtggtacatcgtctctcagccctaccaccgaagggcccagttccggtaccttcccccgtcggtccacccctcctccctaacgcgccacctccgtcggggccacgacggccggtccccgtgggcctggtcccg

SEQ ID NO: 229085 - DNA, 527 bp, Homo sapiens
  misc_feature: GYAE6OF02G32KL.8.37.D04.1.454.CMB.1.raw
  modified_base (352)..(352): a, c, t, g, unknown or other
  misc_feature (352)..(352): n is a, c, g, or t
  modified_base (505)..(505): a, c, t, g, unknown or other
  misc_feature (505)..(505): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattacngtgcgagaatcgaagaaggtggactacaatcacggagcttttgaattttggggaccaagggacaagtggtcatcgtctcctcacgcctccaccaacgggcccatccgtcttcccctgccaccctccaccaagacgccacctctcggggcacgnggccgcccgtgggcctgtcccg

SEQ ID NO: 229086 - DNA, 526 bp, Homo sapiens
  misc_feature: GYAE6OF02GHFTO.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagctttgaattttggggccaagggacaatggtcatcgtctcctcagcctccaccaagggcccatcgtcttcccctgtccacctcctccaacgacgcaccctcgtcgggggcacgacggccggcccgtgggcctggtcccg

SEQ ID NO: 229087 - DNA, 529 bp, Homo sapiens
  misc_feature: GYAE6OF02GC8BL.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggcctatattactgtgcgagaatcgaagaaggtggctacaatcacggagcttttgaattttggggccaagggacaagtggtcatcgtctcctcagcctccaccaagggcccatcggtcttcccctgccacccgtcctccaagacgccaccctcgtcggggccacgacggccggccctcgggcctgtcccgg

SEQ ID NO: 229088 - DNA, 570 bp, Homo sapiens
  misc_feature: GYAE6OF02H6ZXD.8.37.D04.1.454.CMB.1.raw
  modified_base (286)..(286): a, c, t, g, unknown or other
  misc_feature (286)..(286): n is a, c, g, or t
tcagctcgcgtgtccacgaccggtgctcgatttagtagcatactgttgggtttgggttgcccaagctgctggagggcgacggtcaccacgctgctgagatgaagagtcctggggcctcagtgaagatttcctgcaaggcgtccggatacaggttcaccgccgtctatattaattggctgcgacaggcccctggacaagggcctgagtggatgggggagaatcaaacccgagtggaggtggtgcagagtacgccagaggtttcagggcagagtctccatgaccagtnacacgtccgcgagcactgtcatatggagatgaggagcctgagacttgacgacacggccgtatataactgtgcgaagaatcgaaagaaggtggactacaatcaacggagtcgtttgtaaagttttggggacgaaggtaacaagtggtacatcgtctcctcagcctaccactaacgggccagtccgtccttaccccgcggtcctaccctcccttcccgaacgcgacccaccttaccgtcgggggtacctacgaaccggccggtcccgtcgggtctaccggtcccgg

SEQ ID NO: 229089 - DNA, 554 bp, Homo sapiens
  misc_feature: GYAE6OF02G8OT7.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagtcttttgaattttggggaccaaggggacaagttggtacagtcgtctcctcagcctcccaccgaacgggcccaagttccgggtccttccccgtggcccacccctccctaccaacgcgccacccgtcgcggggccaccgacggccggccccgtgggcctcggtcccgg

SEQ ID NO: 229090 - DNA, 573 bp, Homo sapiens
  misc_feature: GYAE6OF02ICYBB.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatgggggagaatcaacccgagtgggaggtggtgcagagtacgcccagaggtttcagggcagagtctccatgaccagtgacacgtccgcgagcactgtctatatggagatgaggagcctgagacttgacgacacggcctatattactgtgcgaagaatcggaaagaagggtcggactacaatcgaacggagtcttttagtaagttttgggaccgtaagggacgaagttggtcatcgtctcctcgacgcctaccgaccgaacggacccgagtccgttcccttccccgtcgccctacccctccctacccaacgacgaccaccgtccgtcggggaccacgacggccggcccgtcggggcctggtacccgg

SEQ ID NO: 229091 - DNA, 528 bp, Homo sapiens
  misc_feature: GYAE6OF02GCD5C.8.37.D04.1.454.CMB.1.raw
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (508)..(508): a, c, t, g, unknown or other
  misc_feature (508)..(508): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggttcagggcagagtctccatgaccagtgacacgtccgcgagcactgtctatatggagatgaggagcctgagacttgacgacacggccgtatattacngtgcgagaatcgaagagtggctanaatcagagcgtttagaagtttgggacaagggacaagtggtctagtcgtctcctacacgcctccaccgacggccctacgtccgtccttccccgtgcccaccctcctccaagacgaccacctcgtacgggcacgngaccggcctcgggctgtccg

SEQ ID NO: 229092 - DNA, 571 bp, Homo sapiens
  misc_feature: GYAE6OF02HRNBQ.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggttcagggcagagtctccatgaccagtgacacgtccgcgagcactgtctatatggagatgaggagcctgagacttgacgacacggcctatattactgtgacgagaatcgaagaggtgctaacagtcacggagtcttttagtaagttttggggacctaaagggactaaagtgggtacaagtccgttctcctcagtccctaccaccgaacggcccagtccgtcccttccccgcggccctaccctccctccgtaacgacgccaacccgtccggtacggggaccaccggacgccggtccccggtagggtccgtcgtacccgg

SEQ ID NO: 229093 - DNA, 525 bp, Homo sapiens
  misc_feature: GYAE6OF02JGVV3.8.37.D04.1.454.CMB.1.raw
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (431)..(431): a, c, t, g, unknown or other
  misc_feature (431)..(431): n is a, c, g, or t
  modified_base (470)..(470): a, c, t, g, unknown or other
  misc_feature (470)..(470): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccncgagcactgtctatatggagatgaggagcctgagacttgacgacacggccgtatattacngtgcgagaatcgaagagtgctacaatcacgagtctttgaagttttggggaccaagggactaagtggtcatcgtctctcngcctccaccgaagggcccattccggtcttccccgtgccnccctctccagcgccactcgtacggggcacgtacggccggccctgggctcgtccgg

SEQ ID NO: 229094 - DNA, 562 bp, Homo sapiens
  misc_feature: GYAE6OF02IU6A7.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggttcagggcagagtctccatgaccagtgacacgtccgcgagcactgtctatatggagatgaggagcctgagacttgacgacacggccgtatattactgtgcgagaatcgaagaaggtgactacaatcacggagcgttttgtaagttttggggaccgtaagggactaagtggtactatcgtctcctacacgccctaccaccgaacggcccacgtccgttccttccccgtcggccctaccctccctaccgaacgacgaccaccgtccgtcggggacaccgacggcccggcccgtcgggcctcggtcccgg

SEQ ID NO: 229095 - DNA, 537 bp, Homo sapiens
  misc_feature: GYAE6OF02G1843.8.37.D04.1.454.CMB.1.raw
  modified_base (353)..(353): a, c, t, g, unknown or other
  misc_feature (353)..(353): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatgggggagaatcaacccgagtggaggtggtgcagagtacgcccagaggtttcagggcagagtctccatgaccagtgacacgtccgcgagcactgtctatatggagatgaggagcctgagacttgacgacacggccgtatattacngtgcgagaatcgaagaaggtggctacaatcacggagcttttgaattttggggccaagggacaatggtcatcgtctcctcagcctccaccaagggcccagtccggtccttccccctggccaccctcctccaacgacgccaccctccgtcgggggccacgacgccggcccgtcgggcctggtcccg

SEQ ID NO: 229096 - DNA, 555 bp, Homo sapiens
  misc_feature: GYAE6OF02F7EJ4.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaggtggactacaatcacggagtcttttgaattttggggcctaaggggacaagttggtctagtcgtctcctcacgtcctccaccgaacgggcccaagtccggtccttcccccgtgggaccctacccgtccctaccaacgacgccacctcgtcggggccacgacgccggcccgtcgggtctcggtcccgg

SEQ ID NO: 229097 - DNA, 583 bp, Homo sapiens
  misc_feature: GYAE6OF02JX7LT.8.37.D04.1.454.CMB.1.raw
  modified_base (358)..(358): a, c, t, g, unknown or other
  misc_feature (358)..(358): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggtttcagggcagagtctccatgaccagtgacacgtccgcgagcactgtctatatggagatgaggagcctgagacttgacgacacggccgtatattactgtgcganaagtcgaagaagggtgctacaatcaggagtctttagagtttagggcaagggacaagtggtacagtccggtactcctcacgcctaccaccgacggtcccacgttaccgtccgttaccccgtggtccctaccccgtcctaccgaaccggcgtacctacccgttccggtacgggggtaccaccgaacgggcccgggtaccccgtcggggtacccgttcggtaccccgg

SEQ ID NO: 229098 - DNA, 611 bp, Homo sapiens
  misc_feature: GYAE6OF02GRZFW.8.37.D04.1.454.CMB.1.raw
tcagctcgcgtgtccacgaccggtgctcgatttagtagcatactgttgggtttggggtgcccaagctgctggagggcacggtcaccacgctgctcgagatgaagagtccctggggcctcagtgaagatttcctgcaaggcgtccggatacaggttcaccgccgtctatattaattggctgcgacaggcccctggacaagggcctgagtggatggggagaatcaacccgagtagaggtggtgcagagtacgcccagaggtttcagggcagagtctccatgaccagtgacacgtccgcgagcactgtctatatggagatgaggagcctgacgacttgacgacgaccggccgtatagttactggtcgcgagaactcggaaagaagggtcggactaacaactccgaacggtaggtcttttaggaagttttcgggggaccgtaaggggacaaagttgggtacagttcgtctcctcacgccctaccgaccgaacgggccctaacgttccggttcccttcccccgtcggccctaccccgtccctacccgaacgtacgaccctacccgtcggtcgggggactacgacggcccggtaccccgtcgggacctcggtcccgg

SEQ ID NO: 229099 - DNA, 580 bp, Homo sapiens
  misc_feature: GYAE6OF02JAY78.8.37.D04.1.454.CMB.1.raw
  modified_base (354)..(354): a, c, t, g, unknown or other
  misc_feature (354)..(354): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctagagacttgacgacacggccgtatattacgngtgcgagaatcgaagaggtggctacaatcaacggtgtctttgtaagtttggggacaagggacagtaggtacagtcgtctcctcacgcctaccaccgaacgggaccctacgtccggttcccttcccccgnggtacccnccccttcccgtacccaacggtccgacctacccggtccggtacggggccaaccggccggaccggtcccgtacggggtcctcggtccccgg

SEQ ID NO: 229100 - DNA, 528 bp, Homo sapiens
  misc_feature: GYAE6OF02GXB6W.8.37.D04.1.454.CMB.1.raw
  modified_base (489)..(489): a, c, t, g, unknown or other
  misc_feature (489)..(489): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtgctacaatcacggagtctttagtattttggggccgaagggacaagtggtcatcgtctcctcagcctccaccaacgggcccacgtccgtccttcccctcgccaccctcctccacgacnccacctcgtcggggcacgacgccggccgtcggctgtccg

SEQ ID NO: 229101 - DNA, 552 bp, Homo sapiens
  misc_feature: GYAE6OF02G1L8N.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatgggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggactacaatcacggagcttttgaagttttggggacctaagggacaagttggtacatcgtctcctcacgcctaccaccgaacgggccctacgtccgttccttccccctggcccaccctcctaccaacgacgccaccgtccgtcggggcacgacggccggcccgtcgggcctcgtcccgg

SEQ ID NO: 229102 - DNA, 548 bp, Homo sapiens
  misc_feature: GYAE6OF02GYNKH.8.37.D04.1.454.CMB.1.raw
  modified_base (226)..(226): a, c, t, g, unknown or other
  misc_feature (226)..(226): n is a, c, g, or t
  modified_base (359)..(359): a, c, t, g, unknown or other
  misc_feature (359)..(359): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgngtggaggtggtgcagagtacgcccagaggtttcagggcagagtctccatgaccagtgacacgtccgcgagcactgtctatatggagatgaggagcctgagacttgacgacacggccgtatattactgtgcganaatcgaagaaggtgctacaatcacggagctttagaattttggggcctaagggacaatggtcatcgtctcctcacgcctccaccgaacgggcccagttccggtcttcccccgtggcccaccctcctcccaacgcgaccaccctcgtcgggggccaccgacggcccggcccgtcggggcctacggtcccgg

SEQ ID NO: 229103 - DNA, 556 bp, Homo sapiens
  misc_feature: GYAE6OF02ICWJW.8.37.D04.1.454.CMB.1.raw
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggtttcagggcagagtctccatgaccagtgacacgtccgcgagcactgtctatatggagatgaggacgcctgagtactgacgacgacggcctatatactgngacgaanatacgaagaggtgactananacgagtatcgtttagttagtttcgggacgtaaggactaagtgtacagtccgtctcctcacgccctaccaccgaccggccacgttccgtcccttcccgcgtacccaccctccgacacgcgacctaccgtcggtacgggcctacggacggcccggtacccggtgggtccgtcgtccgg

SEQ ID NO: 229104 - DNA, 617 bp, Homo sapiens
  misc_feature: GYAE6OF02FH1AD.8.37.D04.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (276)..(276): a, c, t, g, unknown or other
  misc_feature (276)..(276): n is a, c, g, or t
  modified_base (408)..(408): a, c, t, g, unknown or other
  misc_feature (408)..(408): n is a, c, g, or t
  modified_base (446)..(446): a, c, t, g, unknown or other
  misc_feature (446)..(446): n is a, c, g, or t
tcagctcgcgtgtccacgaccggtgctcgatttagtagcatactggttgggtttggggatccaacaaccacatcccttctctacagaagcctctgagaggaaaggttccctcaccatggactggacctggagggtcttctgcttgctggctgtagttccaggtgctcactcccaggtgcagcctggtncagtctggggctgngatgaagagtcctgggggcctcagtcgaagatttcctggcaagggcgtccggatacaggttcaccgccgtctanattaattggctgcgaccaggcccctggacaaggcctgaagtggatggggagaatcaacccgagtggaggtggtgcaggacgtacggcccaggaggtttcaggggcaggagtctccgatcgaccagttcgacncgtccgcgagccaactcgtcatatggagtactggaggngtccgtggagacgtttggaaccgtacgaaccgggtaccgttaacttaacgtttaccgtagttcggaccgaaggaacgttacggaaaggtaaacggggttgggaccgtaacggtaacgttaccgaaccggggtaagttaccgtttttagggtaacgttttttaccggggggg

SEQ ID NO: 229105 - DNA, 554 bp, Homo sapiens
  misc_feature: GYAE6OF02GIC42.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggtttcagggcagagtctccatgaccagtgacacgtccgcgagcactgtctatatggagatgaggagcctgagacttggacgacacggccgtatattactgtgagagaaatcgaagaaggtggactaacaatcacggagtcgtttagagttttggggaccaagggacaagttggtactatcgtctcctcacgtcctccaccgaacggcccagttacgtccttccccgtgccaccctcctaccaacgacgacctacctcggtcggggaccacgacgccggccccgtcgggtacctcgtaccgg

SEQ ID NO: 229106 - DNA, 693 bp, Homo sapiens
  misc_feature: GYAE6OF02IZ7C0.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatgggggagaatcaacccgagtggaggtggtgcagagtacgcccgaggtgttcgagggcaggagtctccatcgacctagtgaccaccgtccgcgacgcacgtgtctaatagtaggagtatggaaggacgccgtggacgtacttaggaccgaacgaccggaccgttattacttacgtgtcgacgtaagaatacggaaggtaacgggtgactaacaactcggaacggtacgttcgtttagtaacggttttcgggaccgtaagggaactaaggttggtactacgttccgttccgttaccctacgaccgtcccttacccgaaccggaaccgggccctacggttacccgtttccccgttcccccgtcggtcccctaccccgtcccttaacccgaacggtaccgtaccccgtacccggttccgggtaccgggggaccctaccgggaaccgggtccccggtcccgggtccggggtcgtacccggttccccggg

SEQ ID NO: 229107 - DNA, 703 bp, Homo sapiens
  misc_feature: GYAE6OF02JD93V.8.37.D04.1.454.CMB.1.raw
  modified_base (214)..(214): a, c, t, g, unknown or other
  misc_feature (214)..(214): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggganaatcaaccgagtggagtggtgcagagtacgccagacggttcaggcagagtctcgatgacagtcgacacgtccgcgagcactagtcatagtggagagtgaggagccgtgagtacttgacgtacgacggaccgtattacttacgtgtacgtgaaggtaaatacggaaacgtaagggtcggtacgtaactaaacgtccgaacggtacggtacgttttaggttaagttttacggggaccggtaaagggtaactaagttcgggtactacgttaccgtaccttccgtccgtaacgtccccgtaacccgacccgtaaaccggggaccccttaaccggtttcccgggttacccgtttaccccccgttaccgggccccgttaaccccgttaccccgttaccgaaccggtacccgtacccgtacccggtacccggttccgggggaccctaccggaaccgggtcccgggtcccgttccggggaccgttccggtacccggg

SEQ ID NO: 229108 - DNA, 876 bp, Homo sapiens
  misc_feature: GYAE6OF02JX56O.8.37.D04.1.454.CMB.1.raw
  modified_base (91)..(91): a, c, t, g, unknown or other
  misc_feature (91)..(91): n is a, c, g, or t
  modified_base (219)..(219): a, c, t, g, unknown or other
  misc_feature (219)..(219): n is a, c, g, or t
tcagctcgcgtgtccacgaccggtgctcgatttagtagcatactgttgggtttgggtgcccaagctgctggagggcacggtcaccacgctnctgagatgaagagtccgtggggcctcagtgaagatttcctgcaaggcgtccggatacaggttcaccgccgtctatattaattggctgcgacaggccccgtggacaagggcctggagtggagtgggganaatccgaaccgaggtgggagggttgggtaggccgtaaggacgttaccggaccccgaaggtacgggttttcgaggggacctaggaacgttcgttccgaatcggaaccacggtacgacgaaccggtccgacggaacgtccaccgttacggttacctagttaacggtacgggtaggtaacgttgggaacgggacggttacccgttaggggaactacggtttacggaaacgtacggaaccggtaccggtaacttacgtttaacgtggtacgtacggtaataaacggtaccggtaaagtaaagggtcggtaccgttaaacgaacggtacgaacgggtaaggtttaccgttttaaggttaaacgttttacgggggggtaaacccgtaagggttaaacgtaaagtttacgggggtaccttaacgggttccggttaaccttcccggttaccgaccggttaacccccgttccccgaaaacccggtaccggggtaccccttacggtttacccgggtaccccgttttaccccgagggtaacccccttacccccgttccgtaacccgtacggtaaccggacccttaacccgggtcggttaaccggggccctaaccggtcccgggtacccggttaccccggtacggggtccgttaccccgggtaacccgg

SEQ ID NO: 229109 - DNA, 576 bp, Homo sapiens
  misc_feature: GYAE6OF02IOFGW.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggtttcagggcagagtctccatgaccagtgacacgtccgcgagcactgtctatatggagatgaggagcctgaggacttgacgacacggaccgtatattactcgtgcgagaatcgaagaggtgctacaagtcacggagtctttagaagttttcggggactaagggaccaagttggtacaagttcgtcctcctcgacgtccctaccgaccgaacggcccaagtccggttccttccccgtcggccctaccctcccgtacccaagcggacctacccgtcggtcggggacctacgacggaccggccccgtacgggcctacggtacccgg

SEQ ID NO: 229110 - DNA, 644 bp, Homo sapiens
  misc_feature: GYAE6OF02I4JHV.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacagggcctgagtggagtgggagaactcaaccgagtggagtggtgacagacgtaccgccagaggttcgaggcagagtctcatcgaccagtgactacgtccggcgagcactcgtactatagtggagtgtacggagggacgccgtaggaacgtacgttggaaccgacgacggtacgtatagttactgtgtacgaagtaagtacggaaaggtagggtcgacgtaacgtaaagtccgaaacgggtgttaccgttttaggttaaggtttacggggaaccgtaagggaactaggttaggtctacgtaccgtctccctgaccgtcctaccgaacgaaccggtcccaggtcccgttccgtccccgtcgtacccgaccccgtccgtaccgtaacgcctccgtaccgttccggtccgggaccaccggcggtacccggtccgtacgggtcctccggtacccggg

SEQ ID NO: 229111 - DNA, 724 bp, Homo sapiens
  misc_feature: GYAE6OF02GUHD6.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggagtgggagaatcaaccgagtggaggtggtgcgagagtaccgcccgaggtacggtttcgagggacaggagtcctaccagtcgaccaagtgacaccgtccgcgagacacgtgtactatagtaggagagtagaggagccgtgagtcttagacgacgacgtacgtaatactttacgtgtggacgaagtaacgtacggaaaggaaggtgggactaacaaagtacgaacgggtagttacgtttttaaggtaaaggttttcgggggaacgtaaacggggaactaacgttcgggtacctaagttcccgttaccctaccgttaccgaccgtaccccttaccgaacccggtaacggtacccctaacgttcccggtttaccccttcccccgtacggtacccctaacccgtttaccccacccgtaaacggtcccgtacccgtaacccgttacgggtacccgggggtaccctaaccggtaccgggggaccccgtacccggtcggggttacccgtaccggtttaccccggg

SEQ ID NO: 229112 - DNA, 684 bp, Homo sapiens
  misc_feature: GYAE6OF02HR3K3.8.37.D04.1.454.CMB.1.raw
  modified_base (296)..(296): a, c, t, g, unknown or other
  misc_feature (296)..(296): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgcgtctatattaattggctgcgacagcccctggacaagggcctgagtggagtggggagaatcaacccggagtggaggtggtgcagagtacgccaggtaggtttcagggcagacgtctccgatgaccagtgacacgtccgngacgcactgtactatatggagatggaaggacgccgtagacgtacgttagacgaccgacggtaccgttaagttacttacgtgtgacgtagaaatcggaaggaaggtcgactaacaagtcgaacggtagttcttttagtaaggttttcgggaccgtaagggacgtaaagttcggtactacgttccgtcgttcctacgtacgtccctacccgtaccggaacggtcccgtaacgttcccgttccccgttaccccgtccgggttaccctaccccgttccctacccgaaaccggtcgtaaccccgttaccgttaccgggtaccggggtaacccgtaaccggtacccgggtacccgggtcccccggttacggggaccccgttcgggttaccccgg

SEQ ID NO: 229113 - DNA, 726 bp, Homo sapiens
  misc_feature: GYAE6OF02IUI22.8.37.D04.1.454.CMB.1.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacagggcctgagtggatgggagatcaaccgngtggaggtggtgcagagtacgccgagaggtttcgaggtcagagtctcatgaccgagtcgacncgtaccgcgagctactgtctatatcggatagtagaggtacgaccgtagacgtacttcggaacgacgtacggtccgtatacgtttacgtaggtcgaccgtaagtaactaacggaaggtaagggtacggtactaaacgtaagttaccgaacgggtacgttacgttttaggttaacggttttcggggaccgtaaacgggtactaagggttacggtaccgtacgttaccgtcccttaccgttaccgtaccgtacccgtaacccgtaacccggtaaaccgggtaccccttaacggttacccggttaccccgttccccggttaccgtcccttacccccgttacccgtacccggtaacggtaccggtaccgtacccgtccgggttaaccggggtaccaaccgggtacgggtacccggaccccggtacgggtccgttaccgtaccccggg

SEQ ID NO: 229114 - DNA, 757 bp, Homo sapiens
  misc_feature: GYAE6OF02JSOCG.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggagtggggagaatcaacccgagtggaggtggtgcagagtacgcccagacggttcagggcagagtctccatgaccagtcgacaccgtcgcgacgcactgtctatagtggagtagtggaggacgtccgtaggacgacgttacgaaccggacgaccggtaccgttaactaagtttaccgtggttacggacgtaagtaaacgtaaccgggtaaaggtaaacgggttacggacttaaaccgtaacgtaccgtaaacggtacggttaacgttttacgtaaagggtttttaccgggggaccggtaaacgggtaacgtaaaggttcggttacgtacgttccgtttacgtacccctcgtaccgtcccttacccacccggtaaccgggtacccgtaccggttacccgttcccgttacccccggtccgtaccccgtacccctacccgttacccgtaacggtacccggtacccgtacccggtacccgggtaccggggtacccgtaacccggtacccgggacccgggttccccggaccggggttcccgtaccgggtaccccggg

SEQ ID NO: 229115 - DNA, 609 bp, Homo sapiens
  misc_feature: GYAE6OF02HTFFO.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatgggggagaatcaacccgagtggaggtggtgcgagagtacgccagaggtttcagggcagagtctccaatcgaaccagtgaccacggtccgcgagcactgtctatatggagatgaggagcctagagacttgacgacacggcgtatattactgtgcgagaatacggaagaagggtggactaacaactacgaacggtagttacgttttagtaaggttttcggggaccgtaaagggtactaagtcggtacagttccgtacctccctacacgtccctacccaccggtaacggcccacgttccgttcccttaccccgtcggaccctacccgtccctaccgaacgcgtacccaccgtaccggcggggtaccacggcggacccggtcccggtcgggtcctcggtcccgg

SEQ ID NO: 229116 - DNA, 645 bp, Homo sapiens
  misc_feature: GYAE6OF02GTGX4.8.37.D04.1.454.CMB.1.raw
  modified_base (213)..(213): a, c, t, g, unknown or other
  misc_feature (213)..(213): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagattcctgcaaggcgtccggatacaggttcaccgccgtctatattaattggctgcgacaggcccctggacaagggcctgagtggatggganaatcgaacccgagtggaggtggtgcagagtacgcccagaggtttcagggcagagtctccatcgaccagtgacacgtccgcgacgcactgtctatagtcggagatgaggacgcctaggagtacttggaacgaccgacggccgtattactttaactggttacgcgaagaagtccggaaaggaagggtcggacgtaacaagtaccgaacgggtagttacgttttagttaaggtttttacggggaccgtaaagggtacctaagttcggttacgtacttccgtcccgtcctaccgacgtccctacccgaacccgtaaccgggccctacgttcccggttcccttcccccgtggcccctaccctccctaccgtaacggacgcctacccgtcggtacgggaccacgacggcccggtacccgtcgggtcctcggtacccgg

SEQ ID NO: 229117 - DNA, 936 bp, Homo sapiens
  misc_feature: GYAE6OF02JTTNR.8.37.D04.1.454.CMB.1.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagctcgcgtgtccacgaccggtgctcgatttagtagcatactgttgggtttgggtgcccaagctgctggagggcacggtcaccacgctgctgagatgaagagtccgtggggcctcagtgaagatttcctgcaaggcgtccggatacaggttcaccgccgtctatattaattggctgcgacaggcccctggacgaagggcctgagtggagtgggganaatcgaaccgagtggaggtggtgnagacgtaccgccgagtaggtttacgagggtacgagacgtctaccgagtacgaccaggtacgacgaccggtacccgacgacgaccgtacgtggttaccgtaagtagtaggtaagtaagtaaggtagggaactccgtacggtaacgttaccgtacggaaccggtaaccggaccgggttaccgttaacttagtttaacgttggtacggaacggtaacgaaacggtaacggtaaaaggtaacggggtacggttaacccgtaaactaaaccggttaacggaaccgggtttaacggtttaaccgtttttaggggtttaaacgggtttttacgggggtaacccgtaaaaggggtaacccgttaaagggttcggtaaaccgttacgtttaacccggtttcccgttaccgttacccggtaaaccggtaccccccgtttaacccgaaaccccgggtaacccggggaacccccgtttaaccgggttttcccggggttaacccccccgtttccccccggtaacgggttaacccccgtaccccccggtttaccccgtttaaccccgggaaccggttaaacccgggtacccccttaacccgggtttccccggggtcccgggggttaacccggtaaacccggtccccggggtaacccccggggttccccggggtttccccggtccgggttcccccggtttaacccgggg

SEQ ID NO: 229118 - DNA, 546 bp, Homo sapiens
  misc_feature: GYAE6OF02F5KAO.8.37.D04.1.454.CMB.1.raw
  modified_base (309)..(309): a, c, t, g, unknown or other
  misc_feature (309)..(309): n is a, c, g, or t
  modified_base (442)..(442): a, c, t, g, unknown or other
  misc_feature (442)..(442): n is a, c, g, or t
  modified_base (494)..(494): a, c, t, g, unknown or other
  misc_feature (494)..(494): n is a, c, g, or t
tcagctcgcgtgtccacgaccggtgctcgatttagtagcatactgttgggtttgggtgcccaagctgcgtggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatanggagatgaggagcctggacactgacgacacggaccgtatatacgtgtgacgagaatccgaaagacggtgactacaatacgacgagtctttagaagttttgggacctaagggactaagtggtcatccgtctccncagccctccgaccgacggcccacgtccgtaccttccccgtgcctaccctccnccgaacgcgacctaccgtcgtcgggcacgcggccgacccgtggcctcgtccg

SEQ ID NO: 229119 - DNA, 812 bp, Homo sapiens
  misc_feature: GYAE6OF02IU2GS.8.37.D04.1.454.CMB.1.raw
  modified_base (779)..(779): a, c, t, g, unknown or other
  misc_feature (779)..(779): n is a, c, g, or t
tcagctcgcgtgtccacgaccggtgctcgatttagtagcatactgttgggttgggtgcccaagctgctggagggcacggtcaccacgctgctgagatgaagagtcctggggcctcagtgaagatttcctgcaaggcgtccggatacgaggttcaccgccgtctatattaattggctcgcgacgacggcccctaggaacaacgggcctaggagtggagtcggggagtaactacaacccgtagtagggaaggtggtaggccaaggtacgtacggaccctaaggtacggtttcgaaggggtactaacggtaggttacctaccgtaagtacggtaaccgtaacggttaccggaaaccgaccggtttacccggacggaaacgtaccgttaaccgtcgttaaccgttaacgtaaccggtaggggttaaacagttcgggtaaaaggaaccgtccccgttaagggaacgttaaccggttgaaaccgggtaccaaccgggttacccgttaatttaaaccgtttacgtacggttacgaaccggaacggttaaagtaaaccggtaaggtaaacgggtcgtaacgtaaacgtaacgtacgtaaccgggtaatccgtttaaggtacgtttacggggacgtaaacgggacgtaacggttagtctagtaccgtaccgtacaccgtacgcccttaacccgacccgtaacggccctaacggttcccgttccctcccgtacggtaccctacccgtaccgtacgaaccgtacgacctcccggttacggccgggtaacncgtacggaccggtccctcgggcctacgtaccgg

SEQ ID NO: 229120 - DNA, 803 bp, Homo sapiens
  misc_feature: GYAE6OF02HM4RE.8.37.D04.1.454.CMB.1.raw
  modified_base (205)..(205): a, c, t, g, unknown or other
  misc_feature (205)..(205): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtaccggatacaggttcaccgccgtctatattaattggctgcgacacgcccctggacaaggcctgagnggatggggagatccaaccgagtcgggaggtggtgcaggacgtacgacccgtaggtacggtttcgagggcaggacgttacgtaccgtatcgaaccgtaggtacggacctaaccggtcccgacggaacgccgaaccgtttcgtaccgttataacgttcggaaggtaagtaggacgggacgtaccctagggtacgtacgttacgaaccggaccgtacccgggtaccggttaacttaactttaacgttcgtacggtaccgaagtaacgtaacggtaaacgggtacgggtacggtaaccgttaacgaacttaccgggtaccgggtaacgtttaccggttttaaggttaaacgggttttacgggggaaccgttaaacgggtaaccgtaaggttacggttaccgtacgttaccgttccgttaccctaccgtaccgtcccgttaaccccggaccgtaaccgggtacctaacggttccccggttacccttccccggtacgacccttaccccgtacccgtaccgtaacgtacccggccttacccgtcgggttacccgggatacccgacgggtccccggtaccggtaccgggtccggtcgttacccggg

SEQ ID NO: 229121 - DNA, 671 bp, Homo sapiens
  misc_feature: GYAE6OF02GR3H9.8.37.D04.1.454.CMB.1.raw
  modified_base (216)..(216): a, c, t, g, unknown or other
  misc_feature (216)..(216): n is a, c, g, or t
tcagctcgcgtgtccacgaccggtgctcgatttagtagcatactgttgggtttgggtgcccaagctgctggagggcacggtcaccacgctgctgagatgaagagtcctgggcctcagtgaagatttcctgcaaggcgtccggatacaggttcaccgccgtctatattaattggctgcgacacggccccctggacaagggcctgagtggagtggganaatcaacccgagtagaggtggtgcgagagtacgcccagtacggttcgagggcagagtctccatcgaccagtgacacgtccgcgagcactgtctatatggagtagtcggaggagccgtgaacgtacgttcggaccgacgaccggaccgttaagtaactttacgtgtggacgtaagtaacgtacggaaaggaacggtggactaacgaactacgacggtagttcgttttagtaacgttttcggggacctaaagggtactaaggttcggtacctaacgttccgtccttcctacctaggcccctaccgaacccgtaaccgggtccctacgttcccgttcccttcccccgtaccgtcccgtaccccttcccgtaaccgtaacggtaccgtacccgtacccgtacggtccgggtaccaaccggccgggtacccgtccccggtcgggtaccgtcggtacccgg

SEQ ID NO: 229122 - DNA, 770 bp, Homo sapiens
  misc_feature: GYAE6OF02FZ8XM.8.37.D04.1.454.CMB.1.raw
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
  modified_base (232)..(233): a, c, t, g, unknown or other
  misc_feature (232)..(233): n is a, c, g, or t
tcagctcgcgtgtccacgaccggtgctcgatttagtagcatactgttgggtttgggtgccaagctgctggagggcgacggtcaccacgctgctgagatgaagagtcctggggcctcagtgaagatttacctgcaaggcgtccggatacaggttacaccgccgtctatattaatgctgcgacaggccctaggacaggctgagtggatggganatcgaaccgngtagaggtggnngagagtacgccagtaggttcgagggtcagaggtctaccgattgaccagtagacacgtcggcgaggcctacgtgttactacgtaagtggaacagtggtaagggactaccggtggaagtaccgtttacggaaccgacgtaaccggccgtttaataaacgtttacgtggttacggacgaagtaaacgtacggaaaggtaaggtacggtacgtaacgtaacgtacgaacggtaacgttacgtttagttaagggtttacgggtaaccggtaaacggtaacggtaacgttacggttaacgtacgttaccgtacgttacccgtacgaccgttcccgtaccgtaacccgtaaaccgggtaccccgtaaccgttcccgtttaaccccgttcccccggttaccgtaccccgttaccccgttaccccgttacccgtaaccggtacccggttacccgtaaccggttacccggtaccgggggtaccctaacgggttaccgggaaccccgggttccggtaccggggtacccgttaccggttaaccccgggg

SEQ ID NO: 229123 - DNA, 601 bp, Homo sapiens
  misc_feature: GYAE6OF02FLDMH.8.37.D04.1.454.CMB.1.raw
  modified_base (294)..(294): a, c, t, g, unknown or other
  misc_feature (294)..(294): n is a, c, g, or t
  modified_base (331)..(331): a, c, t, g, unknown or other
  misc_feature (331)..(331): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcacacggcccctggacaagggcctgagtggagtggggagaatccaaaccgagtggaggtggtgcagagtaccgccctagaggtttcgagggcagacgtctccatgaccagtgaaccnccgtccgcgagcactcgttcatagtggagatgaaggngcgtgagtactgaccgacacggctattattacgtgtgcgaagaactacggaaaggacggtggactaacgaacgacgacggtagttctttagtacggtttgggaccgtaaggactaagtcgtcagttcctctccacgcgtccctccgaccgtaccgccgtacgtcccgttcccttccccgtcggtcccctacccgtccctaccgtaagacccgtccacccgttcgggaccgggcgaccggcgtcccggtcccggcgggtccgtcgtcccgg

SEQ ID NO: 229124 - DNA, 907 bp, Homo sapiens
  misc_feature: GYAE6OF02IHWWE.8.37.D04.1.454.CMB.1.raw
tcagctcgcgtgtccacgaccggtgctcgatttagtagcatactgttgggtttgggtgcccaagctgctggagggcacggtcaccacgctgctgagatgaagagtccgtgggcctacagtgaagatttcctgcaaggcgtccggatacaggttcaccgtcgtctatattaattggctgcgacgacggccctggacgaacgggcccttgaggttggagtaggggaagaacgtaccgaaacccggtaggtacgggaggttcggttggaccgaggtaacggtacccgcccgaagggttacggttttacgaacggggcgaacggtaacgttccgttaccgacgttaccggaacccgtaagggtacggtaacccggtaacccgggttaccccggtaccgggaaccggtaaccccgttaaccgtttaccggttttaccgttaaacgtttggtaaaccggtggtaacggttaaggtacggggtaccgttaccggtacgtacggtaacccgtttaggaaccccggtaaccggtacccggggtaacgttaacgtttaacgtttacgttacggtaccggtagtaaaggtaaccgtaacgggaaaggtacgggtacgtaaccttaacgtacgacggtaacggtacgtttacgtttaggtaacggttttaccggggaaacggttaacggtaacgtaacgttcggtaaccgttcgttacccgttccgtaaccctccggtactccccgttaaccgacccggtaaaccggtccgttaaccggttcccgttaccccgttccccgtcccgtaccccttaccccgtaccgtacccgtacgaacccgttaccggtcccgttacgggtaccggtaccgaccggtcccgggtacccggtccccgggtaggtcccgacgtttacccggg

SEQ ID NO: 229125 - DNA, 665 bp, Homo sapiens
  misc_feature: GYAE6OF02HRG67.8.37.D04.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggccgtccgggatacaggttcaccgccgtctatattaattggctgcgacacggccctggacaagggcctgagtggagtggganactcaaccgnggtaggaggtggtgcagacgtaccgcccaggtacggttcgagggcagtacgtcctcatgaccaggtagaccacggtccgacgagcctactggtactatagtgggagtagtggaggacgtccgtagacgtactggaaccgtaccgacggtccgttaattacgtttacgtggtacgacgtaagaaacgtaacggaaggtaaggtacgactaacgtaaatccggaacggtacgttacgttttaggttaaggtttcggggaacgtaaggactaaggttcggtactagttcgtcgtcctacgtctacctaccgacgtaccggacctacgttcccgttcccttccccggacgtaccctaccctcccgtaaccgacggtacccgtcctaccggtccggtccgggacaccggccggccggtaccggtccggtacgtccgtaccggg

SEQ ID NO: 229126 - DNA, 752 bp, Homo sapiens
  misc_feature: GYAE6OF02JFPUH.8.37.D04.1.454.CMB.1.raw
  modified_base (229)..(229): a, c, t, g, unknown or other
  misc_feature (229)..(229): n is a, c, g, or t
tcagctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacacggcccctggacaacgggcctgagtggatggggagaactcgaaccgngtggaggtgtgcagagtaccgccagtaggttcgagggcagagtctccatcgaccagtgacacgtccgcgagcactgtactagtacgtggagtatcggaggacgccgtaggacgtacgttggaaccggtacgtacgggtaccgtaacttaacgtttacgtggtacgacggaagtaaacgtaccggtaaaggaagggttacggacgtaaacgtaacgtcgaacgggtacgttacgttttaggttaaacggttttcggggaaccgtaacgggtaacgtaacgttacgggtactaacggttccgtccttacccgtacgtaccgtacccgttaccccgaaccggaccgggttacccctaaccgggtttcccgttaccccgtttaccccccggttccgtaaccccgttacccccttacccgttacccggtaaccggtcccgtaacccgttcccggttacccgggcggggtacccaaccggtccgggtaccccggtccgggtaccggggtcccgttacggttaccccggg

SEQ ID NO: 229127 - DNA, 774 bp, Homo sapiens
  misc_feature: GYAE6OF02IG65M.8.37.D04.1.454.CMB.1.raw
  modified_base (228)..(228): a, c, t, g, unknown or other
  misc_feature (228)..(228): n is a, c, g, or t
tcagctcgcgtgtccacgaccggtgctcgatttagtagcatactggttgggtttgggtgcccaagctgctggagggcacggtcaccacgctgctgagatgaagagtcctggggcctcagtgaagatttcctgcaaggcgtccggatacaggttcaccgccgtctatattaattggctgcgacacggcccgtggacaagggcctggagtggagtgggagaatcaaccgngtggagtggtgcagcgtaccgccgaggtagtttcgagggcagagtctcatcgacagtcgacgacgtccgacgagcctactggtctatacgtgtacgagtggaaggtacgccgtagagtaccgttaggaccgtaacgaccggtccgttaagtacgttttacgcggttacggacggtaacgtaagtaccggtaaaggtaacgggtcggacttaaacgaacgtccgaaacgggttatttcggttttaacggttaaggttttaccggggaacccggtaaagggttaacctaaaggttccggtaaccaacgtttcccgggtaccttaccgtccgtaaccggtccccgttaacccgaacccgggtaaaccggtccccgtaaaccggtttcccgttcccccggtttaacccccgtccgggttaacccctacccccgtttacccgtaacccggtaacgccccggttaacccttacccgggtaacccgggttccgggggaacctaccggacccggtcccgggtacccgggtcggtcccggttaccggtccccggg

SEQ ID NO: 229128 - DNA, 235 bp, Homo sapiens
  misc_feature: GYAE6OF01CVIVA.25.11.A11.1.454.CMB.1.raw
  modified_base (223)..(235): a, c, t, g, unknown or other
  misc_feature (223)..(235): n is a, c, g, or t
tcagactgtacagtcacgaccggtgctcgatttagctacgactgcgaagggaaagggccagggaaccctggtaaccgtctccttcaccttccaccaagggcccatcggtcttccccctggcgccctgctccaggagcacctctggggcacagcggccctgggcttgcctggtcaaggactacttccactgtacagtctgagcgggctggcaagggcgcatagnnnnnnnnnnnnn

SEQ ID NO: 229129 - DNA, 541 bp, Homo sapiens
  misc_feature: GYAE6OF01CBD24.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactagtcactactgggcctggactccgccacgcccccgaggggttaaggggctgggagtggattggcagtacatatcatacgtgggagaaccttctaccaacccgtccctcaagacgtcgagtcaccatatacaattgacacgtaccaagacgtcacgttctccgtagaagctgagctctcgtcgaccgccgcggacacggccatgtattctgttcgagagagtaaggagcacgtgagtggctacgacggtcccgggtcggggtttgacgtacggtcggggaccgagggcgtcccgtgg

SEQ ID NO: 229130 - DNA, 530 bp, Homo sapiens
  misc_feature: GYAE6OF01AVBFT.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactagtcactactgggcctggatccgccagcccccagggagggctggagtggattggcagtacatatcatactgggagaaccttctacaaccgtccctcaagagtcgagtcaccatatcaattgacacgtaccaagagtcagttctccgtgaagctgagctctgtgaccgccgcggacacggccgtgtactttctgttcgagagataaaggagcactgagtggactacgaagtccgggtcggggttttgacgttacgtggggacccaggggacgcccgtgggtacccg

SEQ ID NO: 229131 - DNA, 253 bp, Homo sapiens
  misc_feature: GYAE6OF01BO564.25.11.A11.1.454.CMB.1.raw
  modified_base (245)..(253): a, c, t, g, unknown or other
  misc_feature (245)..(253): n is a, c, g, or t
tcagactgtacagtcacgaccggtgctcgatttagctacgactgcaggggcgacagcagatggtggagcaagtgactggggccagggaaccctggtaaccgtctcctcaccttccaccaagggcccatcggtcttccccctggcgccctgctccaggagcacctctgggggcacagcggccctgggctgcctggtcaaggactacttccactgtacagtctgagcgggctggcaaggcgcatagnnnnnnnnn

SEQ ID NO: 229132 - DNA, 566 bp, Homo sapiens
  misc_feature: GYAE6OF01A033D.25.11.A11.1.454.CMB.1.raw
  modified_base (333)..(333): a, c, t, g, unknown or other
  misc_feature (333)..(333): n is a, c, g, or t
  modified_base (437)..(437): a, c, t, g, unknown or other
  misc_feature (437)..(437): n is a, c, g, or t
  modified_base (476)..(476): a, c, t, g, unknown or other
  misc_feature (476)..(476): n is a, c, g, or t
tcagactgtacagtcacgaccggtgctcgatttagctacgactgcaggggaggggaaatgctttctgagagtcatggacctcctgtgcaagaaccatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactgggcctggactccgccacgccccccgaggggaacggggctgggagtggattggcagtacatatcatacgtggganaaccttctacacccgtccctcaagagtcgagtcacatatcaattgacacgtccaagacgtcagttctcgtgaagtctgacgtctctgtcgacccgccgcggacncggtccgtgtactttcgtgttacgagagtaagtaaggancacgtgacgtcggactacgtaaggttcccggggtccgggggttttacgacgttacgtacgggggaccaaggggctcccggtgggtacccg

SEQ ID NO: 229133 - DNA, 681 bp, Homo sapiens
  misc_feature: GYAE6OF01CQ35J.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagacccctgtccctcacctgcactgtctctggtgctccatcaggactactagtcactactgggcctggactccgccacggcccccgaggggaacggggcgtggaggtcggattggcagtacatatcatacgtgggactaaccttctaaccaacccgtcctacaacgagtacgagtcacctatatacaattcgaacaccgtaccaagtacgtctagtttcctaccggtagaaacgtcgtagtacgccttcgtcggttcggaccccggccggaccgggaccgaccgggtcccgttaggtttacttttcgtcggtttaccggaaggtaaggtaaagttaaaggggtacaccgtaaccgttagggacggttacgggtaccttaaaccggtaaacggttcccgggggttcccggggggtttttacgaaccggttaccggtcggggggaccccggaagggggtcccggtccccgggttcgggttaccccgg

SEQ ID NO: 229134 - DNA, 649 bp, Homo sapiens
  misc_feature: GYAE6OF01C1R9L.25.11.A11.1.454.CMB.1.raw
  modified_base (562)..(562): a, c, t, g, unknown or other
  misc_feature (562)..(562): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatggtcctgtcccagttgcagctgcaggagtcgggcccaggactggtgaagccttcggacgaccctcgtccctcacctgcactcgtctcgtggtcgctccatcaggtacttactagtcactacgtcggcctcggactcccgaccaccggaccccgaaggggaagggctgggacggtggagttggactaagtacatagtcaatacgtagggaactaaccttctaaccgaacccgtcctaacgaacgtagtaccgagtaccaacctaatatactaaattcgaactaccgtaccaaagtcgtactacgtttacctaccggtagaacgtctagacgtccttacgtcggtaccggacccggccggtaccggaaccgtaccgggtccgtttagttacgtttcgttacggtacgtagaagtaagtaaacggngtactagtgacggtagtacgtaacgacgggtttcgggtcggggttttacacgttacggtcgggacgtagggaccgtccgtggtcccg

SEQ ID NO: 229135 - DNA, 621 bp, Homo sapiens
  misc_feature: GYAE6OF01ADNRU.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactacgtgggcctggactccgccacgcccccgaggggacgggctgggagtggagttggcagtacatatcatacgtgggactaaccttctaacctaacccgtccctacaacgagtacgacgtccaacctatactacaattcgaacctaccgtaccaaagtacgttactacgtttccgtaccgtagtaacgtcgtagacgtctcgttcgtacgacccgccggcggaccgaccggtccgttgttactttcgtcggttacgaagagtaagtaacggagtacgtagtggacggtcgacgtaaccgtacggttccggggttccggggtttagaccgttacggtacggggacccgaggggccgtcccggtggtacccg

SEQ ID NO: 229136 - DNA, 775 bp, Homo sapiens
  misc_feature: GYAE6OF01EVSUH.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactgtcactactggcctggatccgcacgccccagggagggctggagtggattggcagtacatatcatacgtagggataaccttctaaccaacccgttccctacgaaagtacgtacgacgtaccaacctataactacaaatttacgaactaaccgttaccaaagtacgtacctaacgttaccttaccgtaggtaaacgtccgtaggtaacgtccgttacgttacggtacggacccggtcccggaccgggtaacccgtacccgggtccgttacgtttaacgttttccgtacggtttaccggaaggtaaacggtaacgttaaaaacggggtacgtaacccgtaaacggttacgggtaacgggttacgggtaacccgtttaaaccggtaaaacccgggtttccccggggggggttaacccgggggggtttttttaacggaaaccccgggtttaacccgggggtttaccgggggggtacccccggtaaaagggggggtaccccggttacccccgggttaccggggtttaacccccggg

SEQ ID NO: 229137 - DNA, 584 bp, Homo sapiens
  misc_feature: GYAE6OF01BF827.25.11.A11.1.454.CMB.1.raw
  modified_base (506)..(506): a, c, t, g, unknown or other
  misc_feature (506)..(506): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtcgctccatcaggactactagtcactacgtgggcctggactccgccacgcccccgaggggacgggctggagtggattggcagtacatatcatacgtgggaacgtaaccttactaaccgtaacccgtcctacaaagtacgtcgacgtcaacctatactacaattgaaccacgtacaagtacgtctacgttccgtaccgtagaacgctagacgtctacgtcgtcgacccgcgaccggacgacggtccgttgttactttcgtgttacgagtagaagtaaggnactagtgagtaggacgtaacgacggtccgggtcgggtttacgacgttacggtcgggcgagggcgtcccgtggtacccg

SEQ ID NO: 229138 - DNA, 717 bp, Homo sapiens
  misc_feature: GYAE6OF01BDYGT.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactagtcactactgggcctggactccgccacgcccccgaggggacgggctggagtggattggcagtacatatcatacgtagggacgtaaccttctaaccaacccgtccctacgaacgtacgtccgagtccaacctaatatacaaatttcgaacctaccgttaccaaaggtacgttaccgtaacgtttaccgtaccggtagtaaacggtcgttaggaacgtcccttacgtacggtaccggacccggcccggacgggaaccgtaccgggtccgttagttactttccgtacggtttacggaaggtaaggtaagtaaacgggacgtaccgtaacggttaggtaacggttcgggtaacccttaaacggtaaccgggttccccgggggttacccggggggttttttacgaacccggtttaccggggttcggggggtaccccgtaaggggggtacccgtccccgggttgggttaacccccgg

SEQ ID NO: 229139 - DNA, 639 bp, Homo sapiens
  misc_feature: GYAE6OF01DN0P8.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactgggcctggactccgccacgcccccgaggggaaggggctggagtggagttggcagtacatatcatacgtgggacgtaaccttctacctacccgtccctacaagacgtcgagtcaccatactctaattcgactacgtaccaagacgtacagttctcgtagaagtctgaagtctctggtcgaccgccgcggaccgaccggtcgttgtaacttttcgtacggtttccgaggtaacggtaagtaaacgggtgtacctaacgttaggacgggttcggtaccgtaaccgtaaccgggtttcccgggggttaccggggggtttttacgaccggtttaaccgggtcggggggtacccgaggggggtaccgtccccggttcgggttaccccgg

SEQ ID NO: 229140 - DNA, 751 bp, Homo sapiens
  misc_feature: GYAE6OF01C63FA.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatggtcctgtcccagttgcagctgcaggagtcgggcccaggactggtgaagccttcggagaccctgtccctcacctgcactgtctctggtgctccatcaggactatagtcactactggcctggatccgccacgcccccgagggaacgggctgggagtcggattggacagtaacatatacattacgtgggagtaaacccttctaacctaacccgtcccttacgaaacgagttaccgaagttaccaaccattaactctaaattcgaacgtaccgtaccaagtacgtacgtacgtttaccgttaccgtaggtaaacgtccgtaggtaacgtccgttcgtacggtaccggtaacccgtcccggaccgggtaacccgtaccgggtcccgttacggtttaacgtttcccgttaggttttaaccgaagggtaacgtaaacgggttaaaacgggtacggtaccttaaacggttaccggtaaaggttccgggtaaccgttaaaaccggttaaaccggtttccccgggggttaaccggggggtttttaccgtaaacccggtttaccgggttaccgggggacccgtaacgggggtaacccgtccccgggttcgggttaaccccgg

SEQ ID NO: 229141 - DNA, 704 bp, Homo sapiens
  misc_feature: GYAE6OF01ETGL3.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtcgctccatcacctagtggttactcactactggagctggatccgccagccacccgaggggaacgggccgtagggagtgggtagttaggggtaccagttcgtaacgttaccggtgggaactccgtaccgtttctaaccctaaccccgtccctacgaaacttacggtccgaacgtaccaaccgtatccgtacaatttacggaccaacgttactaaacgaaccctagtttacctacccttagtaaacgtttcgaaaccttcgtagttacgtacgtcggacccggccggaacgtaccgggtcccgttagttaactttacggtgtacgggccggtactaacgttaaccgttaacgacttaaccgtaaggtcggtaaccggtaacttacgttaccgaaccgttaactacccgtaacgtactttgttacccgtttttagaacttaaccggttcggttaaccgggggtacccgtaaaacgggggg

SEQ ID NO: 229142 - DNA, 681 bp, Homo sapiens
  misc_feature: GYAE6OF01D9I45.25.11.A11.1.454.CMB.1.raw
  modified_base (321)..(321): a, c, t, g, unknown or other
  misc_feature (321)..(321): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggacgaccctgtccctcacctgcactgtctctggtggctccatcaggtactactagtcactactgggcctggactccgccacgcccccgaggggaacggggctgggagtggagttggcaggtacatntacatacgtagggacaaccgttctaacaaccccgtcctacaagacgtcgagtcacctatactcaaattcgaactacgtaccaagtacgttacagtttcctaccggtagtaaacgtcgtagaacgtcctccgttagtaccggacccggtcccggaccgggtaaccacccgggaccctaagttcggttaacttttcgtcgggttacggtaacggtaaggtaacgtaaagggacggtaacaccgttagggaggtaccgggtactaaccggtaaacgggttcccgggggtttaaccggggggttttgaaacccggttacgggttacggggacccggtaacgggggaccgtcccggttaccgggg

SEQ ID NO: 229143 - DNA, 626 bp, Homo sapiens
  misc_feature: GYAE6OF01CZY54.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtgcggctcccagatggtcctgtcccagttgcagctgcaggagtcgggcccaggactggtgaagccttcggagaccctgtcccctcacctgccactgtctcgtggtcgctccatcgaggactactagtcactacgtgggcctggactccgccacgcccccgaagggacgggctgggacgtggagttggacagtacatactcaagtacgtagggaacgtaacccgtttacctaaccgtaaccccgtccctacgaaagtacgtacgtacgtacaaccatactctaaattcgacaccgtacaagtactacacgttcctccgtagaacgtcgtagaacgtcttcgtgtccgaccgccggaccggaaccgcgggtccgttagttactttcgtacggttacgagtaagtaagtaaggcgactagtaggtagtcggacgttaacgacggttcccggggttcgggttttacgacggtacgtcggggaccgagggccgtccggtggtacccg

SEQ ID NO: 229144 - DNA, 772 bp, Homo sapiens
  misc_feature: GYAE6OF01AULOK.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggcgcccagatgggtcctgtcccagctgcgtctgcaggagtcgagcccagggcaggtgaagccttcggagaccctgtccctcacctgctctgtctcgtggtcacctccatcacctaagttatcgctctattacggtgggtctcggcctcccgccgacgcccccgaagggacgggccgtgggagtggattcggcgtagtttcgttctttcgagttagggtgggtagttcgaccttactaccgtaccgttcccctacccgtacgaacgtacgtaccggtaacgtaccctaccgttagttttccggttacgaccctaccggtacccaccggtacgacggtaccgttagtttacgtcccttacgtcgaaacctaccggttcgaaccgtttcgtcgtacccgacccgggtccccgaccgaccggtacccggtccgttacgttaacgttaccgttggtaccggtacgtacggtacgttcccgggaacggtaccccgggttaacccgggtaaaaacccccctttacccggtaaacccccgttttacggttaacccggtaacccctaacccggggttacgggggaaccccgtaaccggggggttaaccccgttacccgggtttaccccaaccccggttcccgtaacccccgg

SEQ ID NO: 229145 - DNA, 684 bp, Homo sapiens
  misc_feature: GYAE6OF01DF4Z2.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcgggacaccctgtccctcacctgcactgtctctggtgctccatcaggtactacagtcactacgtcggctgactccgccacgcccccgagggacgggctggagtggagttggcagtacatatcagtacgtaggacgtaacctcgtacctaacccgtccacgaagagtacgacgtcaactatactactaattcgacctactaccgaagtacgtacctagttacctccggtaagacgtctagacgtccttcgtcgtacgacccggccgccggacgaccggtcgttgttacgtttcgtaggttacgaggacgtaaggtaaaggtacgacgtacgtagggtacggtacgggtaaccgttaaccggtaaaccggtttccccgggggggtttaaccgggggtttttacgaaacccgggtttacccgggggttaccgggggaccccggggttaaacgggggtaccccggttccccgggttacggggttaaccccccggg

SEQ ID NO: 229146 - DNA, 704 bp, Homo sapiens
  misc_feature: GYAE6OF01EC918.25.11.A11.1.454.CMB.1.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
tcagactgtacagtcacgaccggtgctcgatttagctacgactgcaggggagggaaatgctttctgagagtcatggacctcctgtgcaagaacatgaaacacctgtggttctccctcctgctggtgcagctcccagatggtcctgtccaggtgcagctgcaggacgtcgggcccaggactggtagaacgtccttcacacgaccctcgtccctcacctgcctactgtctcgtcggtgcctcatccacgtaggtgttancactacgnggacncgtggactccgcagccgaccggagggacggtccagggaggtggtaggttggtacagttaccgttagttacggtggacgaccttaccttccgaacccgtaaccccgttcctaacgaacttcggtactaacgtccaaccctattaccgtactaaacttacgaacctacgttaaccgtaaaccgtaacccgttacgtttaccctaccgttaggtaaacgttacgtaaccttacgtcgtacggtaccgcggacccgtacgtaccgtaccggtcgtttacgttacttacgtggttaccgagggtaaccctaagtttacctaacggtaacgtttaccgtagggttccgaaccggttaattaccgtacctaaacgtccgtaccgttaacgtcgtttacggttttacctttaagggctttaaccgggtcgggtaaccggggg

SEQ ID NO: 229147 - DNA, 941 bp, Homo sapiens
  misc_feature: GYAE6OF01EBPNO.25.11.A11.1.454.CMB.1.raw
  modified_base (168)..(168): a, c, t, g, unknown or other
  misc_feature (168)..(168): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcgaggngtccggccaggactggtgaacgtccgttcgggacgaccccttgtcccctcaccgttgcctacgttcgtccgttcgtcgggtcggcctccgtaatccgaacggtaccttaacttacggtacctaaccgttaccggttcggggtcccgtacgggaccttccccggacccgaacccgggaccccccggaagggggaacggggtccgttagggaggttacgggtagtttcgggacctaggttaacaagtacgtactaacgttacggtagggtaaccgttaacccgtttaccgtaaaccccgtaaacccccgttcccgttaacgaaacgggttacgtaccggtaacgttacccgaaaccttaacgttaacgttaaccgtaaaacgtttaccggaaaccgttaaacccggttaaccgtaaaacggttaccggtttaacccgtttaacgggttttaccccgttaacccgggtttaacggtaaaccggtccgtttaacgggtacggttacccgttttaccgggttacccgggttaacccgggaacccccgggtacccgggaacccggtaaaccgaccccggggttacccttaagggtttcgttttaaccgtttttccggtacgggtttaaccgaaacgggtaacggttaaacggtaaaggggccaccgttaccggtagggtacggttcggaaccttaacgggtacggttcccgggggttacggggttttacgacccgttacggggccgggtaacccgtcgggggcccgttccggtaccggg

SEQ ID NO: 229148 - DNA, 811 bp, Homo sapiens
  misc_feature: GYAE6OF01AHWHM.25.11.A11.1.454.CMB.1.raw
  modified_base (289)..(289): a, c, t, g, unknown or other
  misc_feature (289)..(289): n is a, c, g, or t
tcagactgtacagtcacgaccggtgctcgatttagctacgactgcaggggagggaaatgctttctgagagtcatggacctcctgtgcaaagaacatgaaacactgtggttcttcctcctgctggtggcggctcccagatgggtcctgtcccagttgcagctgcgaggagtcgggcccaggacgtggtgaagccgttcggacgcccctgtccctcacctcgcactgtcctgtggcgcctccatacgaggacttactacgtcacctacgtcggccgtggacctcccgaccnccggacccccggtagggggacgggcgtagggaggttaggtagttcggaccgtaggttacaagttactaccgtaacgtacgttacggggtaactaaccctttaccgaacccgtaacccccgttcccctaaggaaacgacggttacgaccgttaccaccctaattactacgtaatttcggactaccggttacaacgtacgtctacgtttacctaccgtaggaacgtcgtagacggttcttccgtaggtacccggaccccggaccgggcccggtaaccgtacccgggtccggtttacgttttaacgtttcggtacggtttccggaagttaacggtaaaggtttaaacgggacgtaaccgttaacggttacggtagggttaccggtaaacggtttaccccggtaaacgggggttttcccccggggttaaccggggggtttttaacacccggggtttacccgggggtaaccgggggtacccgggaacgggggttaccccggtcccgggttccgggttaccccccggg

SEQ ID NO: 229149 - DNA, 661 bp, Homo sapiens
  misc_feature: GYAE6OF01A7BAO.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcggcccaggactggtgaagccgttcggagaccctgtccctcacctgccactgtctcgtggtcgcctccatcgaggacttactagtcactacgtggcctggactcccgccacgacccccgaggggaacgggcgtgggagtggagttcggctacgtacattatctaacgtacgtagggacgtaaaccctttacgtaacccgtaacccgtccctacgaacgacgtaccgacgtaccaacctaatatacctaaagtttcgaacctaccgtaccaacgtacgttcctaagttccgttaccgtagtaacgcctaggactccgttacgtgttaccggacccgtaccggaccggacctccggtcgttggttactttggtacggttcgaaggaacgagtaacgggatacgtacgtgaaggtcgtaacgtacgtacggttcccggggttcgggttacgtacgtaccggttacggggacggtaagggcttcccgggtggtccg

SEQ ID NO: 229150 - DNA, 853 bp, Homo sapiens
  misc_feature: GYAE6OF01A120P.25.11.A11.1.454.CMB.1.raw
tcagactgtacagtcacgaccggtgctcgatttagctacgactgcaggggagggaaatgtctttctgagagtcatggacctcctgtgcaagaacatgaaacacctgtggttcttcctcctgctggtggcggctcccagagtcgggtcctcgtcccagttgcagctgctaggaggtccgggacccgaaggtactgggtagaacgtccggttacgggacgtaccccgttcggtcccctaccacccgttcggaccgtaccgttcggtccgttcggttcggggttacggtcccttaccgtactccgaacggtaaccttaacgttaacggtacctaacgtacggtcgggtaccgtcggacgttccccggacccgtaccgggaccccccggaagggggggtaaccggggtccgttacggggtacgggtacgggtagttcgggaaccgtaacggtaacgtaaacgttacgtaccgttaagtaaccggtacggggtaaaccgttaacccttacccgtaaaccccgtaaccccgttaaccctaacgtaacggacggttaccgaacgtaccaacgtataactactaagtccgaactacgtacaacggtctacgttacgtccgtacgtagtaacgtcgtaagtcgtccgtcggtacgggtaccgacccggtccgggtaacggacccggtacggttaccgggtttcttaaccggtttcctagggttacgaaaggtaacgtaaacggtaacggactacgacggtagtacgtaccggaccgttaacggtacccgggttcggggttaaccgggttacacgggttccggggtacgggacccgtaacgggtccgcccggttggtaccccg

SEQ ID NO: 229151 - DNA, 792 bp, Homo sapiens
  misc_feature: GYAE6OF01C3BPI.25.11.A11.1.454.CMB.1.raw
  modified_base (682)..(682): a, c, t, g, unknown or other
  misc_feature (682)..(682): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcgagggacgtccgggcccagggactgggtagaacgtcccgttcgggacgtaccccgttcgtcccctccaccgtcgcctacttgttcctcgtgggtcggcctccagtcgacggtaccttacgtagtacctactacgtcgggcctggacctcccgaccgaccggcccccggaaggggacggggtcgtagggtaggtggtagttcggacgtacgtaaccgattaacgtacctaagttaccggtaacgggtaaccgttaacccgtttacctaacccgtaacccccgtacccgtaacgaaacggtacggtaccggtaacgtacctaaccgtaacttacgtaactaaacgttacggaacctaacccggtaacccgtaaaggtacgttaccgttacgtttaccgtaccggtagtaacgtcgtcggtaacgtccgttcggtacggttacccggacccggccggaccggtacgaccggttcgttacgtttacgtttcgtacggttacgaagtaacggtaaagtaacggngtaacgtagtaggacggtacgtaccgtaacggtaccgggtttcccggggttacgggtttacgaccggttacgggaccgggtacggagggtacccgtccgttcggtacccg

SEQ ID NO: 229152 - DNA, 703 bp, Homo sapiens
  misc_feature: GYAE6OF01A5XTC.25.11.A11.1.454.CMB.1.raw
  modified_base (640)..(640): a, c, t, g, unknown or other
  misc_feature (640)..(640): n is a, c, g, or t
tcagactgtacagtcacgaccggtgctcgatttagctacgactgcaaggggagggaaatgctttctgagagtcatggacctcctgtgcaagaacatgaaacacctgtggttcttcctcctgctggtggcggctcccagatgggtcctgtcccagttgcagctgcaggagtcggccaggactggtgaagccgttcggagaccctgtccctcacctgcactgtctcgtggtcgctccatcaggtactacgtagtcactacgtcggcctggactccgaccacgcccccgagggacgggcctaggagtcggagttggacagtacattactcatacgtgggactaacctctaaccacccgtcacgaagcgtacgacgtccacctagtacttacaattcgaactaccgtacgaagtagttccgtaaggtttcctaccggtagtaacgtacggtacgtaacggtccttacgggttcggttaccggaccccggacccggaccgggtaccgacccgggtcccgtttaggttaccttttcgtacggtttacggaacgtacggtaaacgttaaacgggactaccgtacgttagggacgttaccgggtaacttaccgggtaaccgttcccgggggttacccgggggttttanaacccgggtttacgggtccggggacccgtaagggggtaacccgtcccggttagggtacccccg

SEQ ID NO: 229153 - DNA, 873 bp, Homo sapiens
  misc_feature: GYAE6OF01C9591.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtgcggctcccagatggtcctgtcccagttgcagctgcgaggaggtcgggcccaggacgtggtagaacgtccgttcggacgacccttcgtccctaccaccgtgcctacctcggtcctcgtggtcggcctaccactcgaacggtaccttacgtacgtacctaaccgttacggtcgggcccgtaggtaccgtccccgacccgaccgggacccccccgtaaggggggaacgggggtcgttaggggtacgggtagggtacgttacgggacgtaacgtaaccgtaagttaacgtacctaacgtaaccgggtacgggtaaaccgtaaaccccgtttaccgtaacccggtaaacccccgttcctaacggtaaaacgtcggttaaccggtaactaccctaaccgtaattaactaccgttaaataccggaacctaaccggtaaccgtaacggtaccttaaccgttacggttaccccgttacggtaacgtaaacggttcgtaacggtacggtcccgttacggttccggttaacccggaccccgggtacccgggacccgggtaaacccggttaccccgggggttaccgtttacgttttaacggttttccgtaccgggttacgaaggtaacgtaacgggtaacggcgtacgtacgtagggtacggtcggtaacgttaaccgtacgggtttacccggggttcggggtttacaaccggttacgggtacgggacccgtagggtacccgtccggtccggttacccg

SEQ ID NO: 229154 - DNA, 794 bp, Homo sapiens
  misc_feature: GYAE6OF01CMMGV.25.11.A11.1.454.CMB.1.raw
  modified_base (122)..(122): a, c, t, g, unknown or other
  misc_feature (122)..(122): n is a, c, g, or t
  modified_base (139)..(139): a, c, t, g, unknown or other
  misc_feature (139)..(139): n is a, c, g, or t
  modified_base (247)..(247): a, c, t, g, unknown or other
  misc_feature (247)..(247): n is a, c, g, or t
  modified_base (558)..(558): a, c, t, g, unknown or other
  misc_feature (558)..(558): n is a, c, g, or t
  modified_base (690)..(690): a, c, t, g, unknown or other
  misc_feature (690)..(690): n is a, c, g, or t
tcagactgtacagtcacgaccggtgctcgatttagctacgactgcaggggaggaaatgtctttctgagagtcagtcggacctcctgtgacaagaacatagaacacctgtgttcttcctctgngtggtggcgcctccagngtcggtcctcgtccgagtgcagctgcgaggtcggccggccaggtacgtggtagaacgtcccggttcggaacgtccccgttcgcccctaccgtacgtgacttaccgttnttccgttcggttcgggtacgtcccttacgacgttaccggaaacggtaccttaccgttacgtacctaccgtacggtcgggtccctaggacccgtcccgacccgaccggacccccggaaagggggcggttaccgagggtacggtggtacgtcgacggtactaaccgtgttaacacgtagtacgggtaggtaacctacctaccgtaacccacccgtcgaagagtaccgtagtaacctccaacgtaataccgtactaaacgtcgaaaccgtaccgtaacgaaacggttcgtaccgttacgttccgtcggaaacgngttacgtcgtaacgtccgttaagtccgacggtaccccggcccgggaaccgtaaccggtcccgaagtttccggttaactttaccgttcggttacggttacgaaagtacgttaaaggacgtacctacggtaccnggttaacggtactacccgggttaatcccggggggtttccggttaacggggttcctaccggggtacgggtacccggagggtacccgggtcctcgggttaaccccg

SEQ ID NO: 229155 - DNA, 941 bp, Homo sapiens
  misc_feature: GYAE6OF01BD57L.25.11.A11.1.454.CMB.1.raw
  modified_base (142)..(142): a, c, t, g, unknown or other
  misc_feature (142)..(142): n is a, c, g, or t
tcagactgtacagtcacgaccggtgctcgatttagctacgactgcagggggagggaaatgctttctgagagtcatggacctcctgtgacaagaacatagaaacacctgtggttccttcctcctgctggtggcggcctccagntcgggtcctgtcccagttgcagctggcgaggtacgggtccgggcccgaaggtacgtgggtaggaacgtcccgtttcgggaaccgtccccttccggtcccctccgaccgttcgcctaccgttcgtccgttcgttcggggtcgtacccttacccgagttccgaacgggtaaccttacgtacgttacctaaccgttccggtcgggtccctggaacccgtccccggacccgacccggaccccggggaaggggggtacgggtcggtaggggtaaggtcggggtattccggggaactaacggttactattaacgtccggttaacgttaccgggtaacgggtaaccttaaaccccggtttaaccctaacccccgggtaaccccgtttacccggaacgtaaacgggtacgttaacccggtctaaacccgtaacctaataaccgtttaactaaacccggtttacggaaacccccgtacgggttaaccgtaaacgggttaccggtacccgttttacgtttaaccgggtacccgttaaaggggaccccttcgggttaagtcccgtaccggttttcccgaggggttaaccccgacccccgggtcggggaccgtaacgggtcccggtaaccgtttgtttaccctttgggtaaccggtacgtaacggaagggttaaacgaggaccttaccggagtaccggttggacccggtaagttacccgggttcccgggttacggggggtttcccggttaacgcccgggttaacgggggtacccggagggtacccggggtaccttccggtcgggttaaccc

SEQ ID NO: 229156 - DNA, 580 bp, Homo sapiens
  misc_feature: GYAE6OF02G3BWG.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactagtcactactgggcctggactccgccacgcccccgaggggaacggggctggagtggattggcagtacatatcatacgtgggagtaaccttctaaccaaccccgtccctacaaagagtcgagtcaccatatacaattcgacactaccaagacgtctagtttctaccgtagaacgctgacgtctctgtcgaccgccgcggaccaccggtccgttgttactttcgtgtttacgagtaagataaaggacgacacgtgaggtggactaacgtaacgtcccggggtaccggggttttagaccgttacggcgggggtaccaggggacgcccgttggtacccg

SEQ ID NO: 229157 - DNA, 554 bp, Homo sapiens
  misc_feature: GYAE6OF02I5LQ3.25.11.A11.1.454.CMB.1.raw
  modified_base (431)..(431): a, c, t, g, unknown or other
  misc_feature (431)..(431): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactgggcctggactccgccacgcccccgagggaagggctggagtggattggcagtacatatcatactgggactaaccttctaccaacccgtccctacaagacgtcgagtcacatactcaattgacacgtaccaagatctagttctccgtgacgctgagctctgtcgaccgcgccgacnccggccgtgttactttcgtcgttcgaggtagaagtaaaggagacacgtgagtggactaacgtaagtccgggtccggggttttcgaacgttacggtggggacccgagggtcgcccgtggtaccg

SEQ ID NO: 229158 - DNA, 639 bp, Homo sapiens
  misc_feature: GYAE6OF02IK0Y0.25.11.A11.1.454.CMB.1.raw
  modified_base (296)..(296): a, c, t, g, unknown or other
  misc_feature (296)..(296): n is a, c, g, or t
tcagactgtacagtcacgaccggtgctcgatttagctacgactgcagggggagggaaatgctttctgagagtcatggacctcctgtgcaagaacatgaaacacctgtggttcttcctctgctggtggcggctcccagatgggtcctgtcccagttgcagctgcaggagtcgggcccaggactggtgaagccttcggacgaccctgtccctcacctgcactgtctctggtggcctccatcaggactactagtcactacgtggcctggactccgccacgccccgagggacgggctggngtggagttggcagtacatatcatacgtgggactaaccttctacacccgtcctacaagacgtcgacgtcacctatactacaattcgaacctacggtaccaagtacgtacctaagttcctccggtagaacgtctagacgtcttcgtgtcgacccgccggacggaccgacgggtccgttgttacgtttcgtagtttacgaagtagaagttaaagggcgaacctacgtaggacggttcgggaccttaacggaaccggttcccggggttaccgggggttttagaaccggttaccgggtacgggggaccccgtaagggggtacccgtaccccgggttggttaaccccgg

SEQ ID NO: 229159 - DNA, 688 bp, Homo sapiens
  misc_feature: GYAE6OF02I4MNW.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtcgctccatcaggactactagtcactactggcctggactccgccacgcccccgaggggaacgggcgtcggagtggattggcagtacatatcatacgtgggataaccttctacaacccgtcctacaagacgtcgacgtcaacctatactcaattcgacacgtacaagacgtacgtaagttctaccgtagaacgtcgtacgacgtacctcgtacgtacggacccgtccggaccggaaccgaccgggtacccggttacgttaacgttttcccgttacggtttaccgaaggtaacggtaaacgttaaaacgggacgtaaccgtaacgttggacgggttacggtaaccgttaaccggtaaaccggttcccgggggttacccggggggttttttaacaaccggtttaaccggttcggggggtacccgtaacgggggtacccggtaccccggttagggttaaccccgg

SEQ ID NO: 229160 - DNA, 540 bp, Homo sapiens
  misc_feature: GYAE6OF02GB215.25.11.A11.1.454.CMB.1.raw
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactgggcctggatccgccagcccccagggaggggctggagtggattggcagtacatatcatactgggagaaccttctacaacccgtccctcaagacgtcgaatcaccatatcaattgacacgtccaagagtcagttctccgtgaagctgacgctctgtcgaccgccgcggacacggccgtgtactttctgttcgagagataaaggngcacgtgagtggactaacgaagtcccgggtccggggttttanacggttacgtcggggccaggggcgtacccgtggtacccg

SEQ ID NO: 229161 - DNA, 536 bp, Homo sapiens
  misc_feature: GYAE6OF02JHT97.25.11.A11.1.454.CMB.1.raw
  modified_base (396)..(396): a, c, t, g, unknown or other
  misc_feature (396)..(396): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactgggcctggatccgccagccccccgagggaacggggctcggagtggattggcagtacatatcatactgggagaaccttctacaacccgtcctacaagagtcgagtcaccatatcaattcgacacgtcaagacgtcagttcncgtgaacgctgagctctgtgaccgccgcggacacggccgtgtacttcgtgttcgagtagagtaaaggacgcactgagtgacctagaacgtccgggtcggggtttagacgtacgtcggggccagggcgtcccgtggtcccg

SEQ ID NO: 229162 - DNA, 570 bp, Homo sapiens
  misc_feature: GYAE6OF02GPPM5.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctcatcaggactactagtcactactggcctggatccgccagcccccgagggaagggctggagtggattggcagtacatatcatactgggagtaaccttctaacaacccgtccctagaacgagtcgagtcaccatatcaattgacacgtacaagagtcagttctccgtagaagtctagacgtctcgtacgttcgacccggccgacggaccacgggtccgtgttactttcgtgttccgaaggacgtaagtaaaggagtacacgtgagtaggactaacgacggttccgggtccggggttttagaccgttacggtcggggaccgagggcgtcccgtaggtacccg

SEQ ID NO: 229163 - DNA, 621 bp, Homo sapiens
  misc_feature: GYAE6OF02JEPUM.25.11.A11.1.454.CMB.1.raw
  modified_base (582)..(582): a, c, t, g, unknown or other
  misc_feature (582)..(582): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactgggcctggatccgcacgcccccgagggagggctggagtggattggcagtacatatcatacgtagggataaccttctaaccgtaacccgtccctacgaaagcgtacgaacgtcaaccaatactactaaattgaacctaacgtaccaaagtacgtactacgttccgtaccgtagtaaacgcgttacgagtccgttcgtacggtcgaacccggtccgacgggaaccgtacggccgttagttactttcgttaggtttaccgagtaacgaagtaaaggcgtacgaaccgtggacgtggtacctaacgaacgttccgggtacggggttttanaccgtacggtcgggaccagggaccggtccaggttacccg

SEQ ID NO: 229164 - DNA, 247 bp, Homo sapiens
  misc_feature: GYAE6OF02HFWT1.25.11.A11.1.454.CMB.1.raw
  modified_base (244)..(247): a, c, t, g, unknown or other
  misc_feature (244)..(247): n is a, c, g, or t
tcagactgtacagtcacgaccggtgctcgatttagctacgactgcaggggcgacagcagatggtggagcaagtgactggggccagggaaccctggtaaccgtctcctcaccttccaccaaggcccatcggtcttccccctggcgccctgctccaggagcacctctgggggcacagcggccctgggctgcctggtcaaggactacttccactgtacagtctgagcgggctggcaaggcgcatagnnnn

SEQ ID NO: 229165 - DNA, 522 bp, Homo sapiens
  misc_feature: GYAE6OF02G00RE.25.11.A11.1.454.CMB.1.raw
  modified_base (402)..(402): a, c, t, g, unknown or other
  misc_feature (402)..(402): n is a, c, g, or t
  modified_base (488)..(488): a, c, t, g, unknown or other
  misc_feature (488)..(488): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactgggcctggatccgccagcccccagggagggctggagtggattggcagtacatatcatactgggagaaccttctacaacccgtcctcaagagtcgagtcacatatcaattgacacgtcaagagtcagttctccgtgaagctgagctntgtgaccgcgcgacacggccgtgtacttcgtgttcgagagagtaaaggcgacacgtgagtgactacgagtccgggtcggggttttnacgtacgtcggggccagggcgtcccgtggtcccg

SEQ ID NO: 229166 - DNA, 651 bp, Homo sapiens
  misc_feature: GYAE6OF02I97E6.25.11.A11.1.454.CMB.1.raw
  modified_base (329)..(329): a, c, t, g, unknown or other
  misc_feature (329)..(329): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactagtcactactggcctggactccgccacgccccccagggaacggggctcggagtgggattgggcaggtacatatcatactggganaaccttctaacaacccgtcctacaagcgtcgagtcacatatcaattcgacacgtccaagtacgtctacgttctaccgtagaacgtcgtgaacgtctcgtagttcgacccggtcccgcggtaaccgacggtacccggttgttaacgtttccttgtttacccggagtaacgtaacgttaaaacgggagacctaacgttaggacggttacgggtaccttaacggtaaaccgttcccgggggttacccggggggtttttacgaaccggtttacggttacggggggtacccgagggggtaccggtaccccggttagggttaccccgg

SEQ ID NO: 229167 - DNA, 645 bp, Homo sapiens
  misc_feature: GYAE6OF02HKZHE.25.11.A11.1.454.CMB.1.raw
  modified_base (606)..(606): a, c, t, g, unknown or other
  misc_feature (606)..(606): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactagtcactactggcctggactccgccacgcccccgaggggaacggggcctgggaggtggagttggcagtacatatcagtacgtgggaacgtaacccttctaaccgaacccgtccctacgaaacgacgtacgagtaccaaccattaactactaaattcgaactaaccgtaccgaaagtacgttacgtaacgtttccgtaccggtagtaaacgtccgtaggacgtcttcgtacggttacgtacccgcccggtaccgggaccgaccggacctacgttcgttacttttccgtgttacgagtaagtaagtaaacggagactagtagtacgtacggtactacgaacggttcccgggtacggggttttnacgttacggtcgggaccgtacgggtacgtcccgtacggg

SEQ ID NO: 229168 - DNA, 601 bp, Homo sapiens
  misc_feature: GYAE6OF02I32E9.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggacgacctgtccctcacctgcactgtctctggtgctcatcaggactactagtcactactgggcctggactccgccacgcccccagggacgggctggagtggatggcagtacatatcatacgtgggataaccttcacaaccccgtccctcaagacgtcgagtcaacatatacaattcgacacgtaccagctactagttcctcgtgaacgtctagacgctcgtgtcgcccgccggcggaccgaccgggtccgttgttacttttcgttacggttcgaacggagtaacgttaaaagggctaacgacgtggaggttggacgtaaccggtaacggttcccgggggtaccgggggttttagaccggttacggtcgggggtaccaagggggtaccgtacccggttggtaccccg

SEQ ID NO: 229169 - DNA, 666 bp, Homo sapiens
  misc_feature: GYAE6OF02HXPCF.25.11.A11.1.454.CMB.1.raw
  modified_base (167)..(167): a, c, t, g, unknown or other
  misc_feature (167)..(167): n is a, c, g, or t
tcagactgtacagtcacgaccggtgctcgatttagctacgactgcagggggagggaaatgctttctgagagtcatggacctcctgtgcaagaacatgaaacacctgtgttcttcctcctgctggtggcggctcccagatgggtcctgtcccagttgcagctgcaggngtcgggcccaggactggtgaacgtccgttcggacgaccctgtccctcacctgcactgtcctctggtcggcctccatcgaggactactagtcactacgtggctgatccgccacgccccgagggagggcgtggacgtggtagttggcacgtacatatctatacgtagggtactaaccttcaaccgtacccgtaccctataacggtacgtacgacgtaccacaagttactaacgtaattacggaactacgtaccaagtacgtactacgttccgtcgtagacgtctagctcgtctcgtaccgaccgccggtccgaacgccggaccgtagtttacgttacgtttccgtcggttacgaacggtacgtaaacggaaacggtaactaccgtagtcggtaacgggttcgtaaccggtaacgtaccgggttccggggggtttacccgggtttaggtaccggtaacgggttcgggaacccgggtacgggtcccggtcccgttaacccggg

SEQ ID NO: 229170 - DNA, 696 bp, Homo sapiens
  misc_feature: GYAE6OF02I0B6C.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctccagatgggtcctgtcccagttgcagctgcaggagtccgggcccaggacgtggtagaacgtccgttcggacgtaccccgtgtcccctcacctcgcctacgtcgtccttcgtggtcgcctaccgtatcgaggtactactacgtcacgttacgtcgggcctaggtactcccgaccgaccggcccccggaaggggaacgggtcgtacgggaggtcgggtagttcggacgtaacggtacaattacgtactaagtacggtacgggtaactacccttacgtaacccgtaaccccgtcctacgaagtcgtacgacgtaccactatactacattacgaactacgtacgaagtactacgtacgttcgtccgtaaggactcgtagtcgtacgtcgtacgaccggaccgtccggccggaacgtccggtacgttgttaccgttctcggtacgaagtacgtaaagacggctacgtagtcggtacgacgtaccgaacggttaccgggttccggggttaacgggtttcgaccggttacggggtcggaaaccgggtggtaccgtcccggtggtaaccccg

SEQ ID NO: 229171 - DNA, 554 bp, Homo sapiens
  misc_feature: GYAE6OF02IJZ4M.25.11.A11.1.454.CMB.1.raw
  modified_base (376)..(376): a, c, t, g, unknown or other
  misc_feature (376)..(376): n is a, c, g, or t
  modified_base (477)..(477): a, c, t, g, unknown or other
  misc_feature (477)..(477): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtggctccatcaggactactagtcactactggcctggatccgccagcccccagggaagggcgtggagtggattgggcaggtacatatcatactgggagaaccttctaacaacccgtccctcaagtacgtacgagtacacatatcaaattnacacgtccaagtacgtcaacgttctaccgtgagactgagctactcgtcgccgccgcggtacacggccgtgtactttcgtgttcgagtagaacgtaaaggancgacgtgagtgtcgtaactacgtccgggtacggggtttcgacgtacggtcgggccgagggtcgcccgttggtacccg

SEQ ID NO: 229172 - DNA, 746 bp, Homo sapiens
  misc_feature: GYAE6OF02FGMLG.25.11.A11.1.454.CMB.1.raw
  modified_base (240)..(240): a, c, t, g, unknown or other
  misc_feature (240)..(240): n is a, c, g, or t
tcagactgtacagtcacgaccggtgctcgatttagctacgactgcaggggagggaaatgctttctgagagtcatcggacctcctgtcgcaagaacatgaaaccaccctgtggttcttcctcctgctggtggcggctcccagatgggtcctgtcccagttgcagcctgcaggagtccgggcccaggactggtgaacgtccgttcggacgccccttgtcccctcacctgccactgcttacgnggtcgctccatcaggacttacctagtcactacgtcggtcctggactcccgcccgacgaccccccgaggggacgggtcctaggtaggtaggtacttcggaccaggtaccagttaactaccagtacgtgggaactaacccttactaaccctaaccccggtccctacgaagtacgtccggaacttccgaacctagtactaccgtaacttacgacctaaccgtaccgaaagtacgtcgtacgtttcctcggtaggtaacgtcgtacgtacgtcctacgtggccgtacccgcccggacgaccgacggtccgttcgttacgttcctaggtttccgaagtaacgtaaagtaaacggtacgtacgtacgttacgggtacgtcggacccttaaaccgaccggttaaccccgggggtttacccgggggtttttaacgaacccgggttaacccggggtttacgggggaaccccggttaaggggtccccggtacccccggtttacggggtaacccccg

SEQ ID NO: 229173 - DNA, 733 bp, Homo sapiens
  misc_feature: GYAE6OF02IJKQX.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggccctaggactggtgaacgccttcgggagaccctgtccctcacctgcactgtctcgtggtcgcctccatcaggactactagtcactagtcggctggactccgccacgccccgaagggaacgggctacggagtggagttggacagtacatactactacgtaacgtggaactaaccttactaacctaacccggtcctacgaagtacgtacgtacgtacgaacctaagtaactactaaacgttacgaacctaacggtaccgaaaggtaacgtactacggtttaccttaccggtaagtaaggtaccgtacgggacgtaccgttacgtacggtacccggaccccggtccgggacccggtaacggtaccgggtccggttaagtttaccgttttcggttacgttaccggaaggtacggtaaacgtaaaacgggtcgtaaccgtaacggtggtacgtcgggtaaccgtaaacgtaacccgggttccgggggttaccgggtttaacgaaccggttacggggtaccggggacccggtaaggggtacccgtccccgggttaggtaaccccgg

SEQ ID NO: 229174 - DNA, 754 bp, Homo sapiens
  misc_feature: GYAE6OF02H5TBJ.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttcttcctcctgctggtggcggctcccagagtgggttccttcgtcccaggttgcagctgacgaggacggtccgggcccgaggtactgggtcgaacgtccgttcggacgacccttcgtcccctacacctgacacgtcgtcctgtggtcggtcctccagtcgaggtacctactacgtctaccgtacgtcggccgtcggacctcccgaccgacccggcccgtacgggggacggggacgtggacggtggagttggacgtacgtacgaacttactacgtaagtaacggtacgggaacgtaaacccctttaccgtaacccgtaccccggttccctaacgtaagtacggtaccgtaacgtaccgtaacctaagttactaacttaaacgttcgtaaacctcgtaaccgaaggtacgtccttacggtccgttacgtgtaactcgagtcgtcccgttagtcggtaccgccgtaccggaccgtaccgcggtccgttgttcgttactacggttcgaaggtaacggtaaagttaaccgggatacgtacgtagtcggttaccggtacttacgggtacccggtttccggggggttaacgtttaccggtcggtaccggggttacgggacccgggtacgggtacgtccccggtacggttaccg

SEQ ID NO: 229175 - DNA, 728 bp, Homo sapiens
  misc_feature: GYAE6OF02JLPBF.25.11.A11.1.454.CMB.1.raw
  modified_base (211)..(211): a, c, t, g, unknown or other
  misc_feature (211)..(211): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggacgtcgggcccaggactggtcgaagccttcggagaccctgtcccncacctgcactgtctctgggtcgcctccatcgaggaccttactagtcacctacgtgggacctcggactcccgccaaccggcccccgagggggaacgggccgtagggaggtggtagttcgggacgagtaccatacgtacagtacgtagggaacgtaaccgttacctaaccgtaccccgtaccctacaaacggtaacgtccgacgtacctaaccgataactactaaacgttcgaacgtaccgtaccgtaaaggacgtaccgtacgtttaccgtaccgtaaggacgtactaggaacggtctcgtacgttcggacccggtaccgaccggacgtaccggtaccgtttacggttacttttaccgttcggtttaacgacgggtaacgtaaacgttaaagggaccgtaacgtaccgtagtacggcggtaccctaacgtaacggttcccggggtacccgggggtttttacaccggttaccgggtcggggtaccggtaacgggtacggtcccggttacgggtaccccg

SEQ ID NO: 229176 - DNA, 671 bp, Homo sapiens
  misc_feature: GYAE6OF02FUAW6.25.11.A11.1.454.CMB.1.raw
tcagactgtacagtcacgaccggtgctcgatttagctacgactgcagggggagggaaatgctttctgagagtcatggacctcctgtgcaagaacatgaaacacctgtgttcttcctcctgctggtggcggctcccagatgggtcctgtcccagttgcagctgcaggagtcgggcccaggactgggtagagccgttggacgaccctcgtccctcacctgcactgtctcgtggtgctccgatcgacggactactagtctacgtacgtggcctggacttccgccgtaccgcccccggaaggggaacgggtcggtggtaggtggtaagttggcagtacatatactagtacgtagggtactaaccgttctaaccgtaacccttcctacgaacggtacgtcgacgtccactataactactaattagaaccgtacgtaaccgaggtacttcgtacgtttactcccggtagtaacgtctaggtcgtacctcttacgggttccgacccggccgtacgggaccgtaccgggtccgttggttacttcggttagtcggggtaacaaggtaataaacgggcgtagacgttggacggttcgtaaccgttcgtacgggttcccgggttcggggtttataccgggtacgttccgggggatacccggggtgttcccggacggttcccg

SEQ ID NO: 229177 - DNA, 780 bp, Homo sapiens
  misc_feature: GYAE6OF02F8SNJ.25.11.A11.1.454.CMB.1.raw
tcagactgtacagtcacgaccggtgctcgatttagctacgactgcaggggagggaaatgctttctgagagtcatggacctcctgtgcaagaacatgaaacacctgtggttctccctcctgctggtggcagctcccagatggtcctgtcccaggtgcagctgcgaggacgtcgggccaggctggtgaacgccttcacacgaccctcgtccctcgaccctgccacgtcgtcctcgtggtcgcctccatccaccgtagttcggttactaccgtaacgtaccgtggacgtcgtcggtaaccgtcccgaccgtagacccgaacccggaacgggggaaccggttcccgttagggaaccgggttggtacggtttacgggtaacctacgtttacgtttaacggttacccgggttagggtaccgtccctttaacccgttccgttaacccctaaacccccgggttcccttaactaaaccgttaccggtaccgtacgttacccaaccgtactccttaacgtaagttaccgaacgtaccgtttaacgaaaacccgttaacccgtacgtttccctaccccgttaagttaacgttaacgtaccgttacgtacgtacggtacgtaacgggtcccgacggtacccgtaacgtcgttacggttacttacgtcggtagtaccgggtcttaaccgtacctaaaggtaccgttagttaacggtcgtaactacgtactaccctaacgtagtaccgttaccgctttacggtttacctttagaaccgttggtccgtaccgggg

SEQ ID NO: 229178 - DNA, 653 bp, Homo sapiens
  misc_feature: GYAE6OF02I9QHN.25.11.A11.1.454.CMB.1.raw
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
tcagactgtacagtcacgaccggtgctcgatttagctacgactgcaggggagggaaatgctttctgagagtcatggacctcctgtgcaagaacatgaaacacctgtggttcttcctcctgctggtggcggctcccagatgggtcctgtcccagttgcagctgcaggagtcgggcccaggactggtgaagtccttcggacgaccctgtccctcacctgcactgtctctggtcgcctccatcaggtactacgtacgtcacgtactcgggcctggactccgccacgccccgaggggacggctggagtggagtggctagtacatancatacgnggactacctacacctacccgtccacgagtacgcgacgtccactatactactaattcgaactaccgtacgaagtcgtactacgttccgtacgtagacgtcgtacggagtccttacgtcggttacggacccgtccgggacccgggacgtaccgggtcccgttagttacgtttccgtcggttaacgacggtaacgtaaagtaaacgggagtaccctaaggtatagggtccgtaacgttaacggtaaccggtcccgggggtttacggggtttacgaccggtttacgggccgggtaaccgacggggtccgtcccggtaggttaccccgg

SEQ ID NO: 229179 - DNA, 123 bp, Homo sapiens
  misc_feature: GYAE6OF01CLK6A.34.20.B09.1.454.CMB.1.raw
  modified_base (123)..(123): a, c, t, g, unknown or other
  misc_feature (123)..(123): n is a, c, g, or t
tcagtacacgtgatcacgaccggtgctcgatttagtgtagtgtgaagggcacagcggccctgggctgcctggtcaaggactacttccatcacgtgtactgagcgggctggcaaggcgcatagn

SEQ ID NO: 229180 - DNA, 123 bp, Homo sapiens; identical to SEQ ID NO: 229179
  misc_feature: GYAE6OF01AI7P1.34.20.B09.1.454.CMB.1.raw
  modified_base (123)..(123): a, c, t, g, unknown or other
  misc_feature (123)..(123): n is a, c, g, or t

SEQ ID NO: 229181 - DNA, 668 bp, Homo sapiens
  misc_feature: GYAE6OF01EX4SK.34.20.B09.1.454.CMB.1.raw
  modified_base (283)..(283): a, c, t, g, unknown or other
  misc_feature (283)..(283): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (520)..(520): a, c, t, g, unknown or other
  misc_feature (520)..(520): n is a, c, g, or t
tcagtacacgtgatcacgaccggtgctcgatttagtgtagtgtgaagggtccggtagttcaccgtcgtccagagacgaacttctaagaagctcgttttcgtgcaatgacagcctgagacgtcggactgacacggccgtctattacctagttgccgaaggagacggggccgtcggcctgggccaaccatgctttcgtagtgtctggggccaagggaccaaatggtctaccgtccgtcttcagccgtccaccaagggcccatcggttctttccccctcggtccgntacccgtccctaccgaacgacgaccaccgtccgtcggggccacgacggccggtcccgtcgggtcgtcgtccgttcggctacgtaaccggtaaccgttaccttaccgtacgttacggtaccgggttacggtaccgtacggtacggtccgggtcggtcggacgaacgggccggacgtacgtacggacgacgagtacacnctcacactcncncncncgcgtcgcgtacgtacgttacgcncgttttacgttacgtacgtttacgtttaacgtaacgttacttaactacgtaaccttacgttagtaccgttaccgtacgtacggtaccgtacggtacggacggtacgacggtacgtacgtacgaccgtacgtacgacgtacgtcgcgtc

SEQ ID NO: 229182 - DNA, 123 bp, Homo sapiens; identical to SEQ ID NO: 229179
  misc_feature: GYAE6OF01EEVY5.34.20.B09.1.454.CMB.1.raw
  modified_base (123)..(123): a, c, t, g, unknown or other
  misc_feature (123)..(123): n is a, c, g, or t

SEQ ID NO: 229183 - DNA, 123 bp, Homo sapiens; identical to SEQ ID NO: 229179
  misc_feature: GYAE6OF01AT4EE.34.20.B09.1.454.CMB.1.raw
  modified_base (123)..(123): a, c, t, g, unknown or other
  misc_feature (123)..(123): n is a, c, g, or t

SEQ ID NO: 229184 - DNA, 356 bp, Homo sapiens
  misc_feature: GYAE6OF01DSCTJ.34.20.B09.1.454.CMB.1.raw
  modified_base (354)..(356): a, c, t, g, unknown or other
  misc_feature (354)..(356): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttcccctggccaccctcctccaagagcacctctgggggcacagcggccctgggctgcctggtcaaggactacttccatcacgtgtactgagcgggctggcaaggcgcatagnnn

SEQ ID NO: 229185 - DNA, 358 bp, Homo sapiens
  misc_feature: GYAE6OF01AXKW8.34.20.B09.1.454.CMB.1.raw
  modified_base (350)..(358): a, c, t, g, unknown or other
  misc_feature (350)..(358): n is a, c, g, or t
tcagtacacgtgatcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggctacttccatcacgtgtactgagcgggctggcaaggcgcatagnnnnnnnnn

SEQ ID NO: 229186 - DNA, 352 bp, Homo sapiens
  misc_feature: GYAE6OF01E36NC.34.20.B09.1.454.CMB.1.raw
  modified_base (350)..(352): a, c, t, g, unknown or other
  misc_feature (350)..(352): n is a, c, g, or t
tcagtacacgtgatcacgaccggtgctcgatttagtgtagtgtgaagggccggttcaccatctccagagacaattccaacagcacgctgtatttgcacatgaacagcctgagagccgaggacacggccatatattattgtgtgaaacttccttttgactggttattatcccctagtgaccactggggccagggaaccctggtcaccgtctcctcagcctccaccaagggcccatcggtcttccccctggcaccctcctccaagagcacctctgggggcacagcggcctgggctgcctggtcaaggactacttccatcacgtgtactgagcgggctggcaaggcgcatagnnn

SEQ ID NO: 229187 - DNA, 357 bp, Homo sapiens
  misc_feature: GYAE6OF01BM48Q.34.20.B09.1.454.CMB.1.raw
  modified_base (351)..(357): a, c, t, g, unknown or other
  misc_feature (351)..(357): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaaggcccatcggtcttccccctggcaccctcctccaagagcacctctggggcacagcggccctgggctgcctggtcaaggactactccatcacgtgtactgagcgggctggcaaggcgcatagnnnnnnn

SEQ ID NO: 229188 - DNA, 217 bp, Homo sapiens
  misc_feature: GYAE6OF01CB4RM.34.20.B09.1.454.CMB.1.raw
  modified_base (215)..(217): a, c, t, g, unknown or other
  misc_feature (215)..(217): n is a, c, g, or t
tcagtacacgtgatcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccatcacgtgtactgagcgggctggcaaggcgcatagnnn

SEQ ID NO: 229189 - DNA, 359 bp, Homo sapiens
  misc_feature: GYAE6OF01DP979.34.20.B09.1.454.CMB.1.raw
  modified_base (354)..(359): a, c, t, g, unknown or other
  misc_feature (354)..(359): n is a, c, g, or t
tcagtacacgtgatcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtccttccccctggccaccctcctccaagacgcacctctgggggcacagcggccctggctgcctggtcaaggactacttccatccacgtgtactgagcgggctggcaaggcgcatagnnnnnn

SEQ ID NO: 229190 - DNA, 360 bp, Homo sapiens
  misc_feature: GYAE6OF01BK8AE.34.20.B09.1.454.CMB.1.raw
  modified_base (353)..(360): a, c, t, g, unknown or other
  misc_feature (353)..(360): n is a, c, g, or t
tcagtacacgtgatcacgaccggtgctcgatttagtgtagtgtgaagggccgattcaccgtctccagagacaattctaagaagctcgttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggcaccctcctccaagagcacctctgggggcacagcggccctgggctgccctggtcaaggctacttccatcacgtgtactgagcgggctggcaaggcgcatagnnnnnnnn

SEQ ID NO: 229191 - DNA, 698 bp, Homo sapiens
  misc_feature: GYAE6OF01B6924.34.20.B09.1.454.CMB.1.raw
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagcgtgcgttttctaggtggcaactttaaaaggtgtccagtgtgacgtacagctgttggagtcgggggagccttgacacagccggggggatcgtctgagactctcctgtgaagcctctggtttcactttagcgactatgccatgagctgggtccgccagactccgagggaagggcctgcaggtcgggtcgcggttatagtggaagcactgctgtcacatcccacgctgactctgtgaacgggccgaattccaccgtctacccagtacgactaattctaaagaacgtcttacggtttttctaggacctaaaattcgaaacgtacgaccctaggaacggtaacgttcggaacttacggaaccgtaacccggggtcccgttacgtttaacgtttaaccgttgggttaacggacggaaaacggggtacgggtaaccgggggggtacccggttacgggggtccgggttacccggggggaccccctaaaacccggtaggttaccgggttacccgtttttaccgggaagtttcggggttacccggtacgggggggtaaacccccggg

SEQ ID NO: 229192 - DNA, 357 bp, Homo sapiens
  misc_feature: GYAE6OF01B94ME.34.20.B09.1.454.CMB.1.raw
  modified_base (352)..(357): a, c, t, g, unknown or other
  misc_feature (352)..(357): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccattggtcttccccctggcaccctcctccaagagcacctctggggcacagcggccctgggctgcctggtcaaggctacttccatcacgtgtactgagcgggctggcaaggcgcatagnnnnnn

SEQ ID NO: 229193 - DNA, 450 bp, Homo sapiens
  misc_feature: GYAE6OF01DU18R.34.20.B09.1.454.CMB.1.raw
  modified_base (319)..(319): a, c, t, g, unknown or other
  misc_feature (319)..(319): n is a, c, g, or t
  modified_base (434)..(434): a, c, t, g, unknown or other
  misc_feature (434)..(434): n is a, c, g, or t
  modified_base (439)..(450): a, c, t, g, unknown or other
  misc_feature (439)..(450): n is a, c, g, or t
tcagtacacgtgatcacgaccggtgctcgatttagtgtagtgtgaagggcctgcagtgggtcgcggttattagtggaagcactgctgtcacatcccacgctgactctgtgaagggccgattcaccgtctccagagacaattctaagaagcttcgtttttctgcaaatgaacagcctgagagtcgatgacacggccgtctattactgtgcgaaggagaggggcctggctgggccaaccatgctttcgatgtctggggccaagggacaatggtcaccgtctcttcagccctccaccaacgggcccatccggtcttcccccnggcacccctcctccaagacgccacctcgtcgggggccacacggccggccctggggcctcggcctggtcaacggactaccgttccatcacgtgtactgaggcgggctggcaaggcnatagnnnnnnnnnnnn

SEQ ID NO: 229194 - DNA, 366 bp, Homo sapiens
  misc_feature: GYAE6OF01C9D8R.34.20.B09.1.454.CMB.1.raw
  modified_base (357)..(366): a, c, t, g, unknown or other
  misc_feature (357)..(366): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaaatggtcaccgtctcttcagcctccaccaagggcccatcggtcttccccctggcacccctcctccaaagagcaacctctgggggacacagcggccctgggctgcctggcaaggctacttccatcacgtgtactgagcgggctggcaaggcgcatagnnnnnnnnnn

SEQ ID NO: 229195 - DNA, 776 bp, Homo sapiens
  misc_feature: GYAE6OF01EHOFC.34.20.B09.1.454.CMB.1.raw
  modified_base (205)..(205): a, c, t, g, unknown or other
  misc_feature (205)..(205): n is a, c, g, or t
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagcggtgtgtttcaggtcgcaactttaaaggtgtcagtgtgacgtacagctgttggaggtcgggggngccgttgacacgaggccgggggatctctgacgactctcctgtacgaacgtcctcgttggtttactacctttagctactatcgcctatgagtcgtcgggtccgcaagctaccgagggacggccgtgcgtaggtcgggtccgtggtttagttaggtaggaacgactacgttggcgtacgtccaaacgtcctaaccccgacggtaccttcggaaccttcgttggtaacggggaaaccggggtcccttaacggtttaccctacccggttcctaaccgtaaggaacgtaaacttaacttaaccgtaaagtaaccgggtttcctttttcggtttttaaccaggttaaacctaaagggttacgaaaccttaacgcccgtttagggaataaccgttagaaacgttcgaaacccgttccggtacggtttaacttaacgttcggttagtaacgggacgggaaaggtacggggtcggggtcccgggtcgggttaccggacgggaacccctaacggttacgttcggtttaccgttaaccggtaaggttccgggtttaaaccggggtccgggtaaaacccgggg

SEQ ID NO: 229196 - DNA, 409 bp, Homo sapiens
  misc_feature: GYAE6OF01B0RBC.34.20.B09.1.454.CMB.1.raw
  modified_base (393)..(409): a, c, t, g, unknown or other
  misc_feature (393)..(409): n is a, c, g, or t
tcagtacacgtgatcacgaccggtgctcgatttagtgtagtgtgaagggccgattcaccgtctccagagacaattctaagaagctcgtttttctgcaaaatgaacagcctgagagtcgatgacacggccgtctattactgtgcgaaggagaggggccgtggctgggccaaccatgctttcgatgtctggggccaagggacaatggtcaccgttctcttcagccctccaccaagggcccatccggtccttccccctggccaccctcctaccgaaagacgccaccctcgtcgggggcaccgaggccggccctggggcctcgcccgtggtacaaacggaccttaccttccatccacgttgtactgacggcgggtctggacaagggcgcaagtagcnnnnnnnnnnnnnnnnn

SEQ ID NO: 229197 - DNA, 464 bp, Homo sapiens
  misc_feature: GYAE6OF01DSKK1.34.20.B09.1.454.CMB.1.raw
  modified_base (161)..(161): a, c, t, g, unknown or other
  misc_feature (161)..(161): n is a, c, g, or t
  modified_base (447)..(464): a, c, t, g, unknown or other
  misc_feature (447)..(464): n is a, c, g, or t
tcagtacacgtgatcacgaccggtgctcgatttagtgtagtgtgaagggcctgcagtgggtcgcggttattagtggaagcactgctgtcacatcccacgctgactctgtgaagggccgattcaccgtctccagagacaattctaagaagcttcgtttttcngcaaatgaacagcctgagagtcgatgacacggccgtctattactgtgcgaaggagaggggccgtggctgggccaaccatgctttcgatgtcgtgggccaagggacaatggtcaccgtctcttcacgcctccaccgacggcccagtccgtcctccccgtcggccaccctcctccaacgcgccacctcgtcgggggcacgacggccggcccgtgggctcgccgtggtcaaggccttacttccactctacgtcgtacgtgacggcgggcgtggacgaaggcgcagtagnnnnnnnnnnnnnnnnnn

SEQ ID NO: 229198 - DNA, 359 bp, Homo sapiens
  misc_feature: GYAE6OF01AGIBE.34.20.B09.1.454.CMB.1.raw
  modified_base (353)..(359): a, c, t, g, unknown or other
  misc_feature (353)..(359): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggccaccctcctccaagagcacctctggggcacagcggccctgggctgcctggtcaaggactacttccatcacgtgtactgagcggctggcaaggcgcatagnnnnnnn

SEQ ID NO: 229199 - DNA, 119 bp, Homo sapiens
  misc_feature: GYAE6OF01CA2J7.34.20.B09.1.454.CMB.1.raw
  modified_base (115)..(119): a, c, t, g, unknown or other
  misc_feature (115)..(119): n is a, c, g, or t
tcagtacacgtgatcacgaccggtgctcgatttagtgtagtgtgaagggggagagaggagcccagccctgggattttcgggtgttttcatttggtgatcaggtctagaacagagnnnnn

SEQ ID NO: 229200 - DNA, 650 bp, Homo sapiens
  misc_feature: GYAE6OF01EAB92.34.20.B09.1.454.CMB.1.raw
  modified_base (482)..(482): a, c, t, g, unknown or other
  misc_feature (482)..(482): n is a, c, g, or t
  modified_base (520)..(520): a, c, t, g, unknown or other
  misc_feature (520)..(520): n is a, c, g, or t
  modified_base (541)..(541): a, c, t, g, unknown or other
  misc_feature (541)..(541): n is a, c, g, or t
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
tcagtacacgtgatcacgaccggtgctcgattttagtgtagtgtgaagggccgattacaccgtctccagaggacaattctaagaagcttcgtttttctgcaaaatgaacagcctgagagtcgaatgtacacggccgttcgtattactgtgccgaaggagaggggtccgtggcgtgggccgaaccgatgctttccgatgtcgtgggccaaagggactaagtggtcaccgtctcttcacgccgtccgacccgaccggcccagtccggttccgttccccccgtggccctacccgtccctaccaaagaacgccaaccgttccggtgggggccaacgaacggccggcccgtagggcctcggcccgttacgggtaccgaaacgggtaccttaacgtttcccgtaacgttaccgtacggttcgttaacgttaggaaacggtaccgggtccgtacgggacgaacgggccgtacgaacgttagacgcgtcncgcgcgcgcgacgacgacgtcgtcgtcgtcgtcgcgcncgcgcgacgcgacgacgacgngcgacgacgacgcgacgtcgcgtcgacgtacgtacgtacgtacgtacgactcgtacgtcgtagtacgtcgcggacgtacgtacgtacgagacgacganagancngngng

SEQ ID NO: 229201 - DNA, 773 bp, Homo sapiens
  misc_feature: GYAE6OF01B0ZKL.34.20.B09.1.454.CMB.1.raw
  modified_base (213)..(213): a, c, t, g, unknown or other
  misc_feature (213)..(213): n is a, c, g, or t
  modified_base (333)..(333): a, c, t, g, unknown or other
  misc_feature (333)..(333): n is a, c, g, or t
tcagtacacgtgatcacgaccggtgctcgatttagtgtagtgtgaagggggagagaggagcccagccctgggtattttcgggtgttttcattttggtgatcaggtctgaacagagagaactcaccatggagtttgggctgagctggtctttttcgtggtggctaaactttaaaggtgtccagtgtgacgtacagctgttggaggtcggggganccttgacacgacggcgggggatctctgagctctctgtgacgtcctcttggttactacctttagcgtacttagtcgccagtgagtcgtcgggtccgccagacctacggagggaacggtccnggacgtaggtcgggtcggtacggtttaagtaggtagggaacgcgtacgtgtcctaggtccaactacctcccgaagtcctacgtactcgttaggacggaaaccgggcctaacgttcccgacccggttctaaccgaaggaaccgtaacgtaaaccgttaaccccgaaacgtaaacccgtaccgtacgttaagttactacgtaaccggtaaactaaacgtacgaacccgaaacggttccgtaacggaacggaaccgggaccggaaacggacccgggtaaccggttacctaagggtttaacccggtttaatttaccggtcgggttaaccggaacgggtaaacggacgggaaacggtaaaccgaccggtaaccccggtaccggtaacggtaaacgggttcgaaacgttcccggtaacccgtttacggtcccgttaacccgggggg

SEQ ID NO: 229202 - DNA, 472 bp, Homo sapiens
  misc_feature: GYAE6OF01ESSPJ.34.20.B09.1.454.CMB.1.raw
  modified_base (413)..(413): a, c, t, g, unknown or other
  misc_feature (413)..(413): n is a, c, g, or t
  modified_base (452)..(452): a, c, t, g, unknown or other
  misc_feature (452)..(452): n is a, c, g, or t
  modified_base (454)..(472): a, c, t, g, unknown or other
  misc_feature (454)..(472): n is a, c, g, or t
tcagtacacgtgatcacgaccggtgctcgatttagtgtagtgtgaagggccgattcaccgtctccagagacaattctaaagaagcttcgtttttctgcaaaatgaacagcctgagagtcgatgacacggcctctattactggtgacgaaggaggagggggccgtggcgtgggaccaaccatgtctttcgattggtcggtcggggaccaaagggacaagtcggtacctaccgttctcttcacgtccctaccaaccgaacgggccctacgttccggttcccttccccctggacccaccctcctaccgaacgacaccaccgtcggtcgggggaccacgacggccggtcccggtgggcctcggaccggttggttaccgaaacggtaccttaccgttaccatccgtaacgtcgtacgnggtacgggcgggtactcgggacgacggcgactagtagcngnnnnnnnnnnnnnnnnnnn

SEQ ID NO: 229203 - DNA, 688 bp, Homo sapiens
  misc_feature: GYAE6OF01B90BT.34.20.B09.1.454.CMB.1.raw
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagctggctttttctggtggcaaactttaaaaggtgtccagtgtgacgtacagctgttggaggtcggggggagccttgacacaggccggggggatctctgacgactctcctgtgaacgcctcttggtttctacctttagcgtactatgccatgagtccgtgggtcccgaccacgacctaccgaaggggaacgggcctgcgaggttcggggtcgtacggtttagttaggtaggaacgcacgtgactcggtccacactcccgacgctacgactcgtggtaggaacgggtccgtattcccgaccgtcctacccgaagaacgtaactaacttacgaaagtacgtctttacgtttttacgacgtactaaagtcgaaacctagtacccgtaggaagacggttagacgtacggaaccgtaccggtcccgttaagtttacgttacgtaggtcgaacgggtaaaggggcgggtaacgggggtccgggtacggtccggtacgggacccaacccgtagtcgttcgtttaccggaggttaccggtcgggcggggtaaacccgg

SEQ ID NO: 229204 - DNA, 533 bp, Homo sapiens
  misc_feature: GYAE6OF01ECIA6.34.20.B09.1.454.CMB.1.raw
  modified_base (160)..(160): a, c, t, g, unknown or other
  misc_feature (160)..(160): n is a, c, g, or t
  modified_base (256)..(256): a, c, t, g, unknown or other
  misc_feature (256)..(256): n is a, c, g, or t
  modified_base (316)..(316): a, c, t, g, unknown or other
  misc_feature (316)..(316): n is a, c, g, or t
  modified_base (481)..(481): a, c, t, g, unknown or other
  misc_feature (481)..(481): n is a, c, g, or t
  modified_base (514)..(533): a, c, t, g, unknown or other
  misc_feature (514)..(533): n is a, c, g, or t
tcagtacacgtgatcacgaccggtgctcgatttagtgtagtgtgaagggcctgcagtgggtcgcggttattagtggaagcactgctgtcacatcccacgctgactctgtgaaggccgattcaccgtctccagagacaattctaagaagcttcgtttttcngcaaatgaacagcctgagagtgatgacgacggtccgttctattactgtgacggaaagggaggagggggccgttgggccgtacggggacccaaaccnttcggtcttttcggatcggtcgtggggaccaaagggacaagtcggtccaccgtctcttcncgccctccaccgaacggccctacgttccggtcccttcccccgtggccctaccccttcccaccaacgccgccgtacccgttcgggcggggccaccgacgggcccggcccgtgggcctcggccgtggtaccgaacggtacctaccttccacgtcgtacgtgtaccgnggacggcgggcgtaggacgacggcacgacgtannnnnnnnnnnnnnnnnnnn

SEQ ID NO: 229205 - DNA, 610 bp, Homo sapiens
  misc_feature: GYAE6OF01CRWC2.34.20.B09.1.454.CMB.1.raw
  modified_base (164)..(164): a, c, t, g, unknown or other
  misc_feature (164)..(164): n is a, c, g, or t
  modified_base (575)..(575): a, c, t, g, unknown or other
  misc_feature (575)..(575): n is a, c, g, or t
  modified_base (583)..(610): a, c, t, g, unknown or other
  misc_feature (583)..(610): n is a, c, g, or t
tcagtacacgtgatcacgaccggtgctcgatttagtgtagtgtgaagggcctgcagtgggtcgcggttattagtggaagcactgctgtcacatccccacgctgactctgtgaagggccgattcaccgtctccagagacaattctaaagaagcttcgttttttcngacaaatgaacagcctgagagtcgatcgacacggccgtctattactgtgacggaaggaggacgggggtcccgtggccgtcggggacccaaaaccgtgttcggtccttttcggagtttcggtccgggtacgggggacccgaaaggggtaaccaagttcgggtacctaacccgttcttccttccgacggtacccccttacccgaacccgaacggggcccctacggttccccgggtcccctttaccccccgtggacccctacccccgtacctaacccgaaacgaccgccctaacccggtcggtacgggggccacggaccggcccgggcccgtgggccttccggccgttggacgaagtaccttccttcatcgtacgtgtacgtggacggtccggggtctcggacgaacggtcganacgtagannnnnnnnnnnnnnnnnnnnnnnnnnnn

SEQ ID NO: 229206 - DNA, 394 bp, Homo sapiens
  misc_feature: GYAE6OF01E0650.34.20.B09.1.454.CMB.1.raw
  modified_base (363)..(366): a, c, t, g, unknown or other
  misc_feature (363)..(366): n is a, c, g, or t
  modified_base (368)..(394): a, c, t, g, unknown or other
  misc_feature (368)..(394): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattacctgtgcgaaggagaggggccgtggctgggccaaccatgctttcgatgtctggggccaagggacaatggtcaccgcctcttcagcctccaccaagggccccatcggtccttcccccctggccaccctcctccaagacgcacctctgggggcacagccggccctgggctgcctggtcaaggctactccatcacgtgtactgacggcgggctggcaaggcgacagtagnnnncnnnnnnnnnnnnnnnnnnnnnnnnnnn

SEQ ID NO: 229207 - DNA, 795 bp, Homo sapiens
  misc_feature: GYAE6OF01BHXCC.34.20.B09.1.454.CMB.1.raw
tcagtacacgtgatcacgaccggtgctcgatttagtgtagtgtgaggtgcagctgctggagtctggggggaggcttggtacagccgggggggtccctgagactctcctgtgaagcctctggattcacctttgacaagtgtgccatgaccgtgggtccgccaggcctccgaggggaaggggctggagtgggtctcagttattagtggtagtggtagtagcacagattacgcagactcgtgaaggccgttcacatctcagagacaattccaacagcacgctagtatttgacacatgaacagcctagagagccgagacacggccaatagtattaagttcgtagaccgtaaactttccgttttagacgttggtttaacttaccgttccccgttaaggtacctaacccgtaaaccggttccggggggaccctaaacgggggtaaccccctttgggtacccgtaacccggtttacccttaccccgttaccgtaccgtacccccttaacccgaaccccgaaaacccgggtaccccctaaccgggttacccggtttcccccgttttcccccccgttaccggtacccccgtaacccccgttaccccgtaacccgtaaaccggaaccgtaccccgtaccccggttacccggttaccggggggcccaacccggtaaccggccccgggacccggttccggggtccgtccggtcccgtaccgggtaccgtaaacgggtaacccgttacccgttacccgtaacccgtaccgtaccggttacgtacttacgggacggtccggggtaccgg

SEQ ID NO: 229208 - DNA, 682 bp, Homo sapiens
  misc_feature: GYAE6OF01BNULK.34.20.B09.1.454.CMB.1.raw
  modified_base (85)..(85): a, c, t, g, unknown or other
  misc_feature (85)..(85): n is a, c, g, or t
  modified_base (132)..(132): a, c, t, g, unknown or other
  misc_feature (132)..(132): n is a, c, g, or t
  modified_base (172)..(172): a, c, t, g, unknown or other
  misc_feature (172)..(172): n is a, c, g, or t
  modified_base (606)..(606): a, c, t, g, unknown or other
  misc_feature (606)..(606): n is a, c, g, or t
  modified_base (622)..(622): a, c, t, g, unknown or other
  misc_feature (622)..(622): n is a, c, g, or t
  modified_base (628)..(628): a, c, t, g, unknown or other
  misc_feature (628)..(628): n is a, c, g, or t
  modified_base (678)..(678): a, c, t, g, unknown or other
  misc_feature (678)..(678): n is a, c, g, or t
tcagtacacgtgatcacgaccggtgctcgatttagtgtagtgtgaagggcctgcagtgggtcgcggttattagtggaagcactgntgtcacatcccagctgactctgtgaaggccattcaccgtctccaganacaagttctaagacgtctttcgtttttcagcaaatgaacngcctgagacgtcgatcgacaccggtcttactattacgtggtacgacggtaagggaggacggggtccgtaggccgtacgggaccccaaactgttcggtccgttttacgacgttcggtcggtacggggaccgaagggaacctaaggttcggtacaccgttctccgtaccaccgtccctacccgaccgtaacggccctagttcccggttccccttaccccgtcggtccctaccctcccgtacgaacggactcccgtacccgtacgggtccgggggaccaccggtacgtcccggacccgtgggtccctcggtccggtacgtacgaacgttacctaccgttacgtacttccgtacgttacgtactacggggccggtcggtaccgacggtacggtaacggtcgtaaccgtaagtcggtactcgagcctggtaccaggtcngtacagtccaggtacntcgganacgttcaggaacgcgttctaacggcctgttcgcccgtgctacgagtctgngtcg

SEQ ID NO: 229209 - DNA, 123 bp, Homo sapiens; identical to SEQ ID NO: 229179
  misc_feature: GYAE6OF02IROLF.34.20.B09.1.454.CMB.1.raw
  modified_base (123)..(123): a, c, t, g, unknown or other
  misc_feature (123)..(123): n is a, c, g, or t

SEQ ID NO: 229210 - DNA, 131 bp, Homo sapiens
  misc_feature: GYAE6OF02HZE80.34.20.B09.1.454.CMB.1.raw
  modified_base (123)..(131): a, c, t, g, unknown or other
  misc_feature (123)..(131): n is a, c, g, or t
tcagtacacgtgatcacgaccggtgctcgatttagtgtagtgtgaagggcacagcggccctgggctgcctggtcaaggactacttccatcacgtgtactgagcgggctggcaaggcgcatagnnnnnnnnn

SEQ ID NO: 229211 - DNA, 123 bp, Homo sapiens
  misc_feature: GYAE6OF02IQNAV.34.20.B09.1.454.CMB.1.raw
  modified_base (102)..(102): a, c, t, g, unknown or other
  misc_feature (102)..(102): n is a, c, g, or t
  modified_base (123)..(123): a, c, t, g, unknown or other
  misc_feature (123)..(123): n is a, c, g, or t
tcagtacacgtgatcacgaccggtgctcgatttagtgtagtgtgaagggcacagcggccctgggctgcctggtcaaggactacttccatcacgtgtactgancgggctggcaaggcgcatagn

SEQ ID NO: 229212 - DNA, 358 bp, Homo sapiens
  misc_feature: GYAE6OF02GCA6H.34.20.B09.1.454.CMB.1.raw
  modified_base (354)..(358): a, c, t, g, unknown or other
  misc_feature (354)..(358): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggccaccctcctccaagagcacctctgggggcacagcggccctgggctgcctggtcaaggactactccatcacgtgtactgagcgggctggcaaggcgcatagnnnnn

SEQ ID NO: 229213 - DNA, 569 bp, Homo sapiens
  misc_feature: GYAE6OF02FHCL5.34.20.B09.1.454.CMB.1.raw
  modified_base (146)..(146): a, c, t, g, unknown or other
  misc_feature (146)..(146): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagcggtgngtttctaggtggcaacttaaaaggtgtccagtgtgacgtacagctgttggagtcggggganccttgacacngccgggggatctctgagctctcctgtgagcctctggtttcacctttagcgactatcgccatgagctgggtccgccagctccagggaaggcctgcagtggtcgcggttattagngaagcactgctgtcacntcccngctgactctgtagaagggtccattccgacctcaccaggacactatactaagaacgtcttacggttttcacgactaaacttggaaccagcctagacgacgttacggattacgacaccgggtcctacttagttacctgtagccgtaaggacgacgggtccggtaggcgacgggacccaacgtgtacgtcgtttacggattcggtcgtacgggaacccgg

SEQ ID NO: 229214 - DNA, 588 bp, Homo sapiens
  misc_feature: GYAE6OF02IEULM.34.20.B09.1.454.CMB.1.raw
  modified_base (293)..(293): a, c, t, g, unknown or other
  misc_feature (293)..(293): n is a, c, g, or t
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagcgtgcgttttctaggtggcaactttaaaaggtgtccagtgtgacgtacagctgttggagtcggggagccttgacacagccggggggatctctgagactctcctgtgaacgcctctggtttcacctttagcgactatgccatgagctgggtccnccagactccagggaacggcctgcaggtgggtcgcggttagttagtggaacgcacgtgctgtcacactccacgctagacttctgtgaacgggcctattccgaccgttcaccgagacgaactaattaccaaagtaactcttcgttttcngtacaaattcgaancgcctgagagtacgatagaccacgggccgttattacttacgtgtcgacgagggaggcggggtaccgtgggaccgtacggggacccaaccgtagtcggttccgtttacggagttcggtccggtggggaaacccgg

SEQ ID NO: 229215 - DNA, 425 bp, Homo sapiens
  misc_feature: GYAE6OF02GO8EF.34.20.B09.1.454.CMB.1.raw
  modified_base (419)..(425): a, c, t, g, unknown or other
  misc_feature (419)..(425): n is a, c, g, or t
tcagtacacgtgatcacgaccggtgctcgatttagtgtagtgtgaagggcctgcagtgggtcgcggttattagtggaagcactgctgtcacatcccacgctgactctgtgaagggccgattcatcgtctccagagacaattctaagaagctcgtttttctgcaaatgaacagcctgagagtcgatgacacggccgtctattactgtgcgaaggagaggggccgtggctgggccaaccatgctttcgatgtctggggccaaggggacaatggtcaccgtctcttcagcctccaccaagggcccatcggtcttccccctggcaccctcctccaagagcacctctggggcacagcggccctgggctgcctggtcaaggctacttccatcacgtgtactgagcgggctggcaaggcgcatagnnnnnnn

SEQ ID NO: 229216 - DNA, 360 bp, Homo sapiens
  misc_feature: GYAE6OF02HWJFN.34.20.B09.1.454.CMB.1.raw
  modified_base (267)..(267): a, c, t, g, unknown or other
  misc_feature (267)..(267): n is a, c, g, or t
  modified_base (351)..(360): a, c, t, g, unknown or other
  misc_feature (351)..(360): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggcaccctcctccaagngcacctctggggcacagcggccctggctgcctggtcaaggactactccatcacgtgtactgagcgggctggcaaggcgcatagnnnnnnnnnn

SEQ ID NO: 229217 - DNA, 965 bp, Homo sapiens
  misc_feature: GYAE6OF02FN5FC.34.20.B09.1.454.CMB.1.raw
tcagtacacgtgatcacgaccggtgctcgatttagtgtagtgtgaaggggagagagggagcccgagccctgggattttcgggtgttttcatttggtgtatctaggtctgaacagagagaactcaccatggagtttggctgagcgtggcgtttcaggtcgcgtaactttaaaggtgtcctagttagtgtacgtacagtctgttggagtcggggagcgttgacacgaggccgggggatcgtcctggacgtacgtcgttccctggtacgaacgtccttccgttggtttaccaccgttttacgcgtacgttacttcgacctatgtaacgtcgttgggtcccacctagacccttaccggaggggtaaccgggccctaggaccgtacgggttcggggtccggtacggggtttatttacgggtaggtaacggtccgtaacgttggtacttacggtaacctaacgtaacgttaccccgtaacggtaccgttacggtaaccgttccgtttaggttaacggtaaaccgggtacccgttaacgtttacccgtaacccgggttaccgttacccgtaaggtaaaccgtaacccgtttaaacgtttaacccgtaaaaggtaaacgttacccgttttaaccggtttttaccgaacggtaaccttaaaacggttaccgaaaaccgttacggttaacccgttaggtaaacggtaaccggttaacgtaacggtaaccggtaacccggtacccggggttacccgttaacggtttaaaccgtttaccggttacggtaaccgggtaacggtaaaaccggggtttacgggtaaccgggggttacccgtttaacgggggtaacccggttaacccggggggtaaaccccttaaaacccgggttacgggtttaccggtttaacccggtttttaaccgggaacggttttacccggggttaccggggttaacccgggggttaaaccccgggg

SEQ ID NO: 229218 - DNA, 361 bp, Homo sapiens
  misc_feature: GYAE6OF02GBI62.34.20.B09.1.454.CMB.1.raw
  modified_base (354)..(361): a, c, t, g, unknown or other
  misc_feature (354)..(361): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcatagnnnnnnnn

SEQ ID NO: 229219 - DNA, 418 bp, Homo sapiens
  misc_feature: GYAE6OF02I5Z70.34.20.B09.1.454.CMB.1.raw
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (409)..(418): a, c, t, g, unknown or other
  misc_feature (409)..(418): n is a, c, g, or t
tcagtacacgtgatcacgaccggtgctcgatttagtgtagtgtgaagggcctgcagtgggtcgcggttattagtggaagcactgctgtcacatcccacgctgactctgtgaagggccgattcaccgtctccagagacaattctaagaagctcgttttctgcaaatgaacagcctgagagtcgatgacacggccgtctattactgtgcgaaggagaggggccgtggctggggccaaccatgctttcgatgtctgggggccaagggacaatggtcaccgtctcttcagcctcaccaggccatcggtctcccctggcnccctcnccangcacctcnggggcacagcgcctgggctgcctggtcaacggactacttccatcacgtgtactgacgcgggctggcaggcgcatgnnnnnnnnnn

SEQ ID NO: 229220 - DNA, 633 bp, Homo sapiens
  misc_feature: GYAE6OF02JHXMB.34.20.B09.1.454.CMB.1.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagctggctttttctggtggcaactttaaaaggtgtccagtgtgacgtacagctgttggagtcggggganccttgacacagccgggggatctctgagactctcctgtgaagcctctggttcacctttagcgactatgccatgagctgggtccncagactccgaggaaggcctgcgagtgggtcgcggttatagtggaagcacgtgctgtcacatcccagctgactctggagaacgggccgtattccaaccggttctacccgagacgaactaaattacgtaaagaaacgtccgttacgtttttctacggtaactaaattacgaaactacgtcccgttagaaggtacgtacgtaattacgaaccgaaccgggtccgtacttaagttacctggtacgaccgaaagggacggtaacgggggccgttggggaccctagggggtaccccaaaccgtaacgtcggtacgtttaccgagtttacggtcgttacggggaacccgg

SEQ ID NO: 229221 - DNA, 377 bp, Homo sapiens
  misc_feature: GYAE6OF02H134W.34.20.B09.1.454.CMB.1.raw
  modified_base (366)..(377): a, c, t, g, unknown or other
  misc_feature (366)..(377): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatccggtccttcccccctggccaccctccctccaagacgccacctcgtgggggcacgagccggccctgggctgccgtggtcaaggacctacttccatcacgtgtactgagcgggctggcaaggcgcatagnnnnnnnnnnnn

SEQ ID NO: 229222 - DNA, 448 bp, Homo sapiens
  misc_feature: GYAE6OF02GTBXX.34.20.B09.1.454.CMB.1.raw
  modified_base (433)..(448): a, c, t, g, unknown or other
  misc_feature (433)..(448): n is a, c, g, or t
tcagtacacgtgatcacgaccggtgctcgatttagtgtagtgtgaagggcctgcagtgggtcgcggttattagtggaagcactgctgtcacatcccacgctgactctgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaacgggcccatcggtcttcccccgtggccacccctcctccaagacgcacctcgtgggggccacgacgccggccctgggctgcctggtcaaggactactccatcacgtgtactgaggcgggctggcaaggccgacagtagnnnnnnnnnnnnnnnn

SEQ ID NO: 229223 - DNA, 534 bp, Homo sapiens
  misc_feature: GYAE6OF02FSUS6.34.20.B09.1.454.CMB.1.raw
  modified_base (421)..(421): a, c, t, g, unknown or other
  misc_feature (421)..(421): n is a, c, g, or t
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagctggctttttctggtggcaactttaaaaggtgtccagtgtgacgtacagctgttggagtcggggggagccttgacacagccggggggatctctgagactctcctgtgaagcctctggtttcacctttagcgactatgccatgagctgggtcccgccagactccagggaagggcctgcagtggtcgcggttattagtggaagcactgctgtcacatcccacgctgactctgtgaagggccattcaccgtctccagagacaattctaagaagcttcgttttcngtactaaatgaacagcctagagagtcgatagacacggccgtctattactgtgacgaaggagaggggccgtggcgtcgggccaaccgatcgctttcgagtgtcgtgggaaccgg

SEQ ID NO: 229224 - DNA, 440 bp, Homo sapiens
  misc_feature: GYAE6OF02HZWNS.34.20.B09.1.454.CMB.1.raw
  modified_base (345)..(345): a, c, t, g, unknown or other
  misc_feature (345)..(345): n is a, c, g, or t
  modified_base (433)..(440): a, c, t, g, unknown or other
  misc_feature (433)..(440): n is a, c, g, or t
tcagtacacgtgatcacgaccggtgctcgatttagtgtagtgtgaagggcctgcagtgggtcgcggttattagtggaagcactgctgtcacatccccacgctgactctgtgaagggccgattcacccgtctccagagacaattctaagaagctcgtttttctgcaaatgaacagcctgagagtcgatgacacggccgtctattactgtgcgaaggaggaggggccgtggctgggccaaccatgctttcgatgtcgtggggccaagggacaatggtcaccgtctcttcacgcctccaccaagggcccactcggtccttcccctggcaccctcctcaagagccaccncgtgggggcacacgcggcctgggctcgccgtgtcaacggtactacttccactcacggtgtactgacgcgggctggcaaggcgcatagnnnnnnnn

SEQ ID NO: 229225 - DNA, 360 bp, Homo sapiens
  misc_feature: GYAE6OF02G9WZW.34.20.B09.1.454.CMB.1.raw
  modified_base (353)..(360): a, c, t, g, unknown or other
  misc_feature (353)..(360): n is a, c, g, or t
tcagtacacgtgatcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagccacctctgggggcacagcggccctgggctgcctggtcaaggactacttccatcacgtgtactgagcgggctggcaaggcgcatagnnnnnnnn

SEQ ID NO: 229226 - DNA, 363 bp, Homo sapiens
  misc_feature: GYAE6OF02HLTDS.34.20.B09.1.454.CMB.1.raw
  modified_base (268)..(268): a, c, t, g, unknown or other
  misc_feature (268)..(268): n is a, c, g, or t
  modified_base (354)..(363): a, c, t, g, unknown or other
  misc_feature (354)..(363): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggccaccctcctccaagngcacctctggggcacagcggccctgggctgcctggtcaaggctacttccatcacgtgtactgagcgggctggcaaggcgacatagnnnnnnnnnn

SEQ ID NO: 229227 - DNA, 451 bp, Homo sapiens
  misc_feature: GYAE6OF02G22NP.34.20.B09.1.454.CMB.1.raw
  modified_base (428)..(428): a, c, t, g, unknown or other
  misc_feature (428)..(428): n is a, c, g, or t
  modified_base (431)..(451): a, c, t, g, unknown or other
  misc_feature (431)..(451): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtcgtggggaccaagggacaagtggtccaccgtctcctcacgccctaccaccgaacgggccccagtccggtcccttccccctggcccacccctcctaccaagacgccaaccctcggtcgggggaccaccgacggccgggccccgtggggcctacggcccgttgggtaccaacgggtaccttaccttcccaattccgacgttcgtacgtggacggcgggtctacgggacgtaacggctacagtagcntannnnnnnnnnnnnnnnnnnnn

SEQ ID NO: 229228 - DNA, 359 bp, Homo sapiens
  misc_feature: GYAE6OF02GGNO4.34.20.B09.1.454.CMB.1.raw
  modified_base (355)..(359): a, c, t, g, unknown or other
  misc_feature (355)..(359): n is a, c, g, or t
tcagtacacgtgatcacgaccggtgctcgatttagtgtagtgtgaagggccgattcaccgtctccagagacaattctaagaagctcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggcaccctcctccaagcgcacctctcgggggcacagcggccctgggctgcctggtcaaggactacttccatcacgtgtactgagcgggctggcaaggcgcatagnnnnn

SEQ ID NO: 229229 - DNA, 678 bp, Homo sapiens
  misc_feature: GYAE6OF02GVW9N.34.20.B09.1.454.CMB.1.raw
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagctggctttttctggtggcaactttaaaaggtgtccagtgtgacgtacagctgttggagtcggggggagccttgacacagccggggggatctctgagactctcctgtgaagcctctggttcacctttagcgactatgccatgagctgggtcccgccagacctccgaggggaacggcctgcaggtgggcgcggttatagtggaagcactgctgcacactcccacgctgactcgtggtagaacgggccgtattccgacccgtctaccaggaacgaactaattacgtaaagaacgtcctttaccgtttttctacgtactaaaagttcgaaactacgacccgttaggacggtacgtacggtaatacggaaccgacccgggtaccgttaccttaacgtttaccgtggttacggacgggtaaaggggacgggacggggggtcccggttacggggtaccggttaccgggggaacccctaaacccggttaggtacgttacccggttttaggaacgttttcgggtccgggtacgggggtaaccccggg

SEQ ID NO: 229230 - DNA, 703 bp, Homo sapiens
  misc_feature: GYAE6OF02JBV63.34.20.B09.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagcgtggcttttctggtggcaactttaaaaggtgtccagtgtgacgtacagctgttggagtcggggganccttgacacaggccgggggatctcngagactctcctgtagacgcctctggttacacctttagcgactatcgccagtgacgtcgtgggtcccgacgacgtacgtccgaaggggacgggctcggcaggtgggtcgtcggttagttaggtaggaacgctaccgtggtcctggtccaacctaccgttaccccgaacgtcctacgtaccctcgttagggtacgtaaacggggccctaacgttcccgtacccggtactaccgaacggacgtaaacctaagttttacaaacgggtaacttccgttttaccggtttttcgacgaactaaagttcgaaaccacggtctacgggtagaacggttcaggtacgtaccgaccgggtcctttaacgtactttcggtacgttacgaacgggtagggacggtaccgggggtccgttcgggacgttccgggaaccaacgtatcggttacctttaggattttcggaccggttcgggaaaccgg

SEQ ID NO: 229231 - DNA, 718 bp, Homo sapiens
  misc_feature: GYAE6OF02GJOYM.34.20.B09.1.454.CMB.1.raw
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagctggctttttctggtggcaactttaaaaggtgtccagtgtgacgtacagctgttggagtcggggggagccttgacacaggccgggggatctctgagactctcctgtgagcctctggttcacctttagcgactatgccatgagcgtcgggtcccgccgagacctaccgaaggggaacgggtccgtgcgaggtcggggtcggtcggtttaagttacggtaggaacgtcacgtgcttcgtccaactactacccgacgtctacggtacctctcggtacggaacggggccctaacgtttcccgacccgttcctaccgaggaacgaacctaaacgtttacctaaaggtaaacgttaccgttttacgtttttaccgtcgtaaacctaaagttacgtaaacgtacgtccgtaggaacgtacgtacgaacgtacggtaaccgaccggttcccgttacgtttaacgttaccgttggtacggacggaaagggtacgggacgggggtaccgtcggggccggtaccgggaaccctaaccgtacgttcggttacgtttacgtacgttcggttaccgggtccgggtaaccggg

SEQ ID NO: 229232 - DNA, 676 bp, Homo sapiens
  misc_feature: GYAE6OF02GL01J.34.20.B09.1.454.CMB.1.raw
  modified_base (132)..(132): a, c, t, g, unknown or other
  misc_feature (132)..(132): n is a, c, g, or t
  modified_base (164)..(164): a, c, t, g, unknown or other
  misc_feature (164)..(164): n is a, c, g, or t
  modified_base (177)..(177): a, c, t, g, unknown or other
  misc_feature (177)..(177): n is a, c, g, or t
  modified_base (416)..(416): a, c, t, g, unknown or other
  misc_feature (416)..(416): n is a, c, g, or t
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (639)..(639): a, c, t, g, unknown or other
  misc_feature (639)..(639): n is a, c, g, or t
  modified_base (673)..(673): a, c, t, g, unknown or other
  misc_feature (673)..(673): n is a, c, g, or t
tcagtacacgtgatcacgaccggtgctcgattttagtgtagtgtgaaggggcctgcgagtgggtcgcggttattagtggaagcactgctgtcacagtcccacgctgactctgtgaacggccgattcacgtcnccagagacaattctaagacgcttcgtttttcngacaaatcgaacngcccgtgagtagtcgatgacacggccgtactattactgtagacgaaggaggacggggccgtggccgtagggaccctaaacgtagttacgtaccgttttagacgttacggtccgttacgggggaaccccaaaaggggtacctaaaaggttcggtacctaaccggttcttacctttacgaccgcccgttacctaacccggaaacgggcccctaggttacccggttcccctttacccccggnggtacccctacccccgttccgtacccgaaagccgtacccaccttacgggcgggggaccaacgccggtaccggcccggtggtacccgtacgtcccgtacggtaccgaacggtacctccgttaccaagtccgagtacgtccgtaggacggtcggtacgacgtacgaggtaccgtagacgtaggnttacagctnanagacngtcngngtgtgngngacgacgacgngcacgtcgagacacgacagacgcgtacgcgctcncgc

SEQ ID NO: 229233 - DNA, 425 bp, Homo sapiens
  misc_feature: GYAE6OF02FZ2AB.34.20.B09.1.454.CMB.1.raw
  modified_base (420)..(425): a, c, t, g, unknown or other
  misc_feature (420)..(425): n is a, c, g, or t
tcagtacacgtgatcacgaccggtgctcgatttagtgtagtgtgaagggcctgcagtgggtcgcggttattagtggaagcactgctgtcacatcccacgctgactctgtgaagggccgattcatcgtctccagagacaattctaagaagctcgtttttctgcaaatgaacagcctgagagtcgatgacacggccgtctattactgtgcgaaggagagggggccgtggctgggccaaccatgctttcgatgtctggggccaaggggacaatggtcaccgtctcttcagcctccaccaagggcccatcggtcttccccctggcaccctcctccaagagcacctctggggcacagcggccctgggctgcctggtcaaggactacttccatcacgtgtactgagcgggctggcaaggcgcatgnnnnnn

SEQ ID NO: 229234 - DNA, 711 bp, Homo sapiens
  misc_feature: GYAE6OF02JWMTZ.34.20.B09.1.454.CMB.1.raw
  modified_base (146)..(146): a, c, t, g, unknown or other
  misc_feature (146)..(146): n is a, c, g, or t
  modified_base (168)..(168): a, c, t, g, unknown or other
  misc_feature (168)..(168): n is a, c, g, or t
  modified_base (173)..(173): a, c, t, g, unknown or other
  misc_feature (173)..(173): n is a, c, g, or t
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagcggtgngtttcaggtgcaatttaaaggntcagngtcagtagnctgtgagtcggggnctggcanggcgggtantcgtgacnctctntagngtctcgtgttagttctacttagcgtatgtcgactgtacggacgcgtccggtccgtacgacgtccgtaggagggtacgtcgcgtgtacgggtacggtacgtaccggttagtaaggaggtaccgtacgtacgtctcgtactccgtacgtacctaccgtacgtaccgtacgtacgtacggttacggtaacggtacggtaccgtaccgttaccgttacccgtaccgtacgaacgtaacgtaacgttaacgttaacgtaaacgttacgttacgtttacgttacgtaacgtaacgtaacgtaacgtaacgtacgtacgtacgtaacgtacgtacgtacgtacgtaccgtaccgttaccgttacgttacgttacgtaggttacggtacgtaggtacggtacggtacgggtacggtaccggtaccggtaccgtaccgttacggttacggttaccgttacgttaccggtccggtaccggttacggtaacgg

SEQ ID NO: 229235 - DNA, 585 bp, Homo sapiens
  misc_feature: GYAE6OF02JJXCY.34.20.B09.1.454.CMB.1.raw
  modified_base (161)..(161): a, c, t, g, unknown or other
  misc_feature (161)..(161): n is a, c, g, or t
  modified_base (205)..(205): a, c, t, g, unknown or other
  misc_feature (205)..(205): n is a, c, g, or t
  modified_base (552)..(552): a, c, t, g, unknown or other
  misc_feature (552)..(552): n is a, c, g, or t
  modified_base (554)..(585): a, c, t, g, unknown or other
  misc_feature (554)..(585): n is a, c, g, or t
tcagtacacgtgatcacgaccggtgctcgatttagtgtagtgtgaagggcctgcagtgggtcgcggttattagtggaagcactgctgtcacatcccacgctgactctgtgaagggccgattcaccgtctccagagacaattcaaagaagcttcgtttttcngtacaaaattgaacaggacctgagagtcgatcgacacggccgtntattactgtagcgaaaggagagggggccgtggcgtgggacccaaaccgagtgtactttcgagttgtcggtggggaccaagggacaagtggtcaccgtctcttcacgcctaccaaccggaggtacccagtcccggtcccttccccgtcggccctaccccgtcctaccgaacgtccgcctacccgtcggttcgggggaccctaacgaccggccggtcccgtacgggggtccctccggtccgtacggggaccctaaagggtaacccttaccgttcctaacgtactaaccggttcgtaacggtccgggtaggaccggggtcgtcgggtacgggaacgccgtacgagtacgncnnnnnnnnnnnnnnnnnnnnnnnnnnnnnnnn

SEQ ID NO: 229236 - DNA, 695 bp, Homo sapiens
  misc_feature: GYAE6OF02FRPK3.34.20.B09.1.454.CMB.1.raw
tcagtacacgtgatcacgaccggtgctcgatttagtgtagtgtgaagggggagagaggagcccagccctgggattttcgggtgttttcatttggtgatcaggtctgaacagagagaactcaccatggagtttgggctgagcgtggcttttctggtggcaactttaaaaggtgtccagtgtgacgtacagctgttggaggtcggggggagccttgacacagccgggggatctctgagactctcctgtgagcctctggttctaccgtttagcgtactatgcatgagtcgtcgggtccgccagacctaccgaggggaagggcctgcgtaggtgggtcgtcggtttagttacggtggaaagcacgtgtctgtaccacactacccgacgtctcgtaacttcgtaggtacgggaaacggggcctacgttccgacccgttcctaccgaagtaacgaactaacttaccgtaaagtaacgttctttacgtttttcagtactaaattagaaacctacgtaccgtggaagtagtacgtaacgtacgaaccgaccggttccgttactttaactttacggtgttacgggtacgaaaggggacgggaccgggggtccggttaggggacccggttacggggacccctaacggttagtcccggttacgttttcggtaaggtttcggttacggggttaccgggtaacccggg

SEQ ID NO: 229237 - DNA, 124 bp, Homo sapiens
  misc_feature: GYAE6OF01AJ9L1.41.24.C02.1.454.CMB.1.raw
  modified_base (124)..(124): a, c, t, g, unknown or other
  misc_feature (124)..(124): n is a, c, g, or t
tcagtctatactatcacgaccggtgctcgatttagtacagatcgttaggaagggctggccctagcgtgttcctgttcccaccctcctcatagtatagactgagcgggctggcaaggcgcatagn

SEQ ID NO: 229238 - DNA, 127 bp, Homo sapiens
  misc_feature: GYAE6OF01CRS6X.41.24.C02.1.454.CMB.1.raw
  modified_base (127)..(127): a, c, t, g, unknown or other
  misc_feature (127)..(127): n is a, c, g, or t
tcagtctatactatcacgaccggtgctcgatttagtacagatcgttagggaaaggggctggccctagcgtgttcctgttcccgccctcctcatagtatagactgagcgggctggcaaggcgcatagn

SEQ ID NO: 229239 - DNA, 129 bp, Homo sapiens
  misc_feature: GYAE6OF01DZKYM.41.24.C02.1.454.CMB.1.raw
  modified_base (128)..(129): a, c, t, g, unknown or other
  misc_feature (128)..(129): n is a, c, g, or t
tcagtctatactatcacgaccggtgctcgatttagtacagatcgttagggaaagggggctggccctagcgtgttcctgttcccgccctcctcatagtatagactgagcgggctggcaaggcgcatagnn

SEQ ID NO: 229240 - DNA, 128 bp, Homo sapiens
  misc_feature: GYAE6OF01C0MU0.41.24.C02.1.454.CMB.1.raw
  modified_base (128)..(128): a, c, t, g, unknown or other
  misc_feature (128)..(128): n is a, c, g, or t
tcagtctatactatcacgaccggtgctcgatttagtacagatcgttagggaaagggggctggccctagcgtgttcctgttcccaccctcctcatagtatagactgagcgggctggcaaggcgcatagn

SEQ ID NO: 229241 - DNA, 127 bp, Homo sapiens
  misc_feature: GYAE6OF01EM8TU.41.24.C02.1.454.CMB.1.raw
  modified_base (127)..(127): a, c, t, g, unknown or other
  misc_feature (127)..(127): n is a, c, g, or t
tcagtctatactatcacgaccggtgctcgatttagtacagatcgttagggaaaggggctggccctagcgtgttcctgttcccaccctcctcatagtatagactgagcgggctggcaaggcgcatagn

SEQ ID NO: 229242 - DNA, 126 bp, Homo sapiens
  misc_feature: GYAE6OF01EL9K6.41.24.C02.1.454.CMB.1.raw
tcagtctatactatcacgaccggtgctcgatttagtacagatcgttagggaaaggggctggccctagcgtgttcctgttcccaccctcctcatagtatagactgagcgggctggcaaggcgcatag

SEQ ID NO: 229243 - DNA, 127 bp, Homo sapiens; identical to SEQ ID NO: 229238
  misc_feature: GYAE6OF02I2AYP.41.24.C02.1.454.CMB.1.raw
  modified_base (127)..(127): a, c, t, g, unknown or other
  misc_feature (127)..(127): n is a, c, g, or t

SEQ ID NO: 229244 - DNA, 127 bp, Homo sapiens; identical to SEQ ID NO: 229241
  misc_feature: GYAE6OF02G8F2Q.41.24.C02.1.454.CMB.1.raw
  modified_base (127)..(127): a, c, t, g, unknown or other
  misc_feature (127)..(127): n is a, c, g, or t

SEQ ID NO: 229245 - DNA, 159 bp, Homo sapiens
  misc_feature: GYAE6OF02HC0PH.41.24.C02.1.454.CMB.1.raw
  modified_base (130)..(132): a, c, t, g, unknown or other
  misc_feature (130)..(132): n is a, c, g, or t
  modified_base (134)..(159): a, c, t, g, unknown or other
  misc_feature (134)..(159): n is a, c, g, or t
tcagtctatactatcacgaccggtgctcgatttagtacagatcgttagggaaagggggcctggccctagcgtgttcctgttcccgccctcctcatagtatagacttgagcgggctggcaaggcgcatagnnngnnnnnnnnnnnnnnnnnnnnnnnnnn

SEQ ID NO: 229246 - DNA, 127 bp, Homo sapiens; identical to SEQ ID NO: 229238
  misc_feature: GYAE6OF02H1IKJ.41.24.C02.1.454.CMB.1.raw
  modified_base (127)..(127): a, c, t, g, unknown or other
  misc_feature (127)..(127): n is a, c, g, or t

SEQ ID NO: 229247 - DNA, 128 bp, Homo sapiens
  misc_feature: GYAE6OF02HH26R.41.24.C02.1.454.CMB.1.raw
  modified_base (126)..(128): a, c, t, g, unknown or other
  misc_feature (126)..(128): n is a, c, g, or t
tcagtctatactatcacgaccggtgctcgatttagtacagatcgttagggaaaggggctggccctagcgtgttcctgttcccgcctcctcatagtatagactgagcgggctggcaaggcgcatagnnn

SEQ ID NO: 229248 - DNA, 128 bp, Homo sapiens
  misc_feature: GYAE6OF02F11SM.41.24.C02.1.454.CMB.1.raw
  modified_base (128)..(128): a, c, t, g, unknown or other
  misc_feature (128)..(128): n is a, c, g, or t
tcagtctatactatcacgaccggtgctcgatttagtacagatcgttagggaaagggggctggccctagcgtgttcctgttcccgccctcctcatagtatagactgagcgggctggcaaggcgcatagn

SEQ ID NO: 229249 - DNA, 127 bp, Homo sapiens; identical to SEQ ID NO: 229238
  misc_feature: GYAE6OF02GNCOR.41.24.C02.1.454.CMB.1.raw
  modified_base (127)..(127): a, c, t, g, unknown or other
  misc_feature (127)..(127): n is a, c, g, or t

SEQ ID NO: 229250 - DNA, 135 bp, Homo sapiens
  misc_feature: GYAE6OF02FSOTK.41.24.C02.1.454.CMB.1.raw
  modified_base (128)..(135): a, c, t, g, unknown or other
  misc_feature (128)..(135): n is a, c, g, or t
tcagtctatactatcacgaccggtgctcgatttagtacagatcgttagggaaagggggctggccctagcgtgttcctgttcccgccctcctcatagtatagactgagcgggctggcaaggcgcatagnnnnnnnn

SEQ ID NO: 229251 - DNA, 273 bp, Homo sapiens
  misc_feature: GYAE6OF01DFL7I.34.1.A01.1.454.CMB.1.raw
  modified_base (237)..(273): a, c, t, g, unknown or other
  misc_feature (237)..(273): n is a, c, g, or t
tcagtacacgtgatcacgaccggtgctcgatttagacgtctcatcacgttgggctccaggcttagaggatgaggctgattattactgcctgtccgtatgacaagagcctggactgtttatgtcttcggaactgggaccaaggtcaccgtccttggtcagtcccaaggccaaccccactgtcactctgttcccaccctcctcatcacgtgtactgagcgggctggcaaggcgcatagnnnnnnnnnnnnnnnnnnnnnnnnnnnnnnnnnnnnn

SEQ ID NO: 229252 - DNA, 155 bp, Homo sapiens
  misc_feature: GYAE6OF01D9B4V.34.1.A01.1.454.CMB.1.raw
  modified_base (155)..(155): a, c, t, g, unknown or other
  misc_feature (155)..(155): n is a, c, g, or t
tcagtacacgtgatcacgaccggtgctcgatttagacgtctcatcaaggaaggagggaccaaggtggagatcaaacgaactgtggctgcaccatctgtcttcatcttcccgccatctgaatcacgtgtactgagcgggctggcaaggcgcatagn

SEQ ID NO: 229253 - DNA, 190 bp, Homo sapiens
  misc_feature: GYAE6OF01EJ8BO.34.1.A01.1.454.CMB.1.raw
  modified_base (152)..(152): a, c, t, g, unknown or other
  misc_feature (152)..(152): n is a, c, g, or t
  modified_base (158)..(190): a, c, t, g, unknown or other
  misc_feature (158)..(190): n is a, c, g, or t
tcagtacacgtgatcacgaccggtgctcgatttagacgtctcatcgaagggaaggaagggaccaaggtggagatcaaacgaactgtggctgcaccatctgtcttcatcttcccgccatctgaatcacgtgtactgagcgggctggcaaggcncatagnnnnnnnnnnnnnnnnnnnnnnnnnnnnnnnnn

SEQ ID NO: 229254 - DNA, 233 bp, Homo sapiens
  misc_feature: GYAE6OF01AEM6R.34.1.A01.1.454.CMB.1.raw
  modified_base (230)..(233): a, c, t, g, unknown or other
  misc_feature (230)..(233): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaaccccactgtcactctgttcccgccctcctcatcacgtgtactgagcgggctggcaaggcgcatagnnnn

SEQ ID NO: 229255 - DNA, 155 bp, Homo sapiens; identical to SEQ ID NO: 229252
  misc_feature: GYAE6OF01DKVL5.34.1.A01.1.454.CMB.1.raw
  modified_base (155)..(155): a, c, t, g, unknown or other
  misc_feature (155)..(155): n is a, c, g, or t

SEQ ID NO: 229256 - DNA, 234 bp, Homo sapiens
  misc_feature: GYAE6OF01BD7Q3.34.1.A01.1.454.CMB.1.raw
  modified_base (230)..(234): a, c, t, g, unknown or other
  misc_feature (230)..(234): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaaccccactgtcactctgttcccgccctcctcatcacgtgtactgagcgggctggcaaggcgcatagnnnnn

SEQ ID NO: 229257 - DNA, 517 bp, Homo sapiens
  misc_feature: GYAE6OF01C2BFS.34.1.A01.1.454.CMB.1.raw
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggaggcaccttcaacagctttggtatcaactgggtgcgacaggcccctggacaaggcttgagtacatgggaggaatcatccctatttgaatacaggaaataacgcaacagaagtttcagggcagagtgtcgatcacgcgacgaatccacgaacacagtttacgtggtagtgagcagctagagatctagaagacacggcctagtgtattactgtgacgagagaaggtggtagggtgggggtctttggagtagtggtgggacgaaggganaagtggtntacg

SEQ ID NO: 229258 - DNA, 634 bp, Homo sapiens
  misc_feature: GYAE6OF01C8D6Y.34.1.A01.1.454.CMB.1.raw
tcagtacacgtgatcacgaccggtgctcgatttagacgtctcatcagggacataacaaccacattcctcctctaaagaagcccctgggagcacagactcatcaccatggactggacctggaggttcctctttgtggtcggcagcagctacacggtgtccagtctcaggtgcagctggtgcaggtctggggctggaggtgaagaagcctgggtcctcggtgaaggtctcctgcaaggcttctggaggcacttcaacagcttggtatcaactgggtgcgacaggcccctggaccaagggcttgagtacagtgggagatcatccctatttgaatacaaggaaataacgcaacagtaagtttcaggcagagtgtcgatcaccgcgacgaatccaacgaacactagtttacgtaggtagttgagtcgaagcctagacgtatacgtagaacgtaacaccggaccctaagtagttaagtttaccgttaggttcggtacggtaaggaaaggtaaggggttaggggttaacgggggttcggggggggttacccgttttagggtaagtttaagggttacgggttacggggggtaacccggtaaaacgggggtaacgttaaagggtcgggttaccgttaaccggg

SEQ ID NO: 229259 - DNA, 276 bp, Homo sapiens
  misc_feature: GYAE6OF01E589D.34.1.A01.1.454.CMB.1.raw
  modified_base (231)..(237): a, c, t, g, unknown or other
  misc_feature (231)..(237): n is a, c, g, or t
  modified_base (239)..(276): a, c, t, g, unknown or other
  misc_feature (239)..(276): n is a, c, g, or t
tcagtacacgtgatcacgaccggtgctcgatttagacgtctcatcgactgggctccaggctgaggatgaggctgattattactgcctgtcctatgacaagagcctgactgtttatgtcttcggaactgggaccaaggtcaccgtccttggtcagcccaaaggccaaccccatgtccactctgttcccgcctcctcatcacgtgtactgagcgggctggcaaggcacatagnnnnnnnannnnnnnnnnnnnnnnnnnnnnnnnnnnnnnnnnnnnn

SEQ ID NO: 229260 - DNA, 232 bp, Homo sapiens
  misc_feature: GYAE6OF01B51Z2.34.1.A01.1.454.CMB.1.raw
  modified_base (230)..(232): a, c, t, g, unknown or other
  misc_feature (230)..(232): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaaccccactgtcactctgttcccaccctcctcatcacgtgtactgagcgggctggcaaggcgcatagnnn

SEQ ID NO: 229261 - DNA, 796 bp, Homo sapiens
  misc_feature: GYAE6OF01ASRLY.34.1.A01.1.454.CMB.1.raw
  modified_base (330)..(330): a, c, t, g, unknown or other
  misc_feature (330)..(330): n is a, c, g, or t
tcagtacacgtgatcacgaccggtgctcgatttagacgtctcatcagggggggattagaaagctgggggtctgatttgcatggatggaccctcccactctcagagtatgaagaggggcagggagagatttggggaggctctgcttcagctgtggcacaagaggcagcactcaggacaatctccagcatggcctggtctcctctcctcctcactctcctcgctcactgcacgagggtcctgggcccagtctgtgctgacgcacgccgcctcgagtcgtcgtcggggccccagggccaggacggtccaccgtatcctcctgcacgtgggacncagcctaccgaacgagtcggggacaggtattacgtagtagttcgtacgacttagtttacgggtaaccctaagtaccggtaccgtttaaccgaacgggtaaaccccgaaccgggtaacccccctaaaaccgttccccgttaacctacgttacccgtaccggtaacgggttaaccgaaaccctaaacggtaacccgttcccgggtaaccccccgtttaccggggtaacccggggggtttacccccccttaccggggtaccccgtttaaacgttttcccccggtttcccggttaccccgggttaccccgttaaccccgttaaaaccgggttccccggttcccggggttaccccctttacccccgttacccggtaaacccggttcccccccggtttaccccggtaccccgggtaccctttaacccgtccccgtaacccggggttccccggggtacccgttaacccccggg

SEQ ID NO: 229262 - DNA, 519 bp, Homo sapiens
  misc_feature: GYAE6OF01BEJ0S.34.1.A01.1.454.CMB.1.raw
  modified_base (320)..(320): a, c, t, g, unknown or other
  misc_feature (320)..(320): n is a, c, g, or t
tcagtacacgtgatcacgaccggtgctcgatttagacgtctcatcaggggggattagaaagctgggggtctgatttgcatggatggaccctcccactctcagagtatgaagaggggcagggagagatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagagggtcaccatctcctgcacgtgggacncagctccaacagtcggggcagattatgatgtgctagttggaccaacagccttaccgaacggaacacggaccccaaactccctacatcctcaggtcaacaacagtccggccctcgacgggtccctggccgtacttctcgtgcctcagtccgtgcctctcacgcccttccctcggaccctactccgacgtcgggctcccgg

SEQ ID NO: 229263 - DNA, 619 bp, Homo sapiens
  misc_feature: GYAE6OF01AR58Z.34.1.A01.1.454.CMB.1.raw
  modified_base (323)..(323): a, c, t, g, unknown or other
  misc_feature (323)..(323): n is a, c, g, or t
tcagtacacgtgatcacgaccggtgctcgatttagacgtctcatcagggggggattagaaagctgggggtctgatttgcatggatggaccctcccactctcagagtatgaagaggggcagggagagatttggggaggctctgcttcagctgtgggcacaagaggcagcactcaggacaatctccagcatggcctggtctcctctcctctcactctcctcgctcactgcacagggtcctgggcccagtctgtgctgacgcagccgccctcagtcgtcgtcggggccccagggcaggacgggtcaccatctcctgcacgtgggancacgcctaccaacacgtccggggcaggtattagtcgagtgtgctagttacgggtaacccaagtacgtccgttacgaacgggtaaccaccggtaccccaaacgttcccactactcctacgaggtacgaactaacaacgtcccggaccctaccggaccggggttccctcgggtacccgttacgttccgtaccgtcggtacccttacccgtaaagttcccgtcggtcccttcccgttaccgccggttcccccttacccgtccggccctaactccgtaccggttcggggtccctaccggg

SEQ ID NO: 229264 - DNA, 538 bp, Homo sapiens
  misc_feature: GYAE6OF01EG8UI.34.1.A01.1.454.CMB.1.raw
  modified_base (499)..(499): a, c, t, g, unknown or other
  misc_feature (499)..(499): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggagcacctttcaacagctttggtatcaactggtgcgacaggccccctggacaaggggcttggagtacagtgggaggaatcatccctattttgaatacagaaataacgcacagaagtttcagggcagagtgtcgatcgaccgcggacgaatccacgaacactagtttacgtggtagttgagcagcctgagatctgaagacgacggaccagtagttattactgtgacggagaggaggtgggtagggtggggggtcctttaggnttagtggtacgggtcgaagggacaaggttggtcgtacgg

SEQ ID NO: 229265 - DNA, 552 bp, Homo sapiens
  misc_feature: GYAE6OF01EW8IN.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttcgtggaggcaccttcaacagtctttggtatcaacgtgggtgcgacaggcccctggacaagggcttgagtacagtgggaggaatcatcctatttgaatacaggaaataacgacacagaagtttcgagggacaggagtgtcgatcgaccgcggacgaataccacgaacacgtagttacgtaggtagttgagcagcctgagatcgtagaacgacaccggaccatagtattacgtgtggacgagaaggtaaggtagggttagggtcggggggtactttaggagttagtggtgggtaccgaagggaacgaagtggtcgtacg

SEQ ID NO: 229266 - DNA, 623 bp, Homo sapiens
  misc_feature: GYAE6OF01CVPTZ.34.1.A01.1.454.CMB.1.raw
  modified_base (243)..(243): a, c, t, g, unknown or other
  misc_feature (243)..(243): n is a, c, g, or t
  modified_base (285)..(285): a, c, t, g, unknown or other
  misc_feature (285)..(285): n is a, c, g, or t
tcagtacacgtgatcacgaccggtgctcgatttagacgtctcatcgagggggggattagaaagctgggggtctgatttgcatggatggaccctcccactctcagagtatgaaggaggggcagggagagagtttggggagctctgcttcagctgtgggcacaagacggcagcactcaggactaatctccagcatcggcctggtcctcctctcctcctcactcctccgtcactcgactgcaacgnggggtcctggccctagtctgcgctgaccgcacgccgccctanggtcgtccgacgggccccgagggctacggacggtccaacctactccttccgtgccgaaggtcgggactcgacgtaccaccgaacgacggtcgggaactaggtattagtgagtgtgactagttacgaaccaagtcgtacctacgaaacgaaccgaccgaacccctaactccatacgtacacgtacgacaacaacacgttccgaaccgtacggtaccgggtacctcggtaccttacgttccgtacgtccggtactaccggacgttccgccggtaccctccgactaacccggtcccctccggtcgtaaccctacgtcccgacggttccgcccggttaaccg

SEQ ID NO: 229267 - DNA, 515 bp, Homo sapiens
  misc_feature: GYAE6OF01DZSLK.34.1.A01.1.454.CMB.1.raw
  modified_base (511)..(511): a, c, t, g, unknown or other
  misc_feature (511)..(511): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagcctgggtcctcggtgaaggtctcctgcaaggcttctggaggcaccttcaacagctttggtatcaactgggtgcgacaggccccctggacaagggcttgagtacatgggaggatcatccctattttgaatacaggaataacgcacagaagtttcagggcagagtgtcgatcaccgcggacgaatccaacgaacacagtttacgtggagttgagcagcctgagatctagaagacacggccagtgtattactgtgcgagagaggtggtagggtgggggtctttggatagtggtggggcgaagggacaagtggtntacg

SEQ ID NO: 229268 - DNA, 540 bp, Homo sapiens
  misc_feature: GYAE6OF01D2CK8.34.1.A01.1.454.CMB.1.raw
  modified_base (535)..(535): a, c, t, g, unknown or other
  misc_feature (535)..(535): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaggcttcgtggaggcaccttcaacagctttggtatcaactgggtgcgacaggccccctggacaagggcttgagtacagtgggagatcatcctatttagaatacaagaaataacgcacgagtagtttcgagggcagagtgtcgatacgaccgcggaacgaactaccgaacgaacactagtttacgaggtagttgagcacgctgagatcgtagaacgacgacggacagtgtattacgtgtagcgagaggaggtggtagggtcgggggtcgtttggagtagtggtacggggcgtaaagggataagtggtntacgg

SEQ ID NO: 229269 - DNA, 681 bp, Homo sapiens
  misc_feature: GYAE6OF01BJXZ0.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttggtggtggcagcagctacaggtgtccagtctcgaggtgcagctggtgcagtcgtggggctgaggtgaagagccgtgggtcctcgggtgaaggtctcctgacaaggtcttcgtggaggcctaccttcaactagtctttggtatcgaacgtgggtcgacgaccgacggccccgtagggaaccgtaagggtcttaggacgtacgagtaggggagtaactcgacttacccttagttttagaacttaacgaaggtaaataacgacaacgtaaggtaagttcgaggtacaggtagtgtacgactaccgacggacggacgaactaccgaacgaactacgtaaggtttacgtaggtaacgttaggacgcgtacgtccgtagagtagtacgtaggaacgacgaccggtactagtagttaacgttacgtagtacgacggtaggaacgggtagggttaggggttaacggggtcggggggttacctttagggtacggttagggttacggggtacggggtaaccgggaaaggggtaaccgtaaggttcgggtacgttaacgg

SEQ ID NO: 229270 - DNA, 680 bp, Homo sapiens
  misc_feature: GYAE6OF01D3HPC.34.1.A01.1.454.CMB.1.raw
  modified_base (235)..(235): a, c, t, g, unknown or other
  misc_feature (235)..(235): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtggggctgaggtgaagacgccgtggtcctcggtgagtctcctgcagcttcgnggagcacttacaacagtcttgtatcaacgtggtgcgacgacggccccgtggacgaagggtcgttagacgtacgagtgggaggatcaacttccttatttagaatacgaaggaaactaacgacaactaagtaagtttacgagggacaggagtgtcgtatccgacggacggaacgaactacccgaaccgaactaacgttacgtttaacggacggttagttagacgtcgacgtacgtacgaagtacgtacgtagaacgaaccgaccggtacctaagttacggtttaactttacgttcgggtaggtaccgaaagggtaagggtaaaggggtaggggttacggggggttacgggggggttaccttttagggtaaacggtttacgggttcgggggtaacggggtaacccgggtaaagggtaaacggttaacggttagggttacgttaacggg

SEQ ID NO: 229271 - DNA, 564 bp, Homo sapiens
  misc_feature: GYAE6OF01AKOV6.34.1.A01.1.454.CMB.1.raw
  modified_base (523)..(523): a, c, t, g, unknown or other
  misc_feature (523)..(523): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtggggctgaggtgaagaagccgtgggtcctcggtgaggtctcctgcaaggtcttcgtggaggcaccttcaacagtctttggtatcaacgtgggtgcgacgacggccccgtaggacgaagggcttggagtacgagtgggaagatcactaccttatttgaatacgaaggaaataacgcaacagtaagtttcgaggcagtagtgtacgactcgaccggacgacgaacaccacgaacacgtagttacgtggtagttagagacgacgcgagagatcgtagaacgacgacgactatagtatcgtgtacgacggagaggtagggtgggtagggtcggggtcgttggngttaggtgggtacggggacgaagggaagaggtggtagtacg

SEQ ID NO: 229272 - DNA, 640 bp, Homo sapiens
  misc_feature: GYAE6OF01BEH9M.34.1.A01.1.454.CMB.1.raw
  modified_base (239)..(239): a, c, t, g, unknown or other
  misc_feature (239)..(239): n is a, c, g, or t
  modified_base (592)..(592): a, c, t, g, unknown or other
  misc_feature (592)..(592): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtgggctggaggtgaagagcctgggtcctcggtgaaggtctcctgcaaggtcttcgnggagctaccttcaacagtcgtttggtatcaacgtgggtcgacgacgacggccccgtaggaccgaagggtcttaggagtacgagtgggaaggtaatctacgtcccttaagtttacgaaagtacgaaggtaaactaacgacaactaaggtaagtttacggaaggacaaggtagtagtacggtactacgaccgtacggaacgtaactaccgaacgaacgtacgtaaggtttaccggaggtacgttaggaacgtaccgtaacgccgttagacgtacgttacgtaaggaacgacgtaccggctaagttagttcgttaacgtgtacgaggtagtaggagggtggtaggggtcggggttnttaggagttacggtaggacgggtacagggtaactaggtcgtacgtacg

SEQ ID NO: 229273 - DNA, 547 bp, Homo sapiens
  misc_feature: GYAE6OF01AK2AQ.34.1.A01.1.454.CMB.1.raw
  modified_base (440)..(440): a, c, t, g, unknown or other
  misc_feature (440)..(440): n is a, c, g, or t
  modified_base (508)..(508): a, c, t, g, unknown or other
  misc_feature (508)..(508): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagccgtgggtcctcggtgaaggtctcctgcaaggtcttcgtggaggccaccttcaacagtctttggtatcaacgtgggtgcgacacggcccctggacgagggctgacgtacagtgggagatcactcctatttagaatacgagaaatacgcacagtagttcgaggcagagtgtacgatccgacgtacggacgaactaccgacgaacactaggttacgtggtagttagacgcgagccgtagagntcagaacgtacgacgctagtagtattgtgtagcgagacggagggtaggtagggtcgggggtcttaggngttaggtggtacgggacggaaggagtaggtggtgtacgg

SEQ ID NO: 229274 - DNA, 766 bp, Homo sapiens
  misc_feature: GYAE6OF01DMNJV.34.1.A01.1.454.CMB.1.raw
tcagtacacgtgatcacgaccggtgctcgatttagacgtctcatcaggggggattagaaagctgggggtctgatttgcatggatggaccctcccactctcagagtatgaagaggggcagggagagagtttggggaggctcgtgcttcagtctggtgggacacgaaaggaggcagcactcgaacggacaatcctccagcagtcggcctggtcctcctctcctcctcacctcctcctcgctcactcgacgacggtacggttccgcggaccctgttcgttcggtcgcgtacggaccgtccgaccggtccccgtccccgtacgtacggttccggtccggtccggggacccccgaggggaccgtacggtaccggtacccacctacgttcctccgtcggaccgtacggtacggactccgaacgtcccaaccgaacggtccggtacgggactaacggttaacttagtacggtagttcggtagtcgttaacggttacgtaacccgaaccgtaccgtaccgttaaccccggaaacggtaacccctaacccggtaacccctaacccgttacctaaccgttacctaccgtaccggtaaccggtaaccaaacccgtaacgtacccgggtcccgaaccccggtaccggacccgggttcccgtacggtccgttacgttcccgtagtaccgtccctaccgtaccgtacgttcccgtcctccccgtacgtccccgtcccgtcgtacccgtaccgtacctacgtacggtccggtcgtaccggg

SEQ ID NO: 229275 - DNA, 707 bp, Homo sapiens
  misc_feature: GYAE6OF01CCKW5.34.1.A01.1.454.CMB.1.raw
  modified_base (239)..(239): a, c, t, g, unknown or other
  misc_feature (239)..(239): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttggtggtggcagcagctacaggtgtccagtctcgaggtgcaggctggtgcagtcgtggggctggaggtgaagaagcctggtcctggtgaaggtctctgcaggcttcgnggagccaccttacaacgagtcgtttaggtatacgtaacgtggggtgaccggacgaaccgggccccttagggaacgaagggtccttaggagtacgagttaggggagaacgtcagttcccttattttacgaataacgaaggtaaatacgacgaacagtaacgtttacgaggtacaggtagtgtacgtaacgtcgaaccggcggaacgtaacgtacccaaccggtaaacctaacgtacggtttaaccggtaggtaacggttacggagacgtacggcccgtaagacgtagtagtaacgaacggaacgaaccgggtaccctaagttcgttaaacgtttacgacggttgtaacggtaaggacgggtaaaggggttaggggtacgggggttcgggggggttacctttagggtagttacgggttaggggtccggggtaaccggtaaagggaccggttaaagtcgggtacgttaacg

SEQ ID NO: 229276 - DNA, 747 bp, Homo sapiens
  misc_feature: GYAE6OF01C2M92.34.1.A01.1.454.CMB.1.raw
  modified_base (252)..(252): a, c, t, g, unknown or other
  misc_feature (252)..(252): n is a, c, g, or t
tcagtacacgtgatcacgaccggtgctcgatttagacgtctcatcaggggacataacaaccacattcctcctctaaagaagcccctgggagcacagctcatcaccatggactggacctggagttcctcttgtggtggcagcagctacaggtgtccagtctcaggtgcagctggtgcagtcgtggggctggaggtgaagaagccgtgggtcctcgggtgaacggttcctccgtgacgtaagggtcctttacgngggacggtcctaaccgtttacaaacgtaggttcttttagggtaacttcgtaaacggttggggtacgaccgaccgaaccgggcccccgttagggaaccgaaggggtcctttaggaacgttaacgaggtagggaaggtaactctaacgttaccgtttattttaaggaaactaacgaaggtaaaactacgactaacgtaagtaacgtttacgaagggtctaggtagtgtacgactaccgaccggacggaaccgaacgtaccgaaccgtaacgtaacgtaaggtttaaccggtaggtaacgtttaggacgtcgaggtaccgtagagtacgtacgtaagaacggaccaacggtacctaagttagttaacgttacgtaggtacggacggaaggtaaggtaacgggtgggttaacgggggttcggggggttacttagggtaggttagggtacgggttacggggaaccggtaacgggaaggtacggtacggtcgttaaccggg

SEQ ID NO: 229277 - DNA, 639 bp, Homo sapiens
  misc_feature: GYAE6OF01C4P9F.34.1.A01.1.454.CMB.1.raw
  modified_base (168)..(168): a, c, t, g, unknown or other
  misc_feature (168)..(168): n is a, c, g, or t
  modified_base (241)..(241): a, c, t, g, unknown or other
  misc_feature (241)..(241): n is a, c, g, or t
tcagtacacgtgatcacgaccggtgctcgatttagacgtctcatcaggggacataacaaccacattcctcctctaaagaagcccctgggacgcacagctcatcaccatggactggacctggaggttcctcttgtggtggcagcagctacaggtgtccagtctcaggtncagctggtgcagtctgggctgaggtgaagagccgtggtcctcggtagacggtcctccgtgacaaggtcttcgnggagccaccttcaacagtcttggtactcgtaacgtggtcgcgacgacggcccctaggacgaagggtcttgacgtacgagtgggagactctacgttcccttatttacgaataacgaaagaaacgtaacgacaacgtagtaacgtttacgaggcaggacgtgtacgatacgaccggacggaacgaacgtaccaacgaacacgtacgtttacggaggtagttgacgacgacgtccgtagacgtacgtacgtagaacgtacgacggacctagtacgttacttacgtggtacggacgtaggaacggtagggttggggtacggggtcgggggttacctttagggacgttacggttagggtacggggtaaccggtaaacgggacgtaaacgtggtacgttaacgg

SEQ ID NO: 229278 - DNA, 647 bp, Homo sapiens
  misc_feature: GYAE6OF01EUJOV.34.1.A01.1.454.CMB.1.raw
  modified_base (360)..(360): a, c, t, g, unknown or other
  misc_feature (360)..(360): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctgggctgaggtgaagaagtctggtcctcggtgaaggtctcctgcaaggtcttcgtggacggctaccttcaactagcttttggtactcaacgtgggtgcgacacggaccccgtggacgaacgggtcttgaggtactagtgggaagatcactccttatttagaatacaggaaactaacgntaacagtaagtttcgagggtcagaggtgtacgatcgaccgacgggactaagtacccgacgaactactacgttacggtggtaagttacgacgctaggtcctagacgtaattcgtaagaagaccgaacggccctaaggtagttaacgttacgtgtacggaaccgtaggtaaacgggtagggttagggttaacggggtcgggggggtaattttacgggtacgttaacgggttaggttaacccggggggaacccgtaaggggtaaacgtaaggtcgggtaccgttaaacgg

SEQ ID NO: 229279 - DNA, 885 bp, Homo sapiens
  misc_feature: GYAE6OF01BOTRA.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtggggctggaggtgaagagcgtgggtcctcggtgaaggtctcctgcaggtcttcgtggagctaccttcgaacagtcgtttaggtactactaacgtgggtcgaccgacgacggcccccgtaggaacgtaaggggtccttaggaacgtacgtaggtacggggaaggtaactacgtacgttacccctttaagttttacgaaagttaacgaaaggggtaaaactaaccggtacgaacgtaaacggttaaacggttttacggaacggggtaccaagggttacggttaggttaacccggtaacgttaccccgggacccgggtaaccggggtaaaccggtaaaccgttaccccgaaaccggtaaacccgtaaaccggtttaaaccgggttttaacccgggttaaggggtaacggttacgggtaacggtaaccgtacggtacccgttagggtaaccgtaacgttaccggtaacggtaaccggtaaaccggacccgggtaaccgttaacggttaacggtttaaacgttttaacgtacggggttacgaacgggtaaagggtaagggggtaaacgggtttacggggggttaacggggggttccggggggggtttaccgtttaagggttaacgggtttaagggttacggggtaaccggggggtaacggtaaacgggggtaaacggttaacgggtagggttacccgttaaccggg

SEQ ID NO: 229280 - DNA, 570 bp, Homo sapiens
  misc_feature: GYAE6OF01B529J.34.1.A01.1.454.CMB.1.raw
tcagtacacgtgatcacgaccggtgctcgatttagacgtctcatcaggggacataacaaccacattcctcctctaaagaagccccctgggagcacagctcatcaccatggactggacctggaggttcctctttgtggtggcagcagctacaggtgtccagtctcaggtgcagctggtgcagtcgtggggctgaggtgaagaagcctgggtcctcggtgaaggtctcctgcaaggcttcgtgggagcaccttcaacagtctttggtatcaacgtgggtgcgacgacggcccctggacaagggcttgagtacagtgggagaatcatccctatttagaatacaggaaataacgcaacagaagtttcgagggcagagtgtacgatcgacggacgacgaataccaagaacactagttacgtaggagtgagcgagcctgagtatcgtagaacgaacgacggacctagtagtaattactgtgacggaagaaggtaggtagggttagggtcggggggtacgtttaggaagttaggtagggtacggggtaccgaaagggactaaggttaggtcgtaacg

SEQ ID NO: 229281 - DNA, 809 bp, Homo sapiens
  misc_feature: GYAE6OF01DOHHQ.34.1.A01.1.454.CMB.1.raw
  modified_base (738)..(738): a, c, t, g, unknown or other
  misc_feature (738)..(738): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctgggtgctagtcgtggggctggaggtagaagacgccgtgggtccgtcgggtagaacggtcctaccgtgacgaaggtcttcgtgggacggcctaccttacgaaacgtagttcgtttacggtatccgtaacgtggggtacgaccggtaacgaccggtacccccgtagggaaccggaacgggttcctttaggacgttaacgacgggtagggtaaaggtactctaaccgtttacccctttaagttttaacggaaactaaccggaaggtaaaactaaccggtactaaacgtaggttaaacggtttcgaacggggtacaaggttacggtacgtacggaactaccggtaccgggaaccgggtaactaaccgtacccgaaacgtaactaacggtttaaggtttaccggtaagggtacgttacggtagaccgtaacggtcgtaggtacggtacttacggacgtaacggaaccgtacggtaacctagttacgtttaacgttacggtcggtaggaacggtaagggtaagggttaccggggttggggtaacggggggttccggggttagtttaacggnggttaccgggtggggtaacccggggtaaaccgggaagggtttaaccgagggttacccggttcgtaaccggg

SEQ ID NO: 229282 - DNA, 702 bp, Homo sapiens
  misc_feature: GYAE6OF01DWPSP.34.1.A01.1.454.CMB.1.raw
  modified_base (187)..(187): a, c, t, g, unknown or other
  misc_feature (187)..(187): n is a, c, g, or t
tcagtacacgtgatcacgaccggtgctcgatttagacgtctcatcaggggacataacaaccacattcctcctctaaagaagccccgtgggagcacagctcatcaccatgactggacctggaggttcctctttggtggtggcagcagctacgaggtgtccagtctcaggtgcagcgtggtgcagtcgngggctggaggtgaagagccgtagggtcctcggtagaaggtctacctgacgaaggtcttcgtggacgccaccttcgaactagtccgtttaggtataccgtaacgtggtgaccgacgaccgggccccgttaggaaccgtaagggtcgtttaggaacgtacgaggttaggggaggtaactcgtaacgttacccttagttttaagaataacgaaggtaaactaacgacaaacgtacggtaagtttcgaagggtcaaggtacgtaggtaccgtagtaccgaaccggacgggaaccgtaacgtacccaaaccggtaactaacgttaacggttttaccggaagggtagttaggaagtccgtaagaccgtagaaggtactacgtagaacgaacacggactagtacgtagttacgtggtacgacgaacggtaaggtaggttagggttacggggtacgggggttacttggtaacgtaggttcgggtacgggtaacgaaacgggtaagtacggtggttgtaaccgg

SEQ ID NO: 229283 - DNA, 795 bp, Homo sapiens
  misc_feature: GYAE6OF01BHVXO.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtggggctggaggtagaagagccgtgggtcctggtagaaggtctcgtgcgaaggtcttcgtgggacgcctaccttacaacgtagtccgttttaggtactaccgtaacggttggggtcgaccggacgtaccgggtcccccgtagggaacgtaacggggtcgttaggacgtaacgaggtaggggaacggtaacgtctaacctttaccccgtttaagttttacgaaacgttaacgaacggtaaaactaaaccggtacaaacgtaacggttaacggttttacggaacgggtaccgtaaggtacggttacggtacggtaacgtaccggtacccgggacgggtaaccgtaacgttacccgaaccggtaaaccgtaacgttaacgggttttaacggtacgggttaagggttacgaacggaccggtacgtaccgtagtaacgacgttacgaacggaacgtaccgaacggtaccgtagttacgttaagtttaccgtggtacggtagaggtaaagggttagggtaggggttacgggggttcgggggttaccgtttaggtagggttacggttaggggtacggggaaccggtaagggtaacgtaacgggttcggtacgttaccgg

SEQ ID NO: 229284 - DNA, 762 bp, Homo sapiens
  misc_feature: GYAE6OF01CKNIZ.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacgaggtgtccagtctcgaggtgcagctggtgcagtcgtggggctggaggtagaaggagccgtgggtcctcgggtggaacggtctccgtgacgtaaggtcttgtcgggacggcctaccttcgaaacgtagttccgtttgggtactcgtaaaccgtggggtcgacggtaccgaccgggtcccgtacggggaccggtaaagggtcgtttcggaacgtacgtaaggtaggggaacggtaacgtacgtacttcccgtttaatttacggtaaataaccggaaaggtaaactaaccggactaacgaaggtaacggtttaacgacgggtacgaaggtagtcggtacggtataccgaccgggacgaacgtacgtaccgaaaccgtaacgtaacgtttaacggtttacgggtagggttaaggttacggaacggacggtacggacccgtaggaacgtacgtagtaaccgggaagtaccgacgggtacccttagtacgttaacttacgtggtacggaacggtaggtaagggtagggggttacggtacgggggggttcggggttacttaggggtaccgttgggttaggggtacgggacgggtaagggactagggtggtacgttacgg

SEQ ID NO: 229285 - DNA, 960 bp, Homo sapiens
  misc_feature: GYAE6OF01B0Y0M.34.1.A01.1.454.CMB.1.raw
  modified_base (141)..(141): a, c, t, g, unknown or other
  misc_feature (141)..(141): n is a, c, g, or t
tcagtacacgtgatcacgaccggtgctcgatttagacgtctcatcaggggacataacaaccacattccctcctactaaaagaacgccccgtgggagcacagctcatcaccagtggactggacctggaggttcctctttggnggtggcagcagctaacgagggtcgtccagtctcgagggtgcgagcgtgggtcgcgtacggtcggtgggggcttgggaagggtaggaaaggtaacggcccgttggggtcccgtaggggttaggaacgggttctccgtggaccgtaacgggttcgttccggtagggacggtacctaccgttaccaaacgtggttccttttagggtaactacgtaaacgggtcggggtcggaccggtaaccggaccgggtccccggtaaggggaaccgtaacggggtctttaacggaacgttaacggtaggtaacggggaaaggtaacttaccgtaccgtttaccgttaagtttaacgtaaacgtaaacggaaaggtaaaacttaaccgaacgaaacgtaaaggttacgttaacggaggtactaacggtagtacgtacgtaccgtaacgccggaacggtaaccgaacgttacccgaaacgtaaccgtaaacggttaagggttaacggtacgggtaaggttacgaacggacgtaacgggtccgtaagggtaacgtaacggtacggtaaacgggtaacgaccgggtaaacccggtaccgttaagttaccggttaaacgtttaccgtaacgggttaccgggttaacgggaaacgggggttaagggttaaaacggggggttacggggggttacgggggggttaaccggggggtttacgggttaaacggggttaacgggttaacggggtacggggggtttaaacccgggggaaacggggttaaaaccggggtaaacggtttaaaacggggtaccggggtttaaaccggttacccggg

SEQ ID NO: 229286 - DNA, 958 bp, Homo sapiens
  misc_feature: GYAE6OF01D4FGQ.34.1.A01.1.454.CMB.1.raw
  modified_base (176)..(176): a, c, t, g, unknown or other
  misc_feature (176)..(176): n is a, c, g, or t
tcagtacacgtgatcacgaccggtgctcgatttagacgtctcatcaggggacataacaaccacattcctcctctaaagaagccctgggagcacagctcatcaccatggactggacctggagttcctctttgtggtggcagcagctacaggtgtccagtctcaggtcgcagctggtncagtcgtggggctgagggtacgaagacggttcgtacgggtccgtacgggttaggaacgggttccttcccgtaggtaccgaaacgggttctttaccggtacggggacggtacctaaccctttacgaaccgtacgttcgttttagggtaacttaccgtaaaccggttcggggttacggaccggtaccgtaaccggtcccccgttacggggaaccgtaacggggttccgttaggtaacggtaaccgtaggtacgggggttacgtaacgtacgtaaccgtttacccgtttaacgtttttaacgggtaaaccttaaaccggtaaacggttaaaaccgttaaaccgggtaaccgttaaaccggtaaaccggtttaaacggtttttaaccccggggaaacgggttaccggtaaacgggttacggttttaacccgggtaaccggttaaaccgtaacccgggtaacccggtaacccgggggaaacccgttaaacccggtaacccgtaaaccccggtaaaccggtaaaccggtttaaacccggtttttaaacgggggtacgggttaaaccggttttcgggaaccggtaacgtaccggtacccggttacggtaacggtaacgttacggttaaccggaaacgggtaacccgtaacgggttacccgtagttaacgttacgtttacggtaagggtccggtacggtaaacgagggttaaacgggtcgggttacgggttcggggttactacggtgttacggtaggtacgggaacgtagggactaggtcgtacgttacg

SEQ ID NO: 229287 - DNA, 631 bp, Homo sapiens
  misc_feature: GYAE6OF01EOC4F.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtggggctgaggtgaagaagcctgggtcctcggtgaaggtcctcctgcaaggtcttcgtggaggcctaccgttcaacagtcttttaggtatacaacgtggggtgccgtacgacggcccccgtggacgaaggggcttaggagtacgagtagggaggaatcacttccttattttagaataacaaggaaataaccgacaacgagtaacgtttcgagggacagagtgtacgatccgaccggacggaacgaactaccgaacgaacaacgtagtttacggtaggtagtagagacacgccgtagagtagtactaggaacgtaccgaccggacctagttagttaacttacgtggtacggacgtaaggaaggtaagggttagggtaggggtcggggggtcctttaggtagttaggtgggtacggggtaccggaagggaacgtaggttaggtcgtacgg

SEQ ID NO: 229288 - DNA, 836 bp, Homo sapiens
  misc_feature: GYAE6OF01EEFRW.34.1.A01.1.454.CMB.1.raw
tcagtacacgtgatcacgaccggtgctcgatttagacgtctcatcagggacataacaaccacattcctcctctaaagaagcccctgggagcacagctcatcaccatggactggacctggaggttcctctttggtggtggcagcagctacaggtgtccagtctcaggtgcagcgtggtgctagtcgtggggctggaggtagaagaacgtccgtgggtccgtgggtgtaaggtcctcctgacgaaggtctttcgtggacggcctacccgttacaaccgtagttccgttttaggtaacttccgtaacggttcggggtacgtaccgaaccgtaccggggccccccgttagggaaccgtaacggggtctttagggtaacggttaaccgagggttaggggaacggtaaacgttccgtaactttaccccgttttaagttttaacgtaaacgtaacgtaaagggtaaaactaaacggtaccaaacgtaaagttaacgtttacggaacgggtacgtaaggtacggtacggttacgtaccgtaaccgtaccgggaacgggtaaccgtaaaccgtaacccgtaaaccgtaaaccgtaaccgtttaaacgggttttaacgggtaacgggttaaggttacggaaccgtacggtaccggtaccgtagggtaacgtagtacgtaacgggaacggtaaccgaccgggtaccgtaagttagttacgtttacgtggtacggtacgggaagtaagggttacgggttaggggttaggggttcgggggttactttagggtacggttaggttcgggtacgggtacggaacgggtaaagtacggttggtagttacccgg

SEQ ID NO: 229289 - DNA, 593 bp, Homo sapiens
  misc_feature: GYAE6OF01EQKZG.34.1.A01.1.454.CMB.1.raw
  modified_base (303)..(303): a, c, t, g, unknown or other
  misc_feature (303)..(303): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtggggctgaggtgaagaagcctgggtcctcggtgaaggtctcctgcaaggcttcgtggagcaccttcaacagctttggtatcaacgtgggtgcgacaggccccctggacaagggcttagngtacagtgggaggaatcatcctatttgaatacgagaaataacgacacagaagtttcgagggcagagtgtcgatcgaccgcggaacgaactaccacgaacaacgtagtttaacggtggtagtgagacgagccgtgagtactactagaagacgacgtaccgggggatagttacttactggtagacggaagtaagggtaagggtagggtagggttgggggtagggttacgtttcggtaagttagttcgggtacgggggaccggtaaaggggaacgtaaacgtgggttaaccgg

SEQ ID NO: 229290 - DNA, 839 bp, Homo sapiens
  misc_feature: GYAE6OF01EH1CL.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttggtggtggcagcagctacaggtgtccagtctcgaggtgcagcgttgggtgacgcggtcgtcgggggctggagggtagaaaggaacgccggttgggtccgtcgggtaggtaacggtcctccgtggacgtaacggtcttcgtgggacgtcctaaccgttacgaacgtacgttcgtttaggtaacttaccgtaacggttggggtacgaccggtaaccgaccgggtacccccgtagggtaaccgtaacgggggttccgtttacggtaacggttaacgtagggtaacgggggaacggtaacttaccgtacctttacccgtttaagtttaacgaaacgttaacgaaaggtaaaacgtaaccgacgtaaacgtagttaaacgttcggaaggtacgaggtagtacggttacgaacgtaccggaccggacggtaaccgaacgtacccgaaacgtaacgtacgttaaggttacgtaggtaggttacgacgtacgtacggtccgtagtaacgtagtacggtaagaaccggtaacgaccgggtaactagggtttacgtttaacgttacggtacgggtacggtaacgggtaagggtaaacgggttggggttaacgggggtttacgggggtagggggtttacctttagggtaaggttacggggttacgggacgggggtaaccgggaaagggtaaccgtaacgggttcgtaacgtttaccgg

SEQ ID NO: 229291 - DNA, 229 bp, Homo sapiens
  misc_feature: GYAE6OF02HYCCH.34.1.A01.1.454.CMB.1.raw
  modified_base (228)..(229): a, c, t, g, unknown or other
  misc_feature (228)..(229): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaacccactgtcactctgttcccgcctcctcatcacgtgtactgagcgggctggcaaggcgcatagnn

SEQ ID NO: 229292 - DNA, 155 bp, Homo sapiens; identical to SEQ ID NO: 229252
  misc_feature: GYAE6OF02IF6IO.34.1.A01.1.454.CMB.1.raw
  modified_base (155)..(155): a, c, t, g, unknown or other
  misc_feature (155)..(155): n is a, c, g, or t

SEQ ID NO: 229293 - DNA, 261 bp, Homo sapiens
  misc_feature: GYAE6OF02HD98D.34.1.A01.1.454.CMB.1.raw
  modified_base (234)..(234): a, c, t, g, unknown or other
  misc_feature (234)..(234): n is a, c, g, or t
  modified_base (236)..(261): a, c, t, g, unknown or other
  misc_feature (236)..(261): n is a, c, g, or t
tcagtacacgtgatcacgaccggtgctcgatttagacgtctcatcactggggctccaggctgaggatgaggctgattattactgcctgtcctactgacaagagccctgactgtttatgtcttcggaactgggaccaaggtcaccgtccttggtcagcccaaggccaaccccactcgtcactctgttcccaccctcctcatcacgtgtactgagcgggctggcaaggcgcatagnannnnnnnnnnnnnnnnnnnnnnnnnn

SEQ ID NO: 229294 - DNA, 234 bp, Homo sapiens
  misc_feature: GYAE6OF02INMQ1.34.1.A01.1.454.CMB.1.raw
  modified_base (229)..(234): a, c, t, g, unknown or other
  misc_feature (229)..(234): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaaccccactgtcactctgttcccgcctcctcatcacgtgtactgagcgggctggcaaggcgcatagnnnnnn

SEQ ID NO: 229295 - DNA, 242 bp, Homo sapiens
  misc_feature: GYAE6OF02G6RMY.34.1.A01.1.454.CMB.1.raw
  modified_base (228)..(242): a, c, t, g, unknown or other
  misc_feature (228)..(242): n is a, c, g, or t
tcagtacacgtgatcacgaccggtgctcgatttagacgtctcatcacgtgggctccaggctgaggatgaggctgattattactgcctgtcctatgacaagagcctgactgtttatgtcttcggaactgggaccaaggtcaccgtcttggtcagcccaaggccaacccatgtcactctgttcccaccctcctcatcacgtgtactgagcgggctggcaaggcgcatagnnnnnnnnnnnnnnn

SEQ ID NO: 229296 - DNA, 232 bp, Homo sapiens
  misc_feature: GYAE6OF02IBUN5.34.1.A01.1.454.CMB.1.raw
  modified_base (230)..(232): a, c, t, g, unknown or other
  misc_feature (230)..(232): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaaccccactgtcactctgttcccgccctcctcatcacgtgtactgagcgggctggcaaggcgcatagnnn

SEQ ID NO: 229297 - DNA, 520 bp, Homo sapiens
  misc_feature: GYAE6OF02GVZFC.34.1.A01.1.454.CMB.1.raw
  modified_base (515)..(515): a, c, t, g, unknown or other
  misc_feature (515)..(515): n is a, c, g, or t
tcagtacacgtgatcacgaccggtgctcgatttagacgtctcatcagggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggaggcaccttcaacagctttggtatcaactgggtgcgacaggcccctggacaagggcttgagtacatgggaggaatcatccctattttgaatacaggaaataacgcacagaagtttcagggcagagtgtcgatcaccgcggacgaatccacgaacacagttacgtggagttgagcagcctgagatctgaagacacggccatgtattactgtgcgagagaggtggtaggtggggggccgtttaggagttagtggtggggccgaagggacgaagttggtntacgg

SEQ ID NO: 229298 - DNA, 520 bp, Homo sapiens
  misc_feature: GYAE6OF02HGI74.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggaggcaccttcaacagctttggtatcaactgggtgcgacaggcccctggacaagggcttgagtacagtgggaggaatcatccctatttgaatacaggaaataacgcacagaagtttcagggtcagagtgtcgatcaccgcggacgaatccaacgaacacagtttacgtaggagttgagcagcctgagatctagaagacacggccatgtattactgtgcgagagaggtggtaggtgggggctttggagtagtggtggggaccgaagggagaagtggtcgtacg

SEQ ID NO: 229299 - DNA, 513 bp, Homo sapiens
  misc_feature: GYAE6OF02I0B53.34.1.A01.1.454.CMB.1.raw
  modified_base (509)..(509): a, c, t, g, unknown or other
  misc_feature (509)..(509): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggaggcaccttcaacagctttggtatcaactgggtgcgacaggcccctggacaagggcttgagtacatgggaggaatcatccctattttgaatacaggaaataacgcacagaagtttcagggcagagtgccgatcaccgcggacgaatccacgaacacagtttacgtggagttgagcagcctgagatctagaagacacggccatgtattactgtgcgagagaggtggtaggtgggggcctttggatagtggtgggcgaagggacgagtggtntacg

SEQ ID NO: 229300 - DNA, 504 bp, Homo sapiens
  misc_feature: GYAE6OF02HCX9W.34.1.A01.1.454.CMB.1.raw
  modified_base (400)..(400): a, c, t, g, unknown or other
  misc_feature (400)..(400): n is a, c, g, or t
  modified_base (500)..(500): a, c, t, g, unknown or other
  misc_feature (500)..(500): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggaggcaccttcaacagctttggtatcaactgggtgcgacaggcccctggacaagggcttgagtacatgggagaatcatccctatttgaatacaggaaataacgcacagaagtttcagggcagagtgtcgatcacgcggacgaatccacgaacacagttacgnggagttgagcagcctgagatctgaagacgacggcatgtattactgtgcgagagaggtggtaggtgggggtcttgatgtgtcgggacgaggacgaagtggntacg

SEQ ID NO: 229301 - DNA, 739 bp, Homo sapiens
  misc_feature: GYAE6OF02H9DKT.34.1.A01.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
tcagtacacgtgatcacgaccggtgctcgatttagacgtctcatcagggacataacaaccacattcctcctctaaagaagcccctgggagcacagctcatcaccatggactggacctggaggttcctctttgtggtggcagcagctacaggtgtccagtctcaggtgcagctggtgcagtctgggctgaggtgaagaagcctgggtcctcgagtaggagtctcgtgacgacgtctgnggcgctctacancgttcgttagtcacctaggtggtcgacgacgacccgtccgtacgaacggtacggttcgttaggaactacgtaggtagggaagtactacgtaccttaccgttttagttaagaaactaacggaaaagtaaacgtacgacaagtaagtttaacgttacggaacggtacgaaggtacggttacggtacgtacgtacccggaaccgggtacggaaacgtaacctacccggaaacgaaacctaacggtttaacggtttacggaacggttaggttacggaacgtacgtacgtacgtagaacgtacgtacgtaaggaaaccgaccggaccgaaccttagtacgtttaacgttcggaggttacggaacgaagggtaacgggttaaggggtttacggggtacgggggggttaccgggtttcgttaaaggttaacggtttcgggttacgggggtaaccgggtaaacgggtaaacggggtaattacggggtacgttaaccgg

SEQ ID NO: 229302 - DNA, 514 bp, Homo sapiens
  misc_feature: GYAE6OF02F7UZB.34.1.A01.1.454.CMB.1.raw
  modified_base (450)..(450): a, c, t, g, unknown or other
  misc_feature (450)..(450): n is a, c, g, or t
  modified_base (510)..(510): a, c, t, g, unknown or other
  misc_feature (510)..(510): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggaggcaccttcaacagctttggtatcaactgggtgcgacaggcccctggacaagggcttgagtacagtgggaggaatcatccctatttgaatacaggaaataacgcacagaagtttcaggcagagtgtcgatcaccgcggacgaatccacgaacactagttacgtggagttgagcagcctgagatctgaagacacgccatgtattactgtgngagagaggtggtagggtgggggtccttggagttagtggtgggcgaagggacgaagtggtntacg

SEQ ID NO: 229303 - DNA, 532 bp, Homo sapiens
  misc_feature: GYAE6OF02I7Z93.34.1.A01.1.454.CMB.1.raw
  modified_base (238)..(238): a, c, t, g, unknown or other
  misc_feature (238)..(238): n is a, c, g, or t
  modified_base (458)..(458): a, c, t, g, unknown or other
  misc_feature (458)..(458): n is a, c, g, or t
  modified_base (526)..(526): a, c, t, g, unknown or other
  misc_feature (526)..(526): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctggaggtgaagaagcctgggtcctcggtgaaggtctcctgcaaggcttcnggagcaccttcaacagctttggtatcaactgggtgcgacaggcccctggacaagggcttgagtacatgggagaatcgatccctatttgaatacaggaaataacgcacagaagtttcagggcagagtgtacgagtcaccgcggacgaataccacgaacacagtttaacgtggagtgagcagcctgagatctagaagacgacgaccgatagtattactagtncgagagagggtggtaggtcggggggtacctttggagtagttggtgggaccgaagggacgaagtaggtntaacgg

SEQ ID NO: 229304 - DNA, 526 bp, Homo sapiens
  misc_feature: GYAE6OF02GV58Y.34.1.A01.1.454.CMB.1.raw
  modified_base (340)..(340): a, c, t, g, unknown or other
  misc_feature (340)..(340): n is a, c, g, or t
  modified_base (399)..(399): a, c, t, g, unknown or other
  misc_feature (399)..(399): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagcctgggtcctcggtgaaggtctcctgcaaggcttctggaggcaccttcaacagctttggtatcaactgggtgcgacaggcccctggacaagggcttgagtacatgggagatcatcctatttgaatacagaaatacgcaanagtaagtttcaggcagagtgtcgatcgaccgcggacgaatccaacgaacacagttacgnggtagttgagcagcctagagatctagaacgacgacggccatgtattacgtgtgacgagaggtaggtggtagggtgggggtcctttaggagttagtggtggggtacgaagggacgtaagtggtatacg

SEQ ID NO: 229305 - DNA, 507 bp, Homo sapiens
  misc_feature: GYAE6OF02FVDPZ.34.1.A01.1.454.CMB.1.raw
  modified_base (422)..(422): a, c, t, g, unknown or other
  misc_feature (422)..(422): n is a, c, g, or t
  modified_base (503)..(503): a, c, t, g, unknown or other
  misc_feature (503)..(503): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggagcacctttcaacagctttggtatcaactgggtgcgacaggcccctggacaagggcttgagtacatgggaggaatcatccctattttgaatacaggaaataacgcacagaagtttcagggtcagagtgtcgatcacgcgacgatccacgacacagttacgtggagttgagcagcctgagatcngaagacacggccatgtattactgtgcgagagaggtgtaggtgggggcctttggatgtgtggggccgaagggacaagtggtntacg

SEQ ID NO: 229306 - DNA, 538 bp, Homo sapiens
  misc_feature: GYAE6OF02GTXOY.34.1.A01.1.454.CMB.1.raw
  modified_base (532)..(532): a, c, t, g, unknown or other
  misc_feature (532)..(532): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttcgtggaggcaccttcaacagctttggtatcaactgggtgcgacacggcccctggacaagggcttgagtacagtgggaggaatcatcccttatttgaatacaggaaataacgacacagtaagtttcgaggcagagtgtcgatccacgcggacgaactccaacgaacactaagtttacggtaggtagttagagcgacgcctagagatcgtagaagacgacggccagtgtattactgtgagagaggaggtggtagggtcgggggtactttggagtagtggtgggacgaaggacgagtggngtacgg

SEQ ID NO: 229307 - DNA, 554 bp, Homo sapiens
  misc_feature: GYAE6OF02GF817.34.1.A01.1.454.CMB.1.raw
  modified_base (435)..(435): a, c, t, g, unknown or other
  misc_feature (435)..(435): n is a, c, g, or t
  modified_base (457)..(457): a, c, t, g, unknown or other
  misc_feature (457)..(457): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagcctgggtcctcggtgaaggtctcctgcaaggcttctggaggcaccttcaacagctttggtatcaactgggtgcgacaggcccctggacaaggggcttgagtacagtgggaggaatcatcccttattttgaatacaaggaaataacgcaacagtaagtttcagggcagagtgtcgatccacggcgacgaatcccaacgaacaactagtttacgtaggagttgagcgagcctgacgntactagaagacacggcctagtntattactgtgacggagagtagggtgggttagggtggggggtacctttggaagttaggtgggtgggtaccggtaagggacgtaaggtgggtactacgg

SEQ ID NO: 229308 - DNA, 259 bp, Homo sapiens
  misc_feature: GYAE6OF02I5CVK.34.1.A01.1.454.CMB.1.raw
  modified_base (234)..(259): a, c, t, g, unknown or other
  misc_feature (234)..(259): n is a, c, g, or t
tcagtacacgtgatcacgaccggtgctcgatttagacgtctcatcacgtgggctccaggctgaggatgaggctgattattactgcctgtcctatgacaagagcctgactgtttatgtcttcggaactgggaccaaggtcaccgtccttggtcagcccaaggcccaaccccactgtcactctcgttccccaccctcctcatcacgtgtactgagcgggctggcaaggcgcatagnnnnnnnnnnnnnnnnnnnnnnnnnn

SEQ ID NO: 229309 - DNA, 235 bp, Homo sapiens
  misc_feature: GYAE6OF02IFKJ0.34.1.A01.1.454.CMB.1.raw
  modified_base (231)..(235): a, c, t, g, unknown or other
  misc_feature (231)..(235): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaaccccactgtcactctcgttcccgccctcctcatcacgtgtactgagcgggctggcaaggcgcatagnnnnn

SEQ ID NO: 229310 - DNA, 703 bp, Homo sapiens
  misc_feature: GYAE6OF02HQ8UV.34.1.A01.1.454.CMB.1.raw
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagtacacgtgatcacgaccggtgctcgatttagacgtctcatcagggggggattagaaagctgggggtctgatttgcatggatggaccctcccactctcagagtatgaagaggggcagggagagatttggggaggctctgcttcagctgtgggcacaaggaggcagcactcaggacaatcctccagcatggcctggtctcctctcctcctcactctcctcgctcactgcacgagggtccnggcccagtctgtgctgacgcagcccgcctnacgtcgtcgtcggggccccagggcaggacgggtcaccatcctccgngccacggtcgggacncgacgccgtaccaacgtacggtccggggctaaggtactttagtagtattggtcgtacgttaagtttacgggtaacccaaacgtacgtaccgttaccgaaacgggtaaccgaccgggaaccccctaaactcccgtacacgttaccgtacgtacggttaccgaacctaaacgtaccggtcccggtacccgttaccgggtaacccggggtccccgtacgggtaccgttaccgtttccgtccggtaccgggtaccctaccggtacggttccgttaccggtccctttcccgtaccgtacccggtccccgtttacccggtaccggtacccttaccggttacccgtaaccgggttcccgggtaccccgttaaccggg

SEQ ID NO: 229311 - DNA, 261 bp, Homo sapiens
  misc_feature: GYAE6OF02IXBL8.34.1.A01.1.454.CMB.1.raw
  modified_base (232)..(232): a, c, t, g, unknown or other
  misc_feature (232)..(232): n is a, c, g, or t
  modified_base (237)..(261): a, c, t, g, unknown or other
  misc_feature (237)..(261): n is a, c, g, or t
tcagtacacgtgatcacgaccggtgctcgatttagacgtctcatcacgtgggctccaggctgaggatgaggctgattattacctgcctgtcctatgacaagagccctgactgtttatgtcttcgggaacctgggaccaagggtcaccgtccttggtcagcccaaggccaaccccatcgtcactctcgttcccgccctctcatcgacgtgtactgagcgggctgggccaggcncatgnnnnnnnnnnnnnnnnnnnnnnnnn

SEQ ID NO: 229312 - DNA, 532 bp, Homo sapiens
  misc_feature: GYAE6OF02G7VAV.34.1.A01.1.454.CMB.1.raw
  modified_base (406)..(406): a, c, t, g, unknown or other
  misc_feature (406)..(406): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagcctgggtcctcggtgaaggtctcctgcaaggcttcgtggaggcaccttcaacagctttggtatcaactgggtgcgacaggcccctggacaagggcttgagtacatgggaggaatcatccctattttgaatacagaaataacgcacagtaagtttcgaggcagagtgtcgatcgaccgcgacgaactccacgaacactagtttacgnggtagttgagcagcctgagatctagaacgacgacggccatgtattacgtgtgacgagagtaggtggtagggtgggggtctttaggagttagtggtagggaccggaagggagtaagtggtactacgg

SEQ ID NO: 229313 - DNA, 552 bp, Homo sapiens
  misc_feature: GYAE6OF02F0WSB.34.1.A01.1.454.CMB.1.raw
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (344)..(344): a, c, t, g, unknown or other
  misc_feature (344)..(344): n is a, c, g, or t
  modified_base (547)..(547): a, c, t, g, unknown or other
  misc_feature (547)..(547): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtcgtggggctgaggtgaagaagcctgggtcctcggtgaaggtctcctgcaaggcttcnggaggcaccttcaacngctttggtatcaactgggtgcgacaggcccctggacaagggcttgagtacagtgggaaggatcatccctatttgaatacagaatacgcanagagttcaggcagagtgtcgatcaccgacggacgaatccacgaacacgtagttacgtaggtagttgagcagcctagagtactgtagaacgacgacggacctagtagtagtttacgtgtcggtacgaagaggaggttgggtagggtcggggggtacctttgggaagttagtgggtcggggaccgtaagggtacgtaggtcggtntaacg

SEQ ID NO: 229314 - DNA, 655 bp, Homo sapiens
  misc_feature: GYAE6OF02F8FO8.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggagttcctcttgtggtggcagcagctacaggtgtccagtctcaggtgcagctggtgcagtcgtgggctggaggtgaagagccgtgggtcctcggtagacggtctccgtgcgaaggtcttcgtggagcctaccttcacagtctttggtatctaacgtgggtgcgacgacggcccctggacgaagggcttaggagtacaggtgggaagatcacttcccgtttagtttagaactaacgaaggtaaactaacgacaacgtaggtaagtttcgagggctaaggtagtcgtacgtacgtccgacggacggaacgtaactccgaacgaacgtacgttacggttacggtaggtagtaggacgacgtacgtcgtagacgtactacgtaggaacgaccgaccggtacctagttacgttaacgttacgtacgtcggacgtaaggtaagggtagggttaggggtaggggttcggggggtactttagggtaagttaggttgggtacggggaccggtaacgggtaacgtaacgggttaggtacgtaacgg

SEQ ID NO: 229315 - DNA, 697 bp, Homo sapiens
  misc_feature: GYAE6OF02H0PYI.34.1.A01.1.454.CMB.1.raw
  modified_base (164)..(164): a, c, t, g, unknown or other
  misc_feature (164)..(164): n is a, c, g, or t
  modified_base (222)..(222): a, c, t, g, unknown or other
  misc_feature (222)..(222): n is a, c, g, or t
  modified_base (340)..(340): a, c, t, g, unknown or other
  misc_feature (340)..(340): n is a, c, g, or t
tcagtacacgtgatcacgaccggtgctcgatttagacgtctcatcaggggggggattagaaagctgggggtctgatttgcatggatggaccctcccactctcagagtatgaagaggggcagggagagatttggggaggctctgcttcagctgtgggcacaaagnggcagcactcaggacaatctccagcatggcctggtctcctctcctctcactctcctcnctcactgaccacgacgggtcctcgggccctagtctgtgctgacgcagcccgcctcagtcgtccgtcggggccccagggcaggacgggtccaccgtatcctccgtcgcgacgtgggacncgagcctaccaacgacgtcgggacaagtattagtgagtcgtcgacagtttacggaaccaacgtacgtcctaccggaaacgggaaccgaacccggtaaccccctaaacgttccccgtaactaaccgttacccgttaccgtaacggttaccgaaaccgtaaaccgtaaccggtcccggtaccccgttaccgggtacccggggtacccccttacgggacccggttacctttacccggttacgtaccgggttacccttaaccgttaaccggttcccgtacggtcccttcccgaccgtccgttacccccgttccgtaccgggacccttaccgttaccgtaccggttccgggtaccctaccgg

SEQ ID NO: 229316 - DNA, 646 bp, Homo sapiens
  misc_feature: GYAE6OF02GC1JO.34.1.A01.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
tcagtacacgtgatcacgaccggtgctcgatttagacgtctcatcaggggacataacaaccacattcctcctctaaagaagcccctgggagcacagctcatcaccatggactggacctggaggatcctcttcttggtggcagcagcaacaggtgcccactcccaggtgcagctggtgcaatctgggtctgagttgaagaagccgtggggcctcagtgtaaggtttccngcaacgtccttgtggatacctaccttcactagctatgctatgctagttgggtgcgacacggcccctggacgagggtctggngtggngtgggatgatacaaccaccaacaccggtacggaaaccctaagtacgtccgacccgtagggtaccttaccgaacgtaggggtaccggttttgtaccctttcgtacccggtttcggaacccttacccgttcgttacgtaccgaggtacccgaccgggacttaacgttacgtccgttagacccgtagaccttacgacgtaccgaacgtaccgtaaggtcggagttacgggaacgtacctaacgtccgtacgttattacgtttacgtggtacggaacgaggttaacgtacttaagttacttaggtagtaacggtaagtaggttagtttacgttaag

SEQ ID NO: 229317 - DNA, 257 bp, Homo sapiens
  misc_feature: GYAE6OF02I8MWO.34.1.A01.1.454.CMB.1.raw
  modified_base (235)..(257): a, c, t, g, unknown or other
  misc_feature (235)..(257): n is a, c, g, or t
tcagtacacgtgatcacgaccggtgctcgatttagacgtctcatcactgggctccaggctgaggatgaggctgattattactgcctgtcctatgacaagagcctgacttgtttatgtcttcggaactgggaccaaggtcaccgtccttggtcagcccaaggcccaaaccccactgtcactctcgttccccaccctctcatcacgtgtactgagcgggctggacaaggcgcatagnnnnnnnnnnnnnnnnnnnnnnn

SEQ ID NO: 229318 - DNA, 643 bp, Homo sapiens
  misc_feature: GYAE6OF02JL4JK.34.1.A01.1.454.CMB.1.raw
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (373)..(373): a, c, t, g, unknown or other
  misc_feature (373)..(373): n is a, c, g, or t
tcagtacacgtgatcacgaccggtgctcgatttagacgtctcatcaggggggagttagaaagctggggtcgtgatttgcatggatggaccctcccactctcagagtatgaagagggcagggagagatttgggaggctctgcttcagctgtgggcacaagaggcagcactcaggacaatctccagcatgcctggtctcctcnctccgcnctctcctcgctacnctgcacgaggtcctcgggccagtcctgtgccgtagacgcgacgcccncccgtcacggttcgtcgtccggggaccccagggccaggacgggtaccacgactctcccgtgccgacgtgggaacgcagccgtccaacgtcgtacggggcaaggnttaacgtgacgtgttaacgcgttaacgttcggtaaccgtaacgtacgtaccgttaacccgaaacggtaccgaaaccgtacccgtaaaccgtccctacgtagtacctactacgtacaaccctaaccgacgtacccggtaccctccgtaccgggttaccgacggtaccgtcctttcgtcgtaccgtcctaaaccgtgttaccgccggtcctacttcccgcgtccccgtcgtccggaacctccgtaacccgtccggtcggtacccttaccggg

SEQ ID NO: 229319 - DNA, 789 bp, Homo sapiens
  misc_feature: GYAE6OF02JIMJB.34.1.A01.1.454.CMB.1.raw
tcagtacacgtgatcacgaccggtgctcgatttagacgtctcatcagggggggattagaaagctgggggtctgatttgcatggatggaccctcccactctcagagtatgaagagggcagggagagatttggggaggctctgcttcagctgtgggcacaagaggcagcactcaggacaatctccagcatcggcctggtcctcctctcctcctcactctcctcgctcactcgcacgagggtccctgggccctagtctgtcgctcgacgcacgcccgccctcgtacggtcgtccggtcggggcccccgaggggccgaggacgggtccaccgtactccgtccgtcgacctacggtcgggacgccgtacgccgtacccaaacgtccggttaccggggactaaggttacttaagtcgtagttcggtacgtacttaacgtttaccgggtaaaccctaacgtccgttaacccgttaaccgggaacggaaacccgtacccggtaaacccctaaaccgtcccttaaccgtacgttacccgtacggtaaccgggaaccgtaaacctaaaccgtaaccgggtcccggttaacccccgttacggggttacccgggtttaccccgtccgggtaacccgttaccgtttcccgttaccggtaccgggttaacccttaacccgggttacgttcccggtacccggtttcccgtaccccgtttacgaacccccgtttcccgtccccgggttaccgtaaccccgttaccgttacccgtacccgggtttacccggtacccctacccgggg

SEQ ID NO: 229320 - DNA, 649 bp, Homo sapiens
  misc_feature: GYAE6OF02GABPW.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagaagtctgggtcctcggtgaaggtctcctggacaaggtcttctggaggcaccttcaacagtctttggtatcaacgtgggtgcgacaggcccctggacgaagggcttgagtacagtgggaggaatcactcccttattttagaatacgaaggaaataacgacaacaagtaagtttacgaggtacaagtagtgtacggataccgaccgacggaacgaacgtacccgaacgaaactaacgtaaggtttaacgtaggtaaggttagaacgacaaggccgtagacgtaactacgtaggaacgtaaccgaccggtacgtaacgttagttaagtttacgttacggtcggtaacgaagtaaggtaagggttagggttaacggggtcgggggggttacctttagggtaagttaggttagggtacggggtaccggaaagggtacgaaggttaggtacgtacgg

SEQ ID NO: 229321 - DNA, 616 bp, Homo sapiens
  misc_feature: GYAE6OF02G5RII.34.1.A01.1.454.CMB.1.raw
  modified_base (233)..(233): a, c, t, g, unknown or other
  misc_feature (233)..(233): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagcctgggtcctggtgaaggtctctgcaggcttcnggagcaccttcaacagctttggtatcaacgtgggtgcgacaggtcccctggacgagggtcgttagagtacagtgggaggaatcacttcccttagttttgaattacgaaggtaaactaacgacactagtaagtttcgagggtcaggtagtgtacgataccgaccggacggacgaactaccgaacgtaacactaaggttaccgtgggtacgttacggagcgtacgtccgtgagagttacagaacgtacgaccggtaccagttacgttacgtttacgtggtacgacgaggtaggagggttgggttacggggtacggggggttcctttagggtacgttaggttgggtacggggtaccgaagggtaacgtacggttggtagttaccgg

SEQ ID NO: 229322 - DNA, 624 bp, Homo sapiens
  misc_feature: GYAE6OF02HH1JP.34.1.A01.1.454.CMB.1.raw
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagcctgggtcctcggtgaaggtctcctgcaaggcttcgtggagcaccttcaacagtctttggtatcaactgggtgcgacaggcccctaggacgaagggcttggacgtacagtgggaggaatcatcccttatttagaataacaggaaataacgcaacagaacgtttcgaaggcaagagtcgtcgataccgaccgtacggaccgtaacgtacccgaacgtaaaccgaacgtaacgtttacggtaggtaggttagaggacgtacgtaccgagtacgatcgtaggaacgaccgacggacctagttacgttacttacgttcggtgtacggaggtaggtagggtagggttaggggtcgggggggttactttagggtagttagttgggtacggggtacgggaacgggtaacgtaacggttacggtagttacgg

SEQ ID NO: 229323 - DNA, 593 bp, Homo sapiens
  misc_feature: GYAE6OF02GLL0W.34.1.A01.1.454.CMB.1.raw
tcagtacacgtgatcacgaccggtgctcgatttagacgtctcatcaggggacagtaacgaaccacattcctcctctaaagaagcccctgggagcacagctcatcaccatggactggacctggagttcctcttgtggtggcagcaggctacaggtgtccagtctcaggtgcagctggtgcagtcgtggggactgaggtgaagagccgtgggtcctcggtgaaggtctcctgccaaggcttcgtggaggccaccttcaacagtctttggtatcaacgtgggtgcgacgacggtccctggacaaggggcttgagtacagtggagatcatcctatttgaatacgaggtaaatacgacacagaagtttcgaggtcagagtgcgatccgacgacggacgaactccgaacgaacacgtacgttacgtaggtagttgagacgtagccgttagagtactcgtagaacgacgaaccggcctagttacgttacgttacgtggttacgacgaaggtaggtagggtaggtacggggttggggggtacctttgggtaagttaggtgggtacggggtaccggtaagggacgtagtaggtacgtaacgg

SEQ ID NO: 229324 - DNA, 169 bp, Homo sapiens
  misc_feature: GYAE6OF02H1UOO.34.1.A01.1.454.CMB.1.raw
  modified_base (149)..(149): a, c, t, g, unknown or other
  misc_feature (149)..(149): n is a, c, g, or t
  modified_base (154)..(169): a, c, t, g, unknown or other
  misc_feature (154)..(169): n is a, c, g, or t
tcagtacacgtgatcacgaccggtgctcgatttagacgtctcatcaaggaaggagggaccaaggtggagatcaaacgaactgtggctgcaccatctgtcttcatcttcccgccatctgaatcacgtgtactgagcggctggcaaggcgnatagnnnnnnnnnnnnnnnn

SEQ ID NO: 229325 - DNA, 240 bp, Homo sapiens
  misc_feature: GYAE6OF02I2GCM.34.1.A01.1.454.CMB.1.raw
  modified_base (168)..(168): a, c, t, g, unknown or other
  misc_feature (168)..(168): n is a, c, g, or t
  modified_base (218)..(218): a, c, t, g, unknown or other
  misc_feature (218)..(218): n is a, c, g, or t
  modified_base (224)..(240): a, c, t, g, unknown or other
  misc_feature (224)..(240): n is a, c, g, or t
tcagtacacgtgatcacgaccggtgctcgatttagacgtctcatcactgggctccaggctgaggatgaggctgattattactgcctgtcctatgacaagagcctgactgtttatgtcttcggaactgggaccaaggtcaccgtccttggtcagcccaaggccaacccntgcactctgttcccacctctcatcacgtgtactgagcggctggcaaggcncatagnnnnnnnnnnnnnnnnn

SEQ ID NO: 229326 - DNA, 814 bp, Homo sapiens
  misc_feature: GYAE6OF02G5V0X.34.1.A01.1.454.CMB.1.raw
tcagtacacgtgatcacgaccggtgctcgatttagacgtctcatcaggggacataacaaccacattccctcctctaaagaagcccctgggagcacagctcatcaccatggactggacctggaggttcctctttgtggtggcagcagctacaggtgtccagtctcaggtgcagcgtggtgcaggtcgtgggctggaggtagaagagtcgtcgggtcctggtagaggtcctccgtgacgaaggtcctcgtagggacgtcctaccttagaacgtgtcgtttaggtactacctaacggttcgggtacgaccggtaccgtaccgggccccgtacgggaaccggtaccgggtacttacgggaacgtacggagggtacggggaacggtaacgtacgtacccgtttaccgtttaagtttaacggaaacgttaaaccgtaaaaggtaaaccgttaaaccggaacgtaaacgtaacggttaacgtttacgggaacgggtaacgtaacggtaaggtacggttaaccgacggttaccgaaccgggtaacggtaaccgtaaaccggtaacccgtaaacggtaaccgtaacggttaacggtttaacggtagggttacggttacggacggtacgtacggtccgtagtacgtaagttaccgaacgtaacggtaaccggtaccgtaccgtagtttacgttaacgttaccgtacggtaggtaacggagggttacgggtaagggtacggggttacggggttcggggttaccggttaggtaacggttaggtacgggtaggtacgggtaacggtaggtaaggttggtaacgttcg

SEQ ID NO: 229327 - DNA, 744 bp, Homo sapiens
  misc_feature: GYAE6OF02GUEU0.34.1.A01.1.454.CMB.1.raw
  modified_base (163)..(163): a, c, t, g, unknown or other
  misc_feature (163)..(163): n is a, c, g, or t
  modified_base (226)..(226): a, c, t, g, unknown or other
  misc_feature (226)..(226): n is a, c, g, or t
tcagtacacgtgatcacgaccggtgctcgatttagacgtctcatcagggggggattagaaagctgggggtctgatttgcatggatggaccctcccactctcagagtatgaagaggggcagggagagagtttggggaggctctgcttcagctgtgggcacaagnggcagcactcaggacaatcctccagcatcggcctggtcctcctctcctcctacacgtcctccncgctcactgcacgacgggtcctcggccctgtcgtgtcgccgtacgtaccgccgacgccccgtcccgtcgtaggttaccggtccggtcccgggggaccccccggaacgtacggacgtaccgtaccgtaaccctaccttcccgtacccgtcgaccgtacgggtccgggacctacccgtaccgaaccgtacggtcgggtacgtagtttacgtgtagtacgtacctacggtacgtaacgacgcgtaccgtaccgtaccgaaccgaaccaaccccgaaccctaccgtacctacgtactaccgtacgtaccgtaaccctaacgaacccgtaccgacccgtcccggttaaccggaccggttcccgtaccggttaccgttcgttaccgttccgtaccgttacccgtacgttaaccggtcccgtaacggtaccccttcgtacccgtaccccgttcccgtaccggtaccgttaccctaccggttccggaccggttccgggtacccggtccggttacgtcggtaacggg

SEQ ID NO: 229328 - DNA, 805 bp, Homo sapiens
  misc_feature: GYAE6OF02H6SU8.34.1.A01.1.454.CMB.1.raw
  modified_base (176)..(176): a, c, t, g, unknown or other
  misc_feature (176)..(176): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctcttgtggtggcagcagctacaggtgtccagtctcaggtgcagctggtncagtctggggcttgacggtgaagaagtcctgggtcctcgggtgaacggttctccgtgccaaagggtcttccgtaggcggcaccttcaaactgctttcggtatacaacgtgggtcgacgacgtacggcccctaggacaaggtcgttaggagtaacgaggtacgggaggtaactccgaatacccgttaagttttagaatacgaaaggaaaactaaccggacaacgtaacgaacggtttacgaacggggacaacggtaagttggtaacggtactaccggtaaccggacggtaacgaaactcccgtaaaacgaacctaaacgtaaagtttaccgggtggttaacgggttacgaagtaccgacggttacgtcggtaaacggtacttaccggtacggtaaacggaaccgtaacccggtacccgtaaacgtttcggttaacggttttaaaccttacggttacggttaacgggtaacgggaaccgggttaaaggggttacggggtttaaacgggggttcgggggggggtttaaaccgtttaccgggttaagggttaaccggtttagggggtaacggggttaaccccgggaaacgggtttaaaccgggtaacccggtttaagggtccgtttaaccggg

SEQ ID NO: 229329 - DNA, 574 bp, Homo sapiens
  misc_feature: GYAE6OF02G4TW0.34.1.A01.1.454.CMB.1.raw
  modified_base (249)..(249): a, c, t, g, unknown or other
  misc_feature (249)..(249): n is a, c, g, or t
  modified_base (362)..(362): a, c, t, g, unknown or other
  misc_feature (362)..(362): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctggaggtgaagaagcctgggtcctcggtgaaggtctcctgcaaggcttctggagcaccttnaacagcttggtatcactggtgcgacaggcccctggacagggcttggagtacagtgggaggaatcgactccctattttagaactacaggaaataacgacacaagtaacgtttanagggtacaggagtcgtcgatccgaccggacggtaacgaactaccgaacgaacgactacggtttacgagtagtgagtcacgcctagacgtatctaggaacgacgacggcaagttgtaacgttacgtgtagcggaagaggtagggtggtacggggtgggggtactttaggagttaggtggtacggggacgtaagggactaaggtcggtagtacg

SEQ ID NO: 229330 - DNA, 694 bp, Homo sapiens
  misc_feature: GYAE6OF02JM1PO.34.1.A01.1.454.CMB.1.raw
  modified_base (160)..(160): a, c, t, g, unknown or other
  misc_feature (160)..(160): n is a, c, g, or t
  modified_base (171)..(171): a, c, t, g, unknown or other
  misc_feature (171)..(171): n is a, c, g, or t
  modified_base (387)..(387): a, c, t, g, unknown or other
  misc_feature (387)..(387): n is a, c, g, or t
tcagtacacgtgatcacgaccggtgctcgatttagacgtctcatcagggacataacaaccacattcctcctctaaagaagcccctgggagcacagctcatacaccatgactggacctggtacggttcctctttgtggtggcagcagctacaggtcgtccnccggtcctagnggtgcagcgtggtgcgtagacggtgggctggaggtcccgaaaggccctgggtcccctcgggttgaaggtcctccgtgcgaaggtcttcgtggacggccaccttacaacagtctttggtagtcaacggtcggtgcgtacgacggccccgtacgtacgaagggtccgtgtagtacctttaaagtggacgaagtccgtattactagtttagaacgtaanaaccggtaaataacgagtaacgtacggaagttcgaaggtacgtacgtacgtgacgtacgcgaccgaccgacgaacaccgacgtaacgtacgtaggttacgtaggtacgtacgtagcgtacgacgtacgtagtaagacgagtaaccgaacgtacggtacgttagtacgtagttacgttacgtaaggaggtaacgtaggggtacgggttacgggttacgggttacgggttacgggtttggaacgtttaacggacggttagggtaccggttaacggggtaacctaagggttcggttacgttagttaccgg

SEQ ID NO: 229331 - DNA, 706 bp, Homo sapiens
  misc_feature: GYAE6OF02IS4JU.34.1.A01.1.454.CMB.1.raw
tcagtacacgtgatcacgaccggtgctcgatttagacgtctcatcagggggggattagaaagctgggggtctgatttgcatggatggaccctcccactctcagagtatgaagagggcagggagagagtttgggaggctctgcttcagctgtgggcacgaagaggcagcactcaggactaatctcagcatggcctgtctcctctcctctcactcctcctcgctcactcgctacgcgggtcctcgggccctagtctgtcgtctcgtacctcgcggcctcgtcctccggttcgtcgttcggtcctccgtcggtaactcgtcgactccgtacctgttcctccgtcgtaccgtaccggttacggtaaacccggtcgtaacggttacgggttacgttacgacttaggtaattaaccgtaagttccgttcgttacccgttaccgtacgttaaacccaaacccgtaacccgtaaccccggaactaaaccgtccctaaccctaaacgtcctagttacgttacttacgtacgtattaccgttaacaacgttaccgccgttaccttcgtacgtttaccttacgtccttaacgttccctttaccttcgttacccgtaccttcccgtcgtttaacgttccggttaccgtaccgtacccgaacccgttcccgttaccccgttccacgttaccttaccgttcgttaacccggtctacccgg

SEQ ID NO: 229332 - DNA, 909 bp, Homo sapiens
  misc_feature: GYAE6OF02G8WB1.34.1.A01.1.454.CMB.1.raw
  modified_base (156)..(156): a, c, t, g, unknown or other
  misc_feature (156)..(156): n is a, c, g, or t
  modified_base (160)..(160): a, c, t, g, unknown or other
  misc_feature (160)..(160): n is a, c, g, or t
  modified_base (287)..(287): a, c, t, g, unknown or other
  misc_feature (287)..(287): n is a, c, g, or t
tcagtacacgtgatcacgaccggtgctcgatttagacgtctcatcagggggggattagaaagctggggtctgatttgcatggatggaccctcccactctcagagtatgaagaggggcagggagagatttggggagctctgcttcagctgtgggcanaagnggcagcactcgaaggacaatcctaccagccagttcgggcccttacgggtcctacccgttcctcccgttccctcctaccttccttcccgtccgaccttccgacttcgcctaacggtacggggttcccncgggggcccctaggttcgtacggtcgtccgtacggaccgtaccgaccggtcccccggtaccccttcggaaggtttccgggtcccgggtacccgggggggaccccccgtaagggggacccgtaacgggggtacccggggttacccaaaccccggtacgtttaccccggttccccgttcggtaacccggtaaccgggttacgggggacctaccggtaaaccggtccctaaacccggtaaacggtaccggggttacccgggggtacttaaacggggtttactacggtaacgtttaaccgggtaacctacgggttaacggtaaacgaacggtaccgtaaccgttcgttaaaccggaaccggaaaacccgtacccccgtaaaccccgtaaccgttccctaacgtaccttaaccgttacgtaccgttaaacctaaacccgtaacccggtaccgtaccccggccccttaacggggtaccccggttacccgtacgtaacccgtcgttttaaccccgacggttccgaaccgtccgtaacggttcccgtaccgtaccgtacctccgacccgttaccccgtacggtccgaccttaccgtcggttccccgggtcggttacccgggtcgtaacgg

SEQ ID NO: 229333 - DNA, 768 bp, Homo sapiens
  misc_feature: GYAE6OF02HESG9.34.1.A01.1.454.CMB.1.raw
  modified_base (234)..(234): a, c, t, g, unknown or other
  misc_feature (234)..(234): n is a, c, g, or t
tcagtacacgtgatcacgaccggtgctcgatttagacgtctcatcaggggacataacaaccacattcctcctctaaagaagcccctgggagcacagctcatcaccatggactggacctggaggttcctctttgtggtggcagcagctacaggtgtccagtctcaggtgcagctggtgcagtctggggctgaggtgaagagccgtggtcctggtgaggtctcgtgcaggcttcgnggacgctaccttcaacagtcgtttggtactacgtaaccgtgggtcgacgaccgacggtccccgttggaacgaagggcctttggtaacgtaccgagttacggggaaggaacgtcgtacttccccgttaagttttgaaacgtacgaaggtaaaacgtaaccgactaacgaacggttaagtttaccgaggggtacaggtaagttcggtaccgtaacgttccggaacccggtacgggaaccgtaacgtacccgaaacgtaaaccgtaacgttaacgggttttacggtagggttaaggttacggaggtaccgtaacggtaccgttaagggacgttaacgtcgtaacggtaaacggacccggaaccggtacgtaacgttacggtttaactttacggtcggtacggtaacggtaaggtaaccgggtaaggggttggggttaacggggggttgggggttaccctttaagggtacgttaagggttacggggtaccggggtaaacggaacgggttaaccgaacggttacgggtagttacccggg

SEQ ID NO: 229334 - DNA, 952 bp, Homo sapiens
  misc_feature: GYAE6OF02FGGF8.34.1.A01.1.454.CMB.1.raw
tcagtacacgtgatcacgaccggtgctcgatttagacgtctcatcagggggacataacaaccacattcctcctctaaagaagcccctgggagcacagctcatcaccatggactggacctggaggttcctctttgtggtggcagcagctacaggtagtccagtctcaggtgctagcgtggtgcaggtctggggctgaggtagaacgaacggtccgtgggtccccttcgggtacgaacgggttccctacccgtggaccgtaagggtcccttacggtcggggacggtccctaccgtttacaaaccgtagtccgttttaggtacctaccgtaacggttcgggggtacgacccggaacgtaccggggacccccttaggggaaccgtaaacgggggtccttacgggtaacgttaaccgaacgggttagggggtaaaccgggaaacgttccctaaacggttttaccccctttaagtttttaaccggaaaccgtttaaaccgggaaaacggtaaacgttaaacccgaccgaaaccggttaacggttaaaccgggttaaccggtaacggggacccaaggggttaacgttacgggttaaccgggtaccttaacccgggaccgggaacccgggtaaacccgtaacgtaacccgtaaacccgaaacccggtaaccgttaacgggtttaaacgtgggttaaacggttagggaaccgtaccgggttactacccggtaaggtacgaacgttaccgtaacgggtaaacgaaccggtaccgggtaacccgttagttaaccgggttaactttacgggtacgtaccgggacggtaaggggtaacggtaggggttaggggtaccgggggtttaggggggtaccctttaagggtaaggtttacggggtacggggtaaccgggggtaaccgggtaaaggtacccggttaacggtcgggttaccctttaaccggg

SEQ ID NO: 229335 - DNA, 894 bp, Homo sapiens
  misc_feature: GYAE6OF02IMUOD.34.1.A01.1.454.CMB.1.raw
tcagtacacgtgatcacgaccggtgctcgatttagacgtctcatcaggggggggattagaaagctgggggtctgatttgcatggatggaccctcccactctcagagtatgaagaggggcagggagagtagtttggggaggctctgcttcagctgtgggcacaagaggcagcactcaaggacaatctaccagcatcggtccgtggtcctacctcctcctctcctactccttcctccgtcgtacactcgaccgtacggtacgggttaccgtccgggaccctacggttccgttcggttcccgtacggaccgtcgaaccgccccggtcccttacctaccgttcgtacccgggtcccggggggacccccgtaacggaacggtacggaccgtaaccaacccgtacgttccgttacccgtcggtaccggtaaccgggtacggggtacccctaaccctaaccgtaacgtaccggtaccgggggtaactaacggtaactttaggtacgtggttacggttctacggttaacgttaaccggtaaacccgaacgttacggtaacccgtttaacccgggaaacgggaaacccccgtaaccggaacccccttaaaaccgttccccgtaaactacccgttaccggtaaacgttaccgggtaaacgtaaaacccgtaaacccggtaaacccgttcccccgggtaccggtaaccgggttacccggggtacccgttaccgggtacccgttacgtttccggtaacgttccgtaacccgttaacgttaaccggcgtttacccggaccctttaccggtaccgtaaccccggttcccgttaacccggtacccggtaccttaaccgggtccttaccgggttccggaacccgtaccccggttgggaacctaaacgggg

SEQ ID NO: 229336 - DNA, 880 bp, Homo sapiens
  misc_feature: GYAE6OF02FJPKM.34.1.A01.1.454.CMB.1.raw
  modified_base (121)..(121): a, c, t, g, unknown or other
  misc_feature (121)..(121): n is a, c, g, or t
  modified_base (144)..(144): a, c, t, g, unknown or other
  misc_feature (144)..(144): n is a, c, g, or t
  modified_base (149)..(149): a, c, t, g, unknown or other
  misc_feature (149)..(149): n is a, c, g, or t
  modified_base (159)..(159): a, c, t, g, unknown or other
  misc_feature (159)..(159): n is a, c, g, or t
  modified_base (214)..(214): a, c, t, g, unknown or other
  misc_feature (214)..(214): n is a, c, g, or t
tcagtacacgtgatcacgaccggtgctcgatttagacgtctcatcagggggggattagaaagctggggtctgatttgcatggatggaccctcccactctcagagtatgaagagggcagggngagatttggggagctctgcttcngctgnggcaacgagngcagcactcgagacactcaccagcagtcggcctggtcctcctctccctccgtacnccgtcctacctcgactcgactcgccacgcggtccgtcggcccagtcgtggtcgtcgcgacgcacggtccccgtccgtcgacgttccggccggtaccggggaccccgagggtacgaggtaaccgggtacctacgtaccgttccctacgtcgccggtacggtcgggacgtccgaccgaccttaccaacggtcgggtacgggtactaaacggtttacttacgggtaagttaccggttcggtaacgtacccgtttaggtttaccccggaaaacttaacccggtaccggtttaccccgtaaaccccgggaacggtaaaaccccggtaccccggtaaaaccccgtacccgtttaccctaacgttacccgttaacccggttaccgggaaacgttaaacccggtaaaccttaaacccgggtaaccccggtttccccgggtaacccggtttaaaccccgggggtccccgggttaacccgggttaaccggttaacccgttttcccggttaacccgttaaacccggttccggttaaccccggttaacccgtacccggttcccgttaccggttaaccctaccccggtacccggttacccccgttcccggttacccggttcccgttaacccgttaccgtaacccgggtccccggtttacccgggaccgttaccccgggg

SEQ ID NO: 229337 - DNA, 741 bp, Homo sapiens
  misc_feature: GYAE6OF02FW1DO.34.1.A01.1.454.CMB.1.raw
  modified_base (196)..(196): a, c, t, g, unknown or other
  misc_feature (196)..(196): n is a, c, g, or t
tcagtacacgtgatcacgaccggtgctcgatttagacgtctcatcaggggacataacaaccacattcctcctctaaagaagcccctgggagcacagctcatcaccatggactgacctggaggttcctctttgtggtggcagcagctacaggtgtcccagtctcaggtgcagctggtgctagtcgtgggctgaggtnaagaagccgtgggtcctcggtagaaggtcctcctgcgaaggtcttcgtggaggcctaccttacgaacgtagtccgttttaggtactaccgaacggttgggttcgaccggtacgaccggtccccctagggaaccggtagggccgtttacggacgtactaggtaggggtaacggtaactaccgaactttacccgtttatttacggtaaactacggtaaagtaaaccgtaaacgactaccgtaaaggttaacgtttacggaagggtacctaacggggtagtacggttaccaaccgttccgacccggtaccgggaacgtaacctaccgaaaccgtaaacctaacggttacggttaccgtaggggtgtacggacgactacggtacctaggtacgtactacgacgtaagacccgacggtacgtacgttacggtaattacgtgtacgcgtaaggagttacggggtagggttacgggtcggggtttaacgttgggaacttgggtacgggtacggggaaccggaagggttacgtaaggttcgtacgttaccggg

SEQ ID NO: 229338 - DNA, 509 bp, Homo sapiens
  misc_feature: GYAE6OF02FTRKO.34.1.A01.1.454.CMB.1.raw
  modified_base (202)..(202): a, c, t, g, unknown or other
  misc_feature (202)..(202): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (480)..(509): a, c, t, g, unknown or other
  misc_feature (480)..(509): n is a, c, g, or t
tcagtacacgtgatcacgaccggtgctcgattttagacgtctcatcaagggaaggaaggggctggagtgggttctcaactattagtggtggtggtggtagcacatactacgcagactcccgtgaagggccggttcaccatctccagagacaattccaagaacacgctgtttctgcaagtgaacagcctgagagccgaggacncggccgtatactactgtgacgaaagatgtgaccgaacgggttactagtggggttcgggagtccaacccccgtgttttgattatcgtgggccaagggacacgtgtccacgtctcttcacgccctccaccgaggcccagtccggtccttccccgngccnccctccaccaganccacctcgtggggcacgcgccggcccgtgggctgccgtgacacgtcctactccatcgngttcgtactcggnggccggcgtcggacaccgggtcgacntacgnagncgnnnnnnnnnnnnnnnnnnnnnnnnnnnnnn

SEQ ID NO: 229339 - DNA, 597 bp, Homo sapiens
  misc_feature: GYAE6OF01APJQP.24.37.D04.1.454.CMB.1.raw
  modified_base (485)..(485): a, c, t, g, unknown or other
  misc_feature (485)..(485): n is a, c, g, or t
tcagactactatgtcacgaccggtgctcgatttagtagcatactgttgggtttggggaggaactgctcagttaggacccagagggaaccatggaagccccagctcagcttctcttcctcctgctactcgtggcctccagatcgcccgaccggagactattggttgttgacactagtcctccagcccaccctgttctttgtcctccggaaggggaaagcgcccaccctcctcctgcgacgggccagtgaacaattggttaaggaagtttgtacgccgtggtatacaacaacaaacagtggccaggcctcccggctcctcatctatgatgcactaccaagtacgggccacgtcggcactccccagacgtaggttcaggtcggcgtaggtgggtcgtagggacaggtacttcgactctcacctatcagcaggtgtagacgcctagaagttattttcgcttaagttttattacgtgtcagctaccggtnacctaacgtcggtaccctacgtttccggtcccgtcgggaccacgacgtggaaccactacccgaaccgtaacgtcggtcggactcgaccacctactcgtcgttccttctaccg

SEQ ID NO: 229340 - DNA, 221 bp, Homo sapiens
  misc_feature: GYAE6OF01BCTIW.24.37.D04.1.454.CMB.1.raw
  modified_base (220)..(221): a, c, t, g, unknown or other
  misc_feature (220)..(221): n is a, c, g, or t
tcagactactatgtcacgaccggtgctcgatttagtagcatactgttgggtttggggcacagggaccacggtcaccgtctcctcagcctccaccaagggcccatcggtcttccccctggcaccctcctccaagagcacctctggggcacagcggccctgggctgcctggtcaaggactacttccacatagtagtctgagcgggctggcaaggcgcatagnn

SEQ ID NO: 229341 - DNA, 525 bp, Homo sapiens
  misc_feature: GYAE6OF01ACFUL.24.37.D04.1.454.CMB.1.raw
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacatggccaggcctccccggntcctcatctatgatgcatccaagtacgggccactggcatcccagacaggttcagtggcagtggtctgggacngacttcactcncaccatcagctagtgtagagctagaagtattttgctagtttattactgtcagcaccgtgaccaacgtcggccctacgtttccggccgttagggacccaggtactggacctacgtaccgaacgtaactggtcggctgcctaccatctcgtcttctac

SEQ ID NO: 229342 - DNA, 595 bp, Homo sapiens
  misc_feature: GYAE6OF01B66J9.24.37.D04.1.454.CMB.1.raw
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggagacattgtgttgacacagtctccagccaccctgtctttgtctccgaggggaaanacgccaccctctcctgcagggccagtgacaatgtaggagttgtagctgtatcaacacaaacntggccaggcctcccggctcctcatctatgatgcataccaagtacgggccacgtggcactcccagaccgaggttcaggtggctaggtgggtcgngggacagtacttcactcacaccatcagcagtgtagagcctaggtaagtnttttacgacttaagttttacttacgtgtactacgacctaccggtagaaccgtaaccgtccggacccttaccgtttccggacccgtcgggtaacccacggtaccgtacgggacctactaacccgaaacgtaccgtggttcggccgtacggacctaacccttactaccgttcgttaccttcgtacccg

SEQ ID NO: 229343 - DNA, 641 bp, Homo sapiens
  misc_feature: GYAE6OF01A64U4.24.37.D04.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccacctctcctgcagggccagtgacaatgttaggagttgttagcctggtatcaacanaaacntggccaggcctcccggctcctcatctatgatgcatccaagtacgggccacgtggccactcccaagactagtttcagtggctaggtcgggtctagggactacggactttcgaaccttctaccgaaccagttacagctaaggttcgtaggacgtcctaaggtaagttattttcgacttaaggttttattactgtaccagtacctaaccggtagaacctaaccgttcccggtacccttaccgtttccgggacccgttacgggacctaacggtacgtacggaacccgtacgtaacccgaaacggtaacttcgggtacggtacccgttacgaacccgttacccttaagtttccccgttaggttcccgtttaccgtaaccc

SEQ ID NO: 229344 - DNA, 543 bp, Homo sapiens
  misc_feature: GYAE6OF01BNS6I.24.37.D04.1.454.CMB.1.raw
tcagactactatgtcacgaccggtgctcgatttagtagcatactgttgggtttggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccagggaagagcctggagttggttgcgagtatccattatcatgggcgaacccccttctacattccgtcctcgagagtcgagtcaccatttcactggacgccgtccaagaaccagtactccctgaggctgcggtctgtcgacccccgcggacacggccgtatacttactgtgcgggtcttaggtctagttgtgttggcgtatgtctgctactaccgcgcgctaattgttacggtgggtcgtttggggacacgagggccgtacgg

SEQ ID NO: 229345 - DNA, 508 bp, Homo sapiens
  misc_feature: GYAE6OF01CEYV7.24.37.D04.1.454.CMB.1.raw
  modified_base (203)..(203): a, c, t, g, unknown or other
  misc_feature (203)..(203): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagactactatgtcacgaccggtgctcgatttagtagcatactgttgggtttgggtgaggaactgctcagttaggacccagagggaaccatggaagccccagctcagcttctcttcctcctgctactctggctcccagatgccaccggagacattgtgttgacacagtctccagccaccctgtctttgtctccaggggaaangccacctctcctgcagggccagtgacaatgttaggaagttgtagcctggtatcaacacaaacatggccaggcctccccggntcctnatctatgatgcatccaatggccagtggcatcccagacaggttcagtgcaggtggtctgggacagcttcactcncaccntcagcagtgtagagcctagaagtattttgacttagtttacttactgtcagccacgtgactaactcggccctacgtttcgccctgggaccagctggacacgtccgaacgactggtacgctacgccaccattctgtccttacc

SEQ ID NO: 229346 - DNA, 605 bp, Homo sapiens
  misc_feature: GYAE6OF01ATD7G.24.37.D04.1.454.CMB.1.raw
tcagactactatgtcacgaccggtgctcgatttagtagcatactgttgggtttggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctcgtggtgactccttcagtaacacagtatttattagttgggcctggactccggcacgccccgagggaagacgccgtggagttggtgcgagtactcctattatcagtcgggaccgtaacccccttctactacttcccgtcctcgagagtcgagtccactattcacgtggacgccgtaccaaacgaacctacgtacctcccgtgacgtctcggtcggtctcgtccgacccccggcggaccaccggtccgtatacttacgtgtcggcggtacttaggtctagtttggtgttcggcgtagttgtctgaccgtaccgtaccgcgcgactaagttacgttacggtcgggtcggtttacggggatacggtacgggcccgtaccgg

SEQ ID NO: 229347 - DNA, 224 bp, Homo sapiens
  misc_feature: GYAE6OF01E11TX.24.37.D04.1.454.CMB.1.raw
  modified_base (221)..(224): a, c, t, g, unknown or other
  misc_feature (221)..(224): n is a, c, g, or t
tcagactactatgtcacgaccggtgctcgatttagtagcatactgttgggtttggggcacagggaccacggtcaccgtctcctcagcctccaccaagggcccatcggtcttccccctggcaccctcctccaagagcacctctgggggcacagcggccctgggctgcctggtcaaggactacttccacatagtagtctgagcgggctggcaaggcgcatagnnnn

SEQ ID NO: 229348 - DNA, 509 bp, Homo sapiens
  misc_feature: GYAE6OF01CDK16.24.37.D04.1.454.CMB.1.raw
  modified_base (415)..(415): a, c, t, g, unknown or other
  misc_feature (415)..(415): n is a, c, g, or t
  modified_base (500)..(500): a, c, t, g, unknown or other
  misc_feature (500)..(500): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagcctggtatcaacacaaacatggccaggctccccggctcctcatctatgatgcatccaatagggccactgcatcccagacaggttcagtggcagtgggtctgggacagacttcactctcaccatcagcagtgtagagcctgaagtatttgctagtttatactgtcngcacgtgaacaactcggccctactttcggccctgggacccagactggacactaccaacgtaactggtcggctgccaccattaccngtcttctac

SEQ ID NO: 229349 - DNA, 900 bp, Homo sapiens
  misc_feature: GYAE6OF01DNDGY.24.37.D04.1.454.CMB.1.raw
  modified_base (312)..(312): a, c, t, g, unknown or other
  misc_feature (312)..(312): n is a, c, g, or t
tcagactactatgtcacgaccggtgctcgatttagtagcatactgttgggtttgggggaggaactgctcagttaggacccagacggaaccatggaagccccagcgcagcttctcttcctcctgctactctggctcccagagaccaccggagaaattgtgttgacacagtctccaggcaccctgtctttgtctcgaggggagaggagccacctctcctgcagggccaggccgagtgtagtaagtcttaggctggtaccagacgaactggaccaaggctccgaggcctccgtcatcctatgatgtctccaacgngggtcacgtcggccgtccccgcgtacggttccaggttcggcgtaaggttcggggtaccgttgggggaaccctaagggtaccgtttccgaacccgttccggtacccgtaacccggttacgaacggtacccgtaacggtaccccgttaaacgggaccggttaccccgtagggtaaacggttaacggtttttttaccggggaaccgggttttttaacccgttaaccggtttacgggttaacccgttaaacgggttacccttaacggggtttacccggttttaccccggtcccgtttaccggggacccccggtttaaccggttttaaaacccggggtttttcccgggggggaacccggggggggggttaacccccgttaaacgggggggggttaccgggttaaaccgggggtaaaccgggggttaaaccggggtaaacccggggttaaaacccggtttcggggggtacgggtacccgttaagggaccccggtaaaccgttaacggttaccgttacggttacccgtttccgtaaccgttcccgttacccccgtacttaaccgttccgttacgtaaaccgtacgtttaaccggg

SEQ ID NO: 229350 - DNA, 536 bp, Homo sapiens
  misc_feature: GYAE6OF01C2UJG.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggagttgtagctggtatcaacacaaacatggccaggcctcccggctcctcatctatgatgcatccaagtacgggccacgtggcactccccaagactaggttcagtcggcaggtggtctgggacagtacttcactctcaccatcagcagtgtagagctagaagtatttgacttagtttattactgtacagcacgtgaacacgtcggtccctacgtttccggcccgtagggaccagtaccgtacggactactaccgaaacgtacgtggtcggctgacctacctatactcgtcttcgtacc

SEQ ID NO: 229351 - DNA, 575 bp, Homo sapiens
  misc_feature: GYAE6OF01CXTN1.24.37.D04.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctcgaggggaanagccacctctcctgcagggccagtgacatgttaggaagtttgtagcctggtatcaacacaaacatggccaggcctcccggctcctcatctatgatgcatccaagtaggccagtggacactcccaagacctagggttcaggttcggcgtaggtgggtctgggactagtactttcacttctcaccatcagcaagtgagacgccttagaagtnttttgactagttttattactgtacagctaccgtgaacctaactcggtaccctacgttccggcccgttacgggacctacggacgttacggacctaacgtacccgaaacgtacgtcggtacgcccgttacgaccctaccgtattccgttgttcccgtttctacccg

SEQ ID NO: 229352 - DNA, 498 bp, Homo sapiens
  misc_feature: GYAE6OF01DRPRZ.24.37.D04.1.454.CMB.1.raw
  modified_base (203)..(203): a, c, t, g, unknown or other
  misc_feature (203)..(203): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctgtgtctccaggggaaanagccaccctctcctgcagggccagtgagaatgttggcagcaacttagcctggtaccagcaagaaacctggccaggctcccaggctcctcctctatgctgtctccaccagggcccctggtcgtcccagccaggttcgtggcggtgggtctgggacagatttcactctcacatcagcagcctggagactgaagtattttgactaatgtattactgtcagcagcgtgacaactggcctacctatactactactttgccgacgggaccagctgacatcagacgatgtgactgcncntcg

SEQ ID NO: 229353 - DNA, 508 bp, Homo sapiens
  misc_feature: GYAE6OF01EIED0.24.37.D04.1.454.CMB.1.raw
  modified_base (203)..(203): a, c, t, g, unknown or other
  misc_feature (203)..(203): n is a, c, g, or t
  modified_base (504)..(504): a, c, t, g, unknown or other
  misc_feature (504)..(504): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccacctctcctgcagggccagtgacaatgttaggaagttgttagcctggtatcaacacaaacatggccaggctcccggctcctcatctatgatgcatccaatagggccactggcatcccagacaggttcagtggcagtgggtctgggacagacttcactctcaccatcagcagtgtagacgcctagaagtattttgctagtttattactgtcagcacgtgacaactcggccctacgtttccggcccttgggacctagacgtggaccataccaacgactgtcgctgcaccatctgtcttntacc

SEQ ID NO: 229354 - DNA, 537 bp, Homo sapiens
  misc_feature: GYAE6OF01DH3PB.24.37.D04.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (354)..(354): a, c, t, g, unknown or other
  misc_feature (354)..(354): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccaccctgtctttgtctccgaggggaaanagccacactctcctgcagggccagtcagagtataagagcaactcttagcctggtatcaacagaaacctgccaggctccaggctccncatctatggtatatccagcagggccagtcggtctcccgagcctaggttcagtggcaggtgggtcngggacagagttcactcgtcacatcagctagtctgctagtctagaagtntttgactagtttatacgtnctagcacgcacgagtgaacgtcggacctctcgtacgtttcgggacgggtaacggtacccggtaagggtggaaggactaaccgaaaacggtacgtggtacggactcgcccacgtacg

SEQ ID NO: 229355 - DNA, 509 bp, Homo sapiens
  misc_feature: GYAE6OF01APP6P.24.37.D04.1.454.CMB.1.raw
  modified_base (205)..(205): a, c, t, g, unknown or other
  misc_feature (205)..(205): n is a, c, g, or t
  modified_base (388)..(388): a, c, t, g, unknown or other
  misc_feature (388)..(388): n is a, c, g, or t
  modified_base (486)..(486): a, c, t, g, unknown or other
  misc_feature (486)..(486): n is a, c, g, or t
  modified_base (506)..(506): a, c, t, g, unknown or other
  misc_feature (506)..(506): n is a, c, g, or t
tcagactactatgtcacgaccggtgctcgatttagtagcatactgttgggtttgggggaggaactgctcagttaggacccagagggaaccatggaaggccccagctcagcttcctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggcctcccggctcctcatctatgatgcatccaatagggccactggcatcccagacaggttcagtggcagtgggtctgggacagacttcactctcaccatcagcagtgtagngcctgaagtattttgctagtttatactgtcagcaccgtgaacaactggaccctacgtttccggcccttgggacccagactggacatccgaacgactgnggctcgcaccatctgtcttntac

SEQ ID NO: 229356 - DNA, 731 bp, Homo sapiens
  misc_feature: GYAE6OF01COVMF.24.37.D04.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaaccaanagaaacctggccaggctccaggctcctcatctatgatcgtctccaaacngggtcacgtggccgtccccgcaggttcagtggcaggtgggtccgtaggacgacgttcactctcctaccgtcgacgacgacgtaccgtacgtaacggaccttcggtaaaggtaacgtttttcggtttacggggtttaacctttaaccgttaggttaccgtaacgacggtacgtccgggtttcccggttcccgccgggttccggaccgtttaaccgttttaccggggtaccggggggggaccgggtaaccgggttgggggtaacggaacggggtacggaaacgggtaaccgttaaggtcggggtaccgtacggtaccgacccgtaacttcgtttacggtttccgttaccgttaaccgtacccgttttcccccgaaccccgtacttaacgtaccgtaaactaacgttaacggtttaaacggg

SEQ ID NO: 229357 - DNA, 514 bp, Homo sapiens
  misc_feature: GYAE6OF01ANLFX.24.37.D04.1.454.CMB.1.raw
  modified_base (204)..(204): a, c, t, g, unknown or other
  misc_feature (204)..(204): n is a, c, g, or t
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
  modified_base (502)..(502): a, c, t, g, unknown or other
  misc_feature (502)..(502): n is a, c, g, or t
tcagactactatgtcacgaccggtgctcgatttagtagcatactgttgggtttgggggaggaactgctcagttacggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggcctccccggctcctcatctatgatgcatccaatagggccactggcatcccagacaggttcagtggcaggtggtctgggacngtacttcactctcacatcagcagtgtagancgtgaagtattttgctagtttatactgtacagcaccgtgacaactcggaccctacgttccggccctagggacccagactggaccataccgaacgacgttggcgctcgacaccntctcgttctctc

SEQ ID NO: 229358 - DNA, 544 bp, Homo sapiens
  misc_feature: GYAE6OF01AUOTO.24.37.D04.1.454.CMB.1.raw
  modified_base (207)..(207): a, c, t, g, unknown or other
  misc_feature (207)..(207): n is a, c, g, or t
  modified_base (362)..(362): a, c, t, g, unknown or other
  misc_feature (362)..(362): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccgggagacatttgtgttgacacagtctccagcccaccctgtctttgtctccgaggggaaangccaccctctcctgcagggccagtgacaatgttaggaagttgttagcctggtatcaacacaaacatggccaggcctcccggctcctcatctatgatgcactccaagtacgggccacgtggacactcccagacacggttcagtggctaggtggtcngggacaggtacttcactctacacctataccagcagtgtagacgccgtagaagtattttgacttagtttattactgtcagtcaccgtgaacacgtcggacccttacgtttccgacccgtcgggacctagacgtcggacacgtaccgaacgtacgtggtcgctcgcactactctctcttcgtac

SEQ ID NO: 229359 - DNA, 645 bp, Homo sapiens
  misc_feature: GYAE6OF01DP755.24.37.D04.1.454.CMB.1.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
tcagactactatgtcacgaccggtgctcgatttagtagcatactgttgggtttgggggaggaactgctcgtagttaggacccagagggtaaccatggaagccccagctcagcttctcttcctcctgctactcgtggctcccagatgccaccggagacattgtgttgacacagtctccagccaccctgtcttgtctccagggaangccaccgtctcctgcagggccagtgacaagtgttaggattgtagctggtatcaacacaaacngtaggccaaggcctcccggtactccctcaactcctatgaatcgtcctaccaacgtagggtccacgtcggaccgtacccccgacgtacggttacaggtcggactaggtcggggtctaggggaactaggtaccttcgactcgtcgaccgtcagtcaacggcctacgagtccgtagtaagttagtttgacttaagtttaattacgtagtctacgtccgtaccgtagactaacgtcggtccctaacgtttccggtacccgtacgggtacctacggtaccgtcgggacctacgtacccgtaaccgtacgttcgtcggtcgtacgacccgtacctacgttccgtacgtttccttaccgttaccttccccgttccccgtccctacg

SEQ ID NO: 229360 - DNA, 519 bp, Homo sapiens
  misc_feature: GYAE6OF01D1JSQ.24.37.D04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (284)..(284): a, c, t, g, unknown or other
  misc_feature (284)..(284): n is a, c, g, or t
  modified_base (428)..(428): a, c, t, g, unknown or other
  misc_feature (428)..(428): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacatttgtgttgacacagtctccagccacctgtctttgtctccaggggaaangccaccctntcctgcagggccagtgacaatgttaggaagttgttagcctggtatcaacacaaacatggccaggctcccggntcctcatctatgatgcatccaatagggccactggcatcccaagacaggttcagtggcaggtggtctgggacagacttcactctacaccatcagcagtgtagacgcctagaagtatttgactagtttacttactgtcagcacgtnaacactcggaccctacgtttccggcccgtagggaccagactggacataccgaacgtactgtcggcctgaccactactcttgttcttctacg

SEQ ID NO: 229361 - DNA, 543 bp, Homo sapiens
  misc_feature: GYAE6OF01BC7WM.24.37.D04.1.454.CMB.1.raw
  modified_base (431)..(431): a, c, t, g, unknown or other
  misc_feature (431)..(431): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccagggaagagcctggagttggtgcgagtatccattatcatgggcgaacccccttctacattccgtccctcgagagtcgagtcacctatttcactggagccgtccaagaaccagtacctcctgaggctgcgtctgtcgacccccgcgacncggccgtatattctgtgcggcttaggtcagttgtgttggcgatgtctgcaccgtaccgcgcgactaattacgttacggtgggtcgtttggggacacgagggaccctaccggg

SEQ ID NO: 229362 - DNA, 617 bp, Homo sapiens
  misc_feature: GYAE6OF01DFZSN.24.37.D04.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (590)..(590): a, c, t, g, unknown or other
  misc_feature (590)..(590): n is a, c, g, or t
  modified_base (599)..(599): a, c, t, g, unknown or other
  misc_feature (599)..(599): n is a, c, g, or t
  modified_base (611)..(611): a, c, t, g, unknown or other
  misc_feature (611)..(611): n is a, c, g, or t
tcagactactatgtcacgaccggtgctcgatttagtagcatactggttgggtttgggggaggaactgctcagttaggacccagagggaaccatggaagccccagctcagcttctcttcctcctgctactctggctccagatgccacggagacattgtgttgacacagtctccagccacctgtcttgtctcgaggggaaangccacctcgtcctgcagggccaggtcgacaatgtagagttgtagcctggtatcaacacaacntggccaggcctcccggntcctcatcctatcgatcgcactccgaagtcgggccagtggaccactaccccgaagtacgtaggttccaaggttggacgtagggtcgggtactaggggaacctaggtacctttcgaccgttcgtacctaaccgtacttaccgagtaccgtagtacgtaacggacgtaccttaaggtaacgttagttttcgaacttagttttactacgtgtacagcctacgtagaacctacgtcggtcccgtacgtttccggccgtacgggtaccaggtactacggtactaacgtaccgtaaacgacgttggtcgacgttacnccgtaactnttctcttccgtntacccg

SEQ ID NO: 229363 - DNA, 530 bp, Homo sapiens
  misc_feature: GYAE6OF01BN56O.24.37.D04.1.454.CMB.1.raw
  modified_base (407)..(407): a, c, t, g, unknown or other
  misc_feature (407)..(407): n is a, c, g, or t
  modified_base (490)..(490): a, c, t, g, unknown or other
  misc_feature (490)..(490): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
tcagactactatgtcacgaccggtgctcgatttagtagcatactgttgggtttggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccagggaagagcctggagttggttgcgagtatccattatcatgggcgaacccccttctacattccgtccctcgagagtcgagtcaccatttcactgacgccgtccaagaccagtactccctgaggcngcggtctcgtcgccccgcggacacggccgtatacttactgtcgcggcttaggtcagttgtgttggcgatgtctgcactaccgngcgcaattagtacgnggtcgttgggcacngggccgtacgg

SEQ ID NO: 229364 - DNA, 573 bp, Homo sapiens
  misc_feature: GYAE6OF01B73AZ.24.37.D04.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagataccactggagaagtagtcatgacgcagtctccagccaccctgtctgtgtctccgaggggaaangccaccctctcctgcagggccagtgagatgtgcagcattgcctggtaccagcaagaaacctggccaggctcccgaggcctctcatctatgatgtctacaacngggtcacgtggcctccccgctaggttcagtggcaggtggtctgggacagtacttcactctcacgtcacgctagcctagacgccgtagtaagttacgtttggtacgtttactacgtgtcagtcgacgtccggttccgccgtcggtccgtaccgttaaccggttcggggacgggggtaccaggggtggaaggagggtacgacggtaacgtgggtcggctcggcctacgtagttccgtcggttacccttagtaccttcccgtcccgtaccg

SEQ ID NO: 229365 - DNA, 675 bp, Homo sapiens
  misc_feature: GYAE6OF01BO0AM.24.37.D04.1.454.CMB.1.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctccgaggggaaancgccaccctctcctgcagggccagtgacaatgttaggattgtagcctggtatcaacacaactgtcggaccaggtcctcccggntcctcgatctatcgatcgacattccgaagtacgggcctacgtggactacgtcccgaagactgggttcaggtcgctagggtcggtactacgggactaggtacctttcaacttccactaacccgtattccgacggtacgtacggttacggtaaggtaccgtacccgttaaggtaacgtttcgttttacggacgtttaacggttttaacgttaccgttcgtaccgtacggtaccgtaccgttagaaccttaaccggttccggtacccttacggtttccggacccgtagggacctacggtaccttacgggtaacctaccgtacccgtaaacgtaccgttcggtcgtaccgtacggaccctacgttacgttacgttcgttacccgttcgtaacccg

SEQ ID NO: 229366 - DNA, 635 bp, Homo sapiens
  misc_feature: GYAE6OF01DJR7V.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagtattattattgggcctggatccggcacgccccgagggaagacgcctggagttggtgcgagtactccattatcagtcgggaccgtaacccccttctacacttcccgtccgtcgagtacgtcgacgtccaacctactttcactggacgtccgtaccaaacgaaccctagtaccctcccgtaggacggtctcggccggtctcggtaccgacccccggcggaccgaccgggtacccgtacttacgtttaccgtgtcgggtcgggtcgtttaagggtcctagtttggtggtttgggcgtagtcgtctgaccacctaccggcggtacgactaagtttagttacggtgggtcgggttttggggaccacggacggggtaccctaccggg

SEQ ID NO: 229367 - DNA, 666 bp, Homo sapiens
  misc_feature: GYAE6OF01D1MRF.24.37.D04.1.454.CMB.1.raw
  modified_base (316)..(316): a, c, t, g, unknown or other
  misc_feature (316)..(316): n is a, c, g, or t
  modified_base (516)..(516): a, c, t, g, unknown or other
  misc_feature (516)..(516): n is a, c, g, or t
tcagactactatgtcacgaccggtgctcgatttagtagcatactgttgggtttgggggaggaactgctcagttaggacccagacggaaccatggaagccccagcgcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaaccaacagaaacctggccaggcctcccgaggcctcctcatctatgattgtctaccaacngggtcacgtcggccgtccccgctagggttcaggtggcaggtgggtctgggacagacttcactctcaccgtcagcagccttagacgcccttaggaacgttagtttttacggtcggttttaactacgtgtacgagtccgagtccgtttcccggccgttcgggcccgtacgttaacggtttccgggggacggggggtaaccgngggggttacgggaggtacggggaagtaaccggtaacgttgggtacgggacttcgggacctaacccgtacgttccgttcgtttaccgtttccgacctttccccgttcccccggaccttaacgttccgtaacggtaaaccgtgtttaaacgg

SEQ ID NO: 229368 - DNA, 540 bp, Homo sapiens
  misc_feature: GYAE6OF01BRO6V.24.37.D04.1.454.CMB.1.raw
  modified_base (432)..(432): a, c, t, g, unknown or other
  misc_feature (432)..(432): n is a, c, g, or t
  modified_base (501)..(501): a, c, t, g, unknown or other
  misc_feature (501)..(501): n is a, c, g, or t
  modified_base (530)..(530): a, c, t, g, unknown or other
  misc_feature (530)..(530): n is a, c, g, or t
tcagactactatgtcacgaccggtgctcgatttagtagcatactgttgggtttggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcacgccccagggaagagcctggagttggttgcgagtatccattatcatgggccgaacccccttctacacttcccgtcctcgagtagtcgagtcacctatttcacgtggacgccgtaccaagaaccagtactccctgagctgcgtctgtcgaccccgngacacggccgtatacgttactgtgcggtcttaggctagttgtgtgcgtatcgtctgctacgtccgcgtnctattcgttacggtggtcgttgggcacgnggccgtacgg

SEQ ID NO: 229369 - DNA, 546 bp, Homo sapiens
  misc_feature: GYAE6OF01EAXPN.24.37.D04.1.454.CMB.1.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (374)..(374): a, c, t, g, unknown or other
  misc_feature (374)..(374): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacntggccaggcctcccggntcctcatctatgatgcatccaagtacgggcccagtggcatccccagacaggttcaggtggcaggtgggtctgggacagacttcacttcncaccatcagcagtgtagacgcctagaagtattttgacttagttttattacgttgtacagtcctaccgtgaactaacgtcggacccctacgtttccggccctggggacccaggacctaggactactacccgaacgtactggtcggctcgacctaccattcctcgttcttctac

SEQ ID NO: 229370 - DNA, 534 bp, Homo sapiens
  misc_feature: GYAE6OF01CVIFA.24.37.D04.1.454.CMB.1.raw
  modified_base (204)..(204): a, c, t, g, unknown or other
  misc_feature (204)..(204): n is a, c, g, or t
  modified_base (440)..(440): a, c, t, g, unknown or other
  misc_feature (440)..(440): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaangccaccctctcctgcagggccagtgacaatgtaggaagttgttagcctggtatcaacaacaaacatggccaggcctcccggctcctcatctatgatgcataccaagtacgggccacgtggccactcccagactaggttcaggtgctaggtgggtctgggacagtacttcactctcaccatcagcagtgtagcgctagaagttatttgacttagttttacttactgtcagcacgtanacaacgtcgtccctacgttccggccctaggaccagctggacctagtaccgaacgtatggtcggctagacctacctactcgtcgttcttcgtacc

SEQ ID NO: 229371 - DNA, 534 bp, Homo sapiens
  misc_feature: GYAE6OF01DAIAD.24.37.D04.1.454.CMB.1.raw
  modified_base (205)..(205): a, c, t, g, unknown or other
  misc_feature (205)..(205): n is a, c, g, or t
  modified_base (484)..(484): a, c, t, g, unknown or other
  misc_feature (484)..(484): n is a, c, g, or t
  modified_base (524)..(524): a, c, t, g, unknown or other
  misc_feature (524)..(524): n is a, c, g, or t
tcagactactatgtcacgaccggtgctcgatttagtagcatactgttgggtttgggggaggaactgctcagttaggacccagagggaaccatggaagccccagcgcagcttctcttcctcctgctactctggctcccagataccactggagaagtagtcatgacgcagtctccagccaccctgtctgtgtctccgaggggaaagngccaccctctcctgcagggccagtgagaatgttggcagcaacttgctggtaccagcagaaacctggccaggctcccaggctcctcatctatggtgcgtccaccgaggccacgtggcgtcgcggacaggtcagtggcgtaggtcggtcgtttgggacagtacttcgtactctcatcagtcgacagacgtggacgcccgtaagtatttgctagtagttattacgtgtcagtcttgtttcggtcctctccttctatcgttactcgtttcgccgtggttaccnggtctggagtatacgaacgacgtaacgtgtcggtctgacnccgtgttccg

SEQ ID NO: 229372 - DNA, 615 bp, Homo sapiens
  misc_feature: GYAE6OF01AUFNU.24.37.D04.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (401)..(401): a, c, t, g, unknown or other
  misc_feature (401)..(401): n is a, c, g, or t
  modified_base (463)..(463): a, c, t, g, unknown or other
  misc_feature (463)..(463): n is a, c, g, or t
tcagactactatgtcacgaccggtgctcgatttagtagcatactgttgggtttgggggaggaactgctcagttaggacccagacggaaccatggaagccccagcgcagcttctcttcctctgctactctggctcccagactaccactggagaagtagtcatgacgcagtctccagccacctgtctgtgtctcagggaangccacctntcctgcaggccagtgagatgtggcagcaacttgcctggtaccagtcaagaaccgtggaccaggcctccgaggcctcctcactctaagtcgatcgtcctaccgaagacgggtcacgtcggaccgtccccgcgtaggttcgaggtcggactagggtcgggtcgtcgggactaggtacttcacgttctacgaccgtnacgctacgctagcgtcctagaagttctttagacttagtttattacgtgtacacgtctacgtnaacgtacgtcgtaccctacgtttccgggacccgttacggaaccctaggtaccgtacggacctaccgtacccgtaaacggtaccttgggtacggtacctaccggtacctaacccgttacgttaccgttagttccctttcgtaccgtttccccg

SEQ ID NO: 229373 - DNA, 531 bp, Homo sapiens
  misc_feature: GYAE6OF01EBYZM.24.37.D04.1.454.CMB.1.raw
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
  modified_base (527)..(527): a, c, t, g, unknown or other
  misc_feature (527)..(527): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagacgccaccctctcctgcagggccagtgacaatgttaggaagttgtagcctggtatcaacacaaacatggccaggcctcccggctcctcatctatgatgcatccaatacgggccactggacatcccagacaggttcagtggcagtggtctgggacagacttcgactcncacatcagcagtgagagcctagaagtnttttgctagtttattacttgtcacgcaccgtgaactaacgtcggaccctacgtttccggaccctcgggaccagtactcggacatcccgaaacgtacgtggtcggcctgaccacctattcctcgttccttntacc

SEQ ID NO: 229374 - DNA, 573 bp, Homo sapiens
  misc_feature: GYAE6OF01C6C08.24.37.D04.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (358)..(358): a, c, t, g, unknown or other
  misc_feature (358)..(358): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgttgttgacacagtctccagccacctgtctttgtctccgaggggaaangcccaccctcgtcctgcagggccaggtcgacaatgttaggagttgtagctgtacncaacacaaacntggccaggtcctcccggtctcctcatctatgatgcatccgaagtcgggacacgtgaccatcccagactaggttcagtcgcaggtggtcngggactagtactcactctacaccatcagcaggtagtagacgctagtaagtgtttgacttagtttactacgtgtacacgtccacgttacgaaccgtaacgtccggtacccttacgtttcccggcccgttacgggacctacgtacgtacgactacgtacccgaacggtaacgttggtcgtcgtacaccctacgtacttgttccgtctttccgtaccc

SEQ ID NO: 229375 - DNA, 655 bp, Homo sapiens
  misc_feature: GYAE6OF01CV44U.24.37.D04.1.454.CMB.1.raw
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
tcagactactatgtcacgaccggtgctcgatttagtagcatactgttgggtttggtggaggaactgctcagttaggacccagagggaaccatggaagccccagctcagcttctcttcctcctgctactctggctcccagataccaccggagacattgtgttgacacagtctccagcccaccctgtctttgtcctccgaggggaaancgcccaccctctcctgcagggccagtgacaatgtaggattgtagctgtatcaacacaaacntggccaggcctcccggctcctcatctatgatgcatccaagtcggccacgtggacactcccagacaggttcaggtggactagggtggtcgtagggactaggtacctttcaccgttctaccaacctagtacacgacgtaggtcgtaacgacgtaccgtagtaagttacgttttgacctttaagttttaacttacgttgtaccgaacgtccgtaaccggtacgtaacccgtaacgttccgggtaccccttaccggtttcccgggacccgttacgggacccgacggtaccgttacgggaaccctaacgtaccccgtaaacggtaaccgttggtcggtaccgtacggaccctaacccgttacgttacccgttcgttcccttaccgttaccccg

SEQ ID NO: 229376 - DNA, 542 bp, Homo sapiens
  misc_feature: GYAE6OF01EHYDA.24.37.D04.1.454.CMB.1.raw
  modified_base (203)..(203): a, c, t, g, unknown or other
  misc_feature (203)..(203): n is a, c, g, or t
  modified_base (441)..(441): a, c, t, g, unknown or other
  misc_feature (441)..(441): n is a, c, g, or t
  modified_base (528)..(528): a, c, t, g, unknown or other
  misc_feature (528)..(528): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctgtgtctccgaggggaanacgccaccctctcctgcagggccagtgagatgttggcagcaacttgcctggtaccagcagaaacctggccaggctcccaggctcctcctctatgctgtctccaccagggcccctggtcgtccccagtccgagggttcgttgggcggtggggtctggggacagtactttcactctcaccatcagccgcctccagtctgaatattttgctacttttatttctgttacaactactatggtntacgtggcctccgtactacgtttcggccgtacgggaccaacgtggagatcgaaacgtacgtgtcggctgcactatcgtcgtcttacncttccttcccgtcc

SEQ ID NO: 229377 - DNA, 524 bp, Homo sapiens
  misc_feature: GYAE6OF01BBLZC.24.37.D04.1.454.CMB.1.raw
  modified_base (204)..(204): a, c, t, g, unknown or other
  misc_feature (204)..(204): n is a, c, g, or t
  modified_base (426)..(426): a, c, t, g, unknown or other
  misc_feature (426)..(426): n is a, c, g, or t
tcagactactatgtcacgaccggtgctcgatttagtagcatactgttgggtttgggggaggtactgctcagttaggacccagagggaaccatggaagccccagctcagcttctcttcctcctgctactctggctcccagatgccaccggagacattgtgttgacacagtctccagccaccctgtctttgtctccgaggggaaangccaccctctcctgcagggccagtgacaatgttaggattgtagcctggtatcaacacaaacatggccaggcctcccggctcctcatctatgatgcatccaatgggccatggcatcccagacaggttcagtgcaggtgggtctgggacagtacttcactctaccaccatcagcagtgtagacgtctagaagtattttgacttagtttatactgtcagcacgtnactaacgtcgaccctacgttccggccgtgggaccagacgtcggacctacgtaccgaacgtacgtggtcggctcgacctacacttctcgtcttcgtacc

SEQ ID NO: 229378 - DNA, 667 bp, Homo sapiens
  misc_feature: GYAE6OF01B4E58.24.37.D04.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaancgccaccctctcctgcagggccagtgacaatgttaaggagttgttagcctggtatcaaacacaaacatggccaggcctccccggntcctcatctatgatgcataccaagtacgggccagtggccactcccaagaccaggttcaggtggactagggtcgggtctaggggacaggtacttcactctcaccatcagcacgacctagacgccgtagtaagttagttttcggtaccggttttaactacgttcgtacgacgtcgtacggttccgttcccgccgtaccgggtacccgtacggtttaacccgggtttccggggggacccgggggggtaaccgtaggggggtaacgggaacgggtaacggggaccgggtaaacggtaccggttgggtacgggaccggttcggacccgtaacccgtacgttccgttacggttacctttccgtaacctttccccggttaccccg

SEQ ID NO: 229379 - DNA, 519 bp, Homo sapiens
  misc_feature: GYAE6OF01A3H9B.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacatgttaggaagttgtagcctggtatcaacacaaacatggccaggcctcccggctcctcatctatgatgcatccaatcgggccactggtgtcccagccaggttcagtggcaggtgggtctgggacagagttcactctcaccatcagcagtctgcagtctagaagtatttgctagtttattactgcctagcagcacgagtgacgtggccgtctcgtacgttcggcggacggaccgagggtacgtacgatacgaaacgtacgtggtacggctacggaccacctagtcgtacg

SEQ ID NO: 229380 - DNA, 590 bp, Homo sapiens
  misc_feature: GYAE6OF01CG4RH.24.37.D04.1.454.CMB.1.raw
  modified_base (528)..(528): a, c, t, g, unknown or other
  misc_feature (528)..(528): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagtattattattgggcctggatccggcacgccccagggaagagcctggagttggttgcgagtatccaattatcagtcgggccgaacccccttctacacttccgtccctacgagagtcgagtcacctattcactggacgccgtacaagaaccacgtacctccctgacggctcgcggtctggtccgaccccgcggacacggcctatacttactggtacgcggtcttaggtctagttcgttggttcggacgattcggtctggcctaccgtccggccgtanacgttaacgttacgttacgggtgggttccggtttcgggactacggagggtacccgtaccggg

SEQ ID NO: 229381 - DNA, 567 bp, Homo sapiens
  misc_feature: GYAE6OF01DC60T.24.37.D04.1.454.CMB.1.raw
  modified_base (206)..(206): a, c, t, g, unknown or other
  misc_feature (206)..(206): n is a, c, g, or t
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattggtgttgacacagtctccagcccaccctgtctttgtctccgaggggaaanagcccaccctctcctgcagggccagtgacaatgttaggaagtttgtancctggtatacaacacaaacntggccaggcctcccggctcctcatctatgatgcatccaagtacgggccacgtggccaactcccaagactaggtcagtggctaggtgggtctagggacagtacttcactctacaccatcgagcagtagtagagccgttagaagtattttgactagttttaactacgtgtcagctacgtacacaacgtcggaccctacgttcggcctaggaccagactacggactacgtaccgaaacgaacgttcggcgtaccgtacggacctaacccgtattcccttcgttcccttccgtaccg

SEQ ID NO: 229382 - DNA, 558 bp, Homo sapiens
  misc_feature: GYAE6OF01DB8WO.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagataccactggagaagtagtcatgacgcagtctccagccaccctgtctgtgtctccgaggggaaaangcccaccctctcctgcaggggccagtgagaatgttggcagcaacttgcctggtaccagcaagaaacctggaccaggctccaggcctcctcctctatgcttgtcctcccaccgacgggcccctggtctcccagccaggttcgtggcggtgggtctgggactagtatttcactctcaccatcagcgcctcagtctagagtatttgtctactttatttcttcgtctaactactagtggtgtacgtcggtcctccgttactacgttttcggccgtacgggacctaaacgtggacgaatacgaaacgtaactaggtcgacgtgcaccgtatcgtctacttctactccgttcccgtacc

SEQ ID NO: 229383 - DNA, 721 bp, Homo sapiens
  misc_feature: GYAE6OF01C10HD.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagtattattattgggcctggactccggcacgcccccgagggaagagcctggtaggttggttgcgagtactccatttatcagtcgggaccgaacccgtcccttactactaccgttcccgtcccgtacgagtacgtacgtactaccctacttacttacgtacggtacggaccggtacccgtaaccgaaccgtaaccgtaccgttacccttacccggtagggaccgtcgtacggtccgggttccgttaccggtacccccggacccccgggaccggaccccggtacccggtaccgttaacgtttacgttaccgtggtacgggtccggttacggttacgtacgttaggtttcggttaggtacggcgtagttcgttcgtccgtaccgtacccggtaccgccggacggttactaacgtttaggttaccgggtcgggtttacggggttacggaccggacgggtccggtaaaccccggg

SEQ ID NO: 229384 - DNA, 656 bp, Homo sapiens
  misc_feature: GYAE6OF01CO246.24.37.D04.1.454.CMB.1.raw
  modified_base (236)..(236): a, c, t, g, unknown or other
  misc_feature (236)..(236): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtnactccttcagtaacacagtattaattattgggcctggatccggcatccccagggaagagcctggagttggttgcgagtatccattatcagtgggccgaacccccttctacacttcccgtccctcgagacgtcgagtcacctatttcaaccgtggacgtccgtaccaaacgaacccagttacctccctaggacggtctcggcggttctcgtccggaccccccgcggaaccgaccggacccttataacgttactggttacggcgggtctttacggtctagtttcgttggttcggtacggtattcgtacgttggaccgtacctacccggtcggtcgaccttaaacgtttaaggtttacgggttacgggggtcgggtttttacggggggacctaaccgggaagggggtacccgtaaacccgggg

SEQ ID NO: 229385 - DNA, 505 bp, Homo sapiens
  misc_feature: GYAE6OF01AN4OE.24.37.D04.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccaggggaaanagccaccctctcctgcagggccagtgacaatgttaggaattgttagcctggtatcaacacaaacatggccaggctccccggntcctcatctatgatgcatccaataggccactggcatcccagacaggttcagtggcaggtggtctgggacagacttcactctcaccatcagcagtgtagacgcctgaagtattttgctagtttattactgtcagcacgtgacaactcggccctactttccggccttacgggaccagacgtgacatcccgaacgactgtcggctgcctacatctntcttntac

SEQ ID NO: 229386 - DNA, 533 bp, Homo sapiens
  misc_feature: GYAE6OF01BOWKD.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttagaacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacatggccaggcctcccggctcctcatctatgatgcatccaatacgggccacgtggcatcccagacaggttcagtggcaggtgggtctgggacagacttcactctcaccatcagcagtgtagagcctagaagtattttgactagtttattactgtcagtctaccgtgaacaacgtcggtaccctacgtttccggcccgtcgggaccaggtactcggacacgtaccgaacgtactggtcggctgaccacctatcctcgttcttcgtacc

SEQ ID NO: 229387 - DNA, 594 bp, Homo sapiens
  misc_feature: GYAE6OF01ATGW9.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaagngccaccctctcctgcagggccagtgacaatgttaggagttgtagcctggtatcaacacaaacatggccaggcctcccggctcctcatctatgatgcatccaagtacgggccacgtggaccactccccagacaggttcaggtggcgaggtgggtctgggacaggtacttcactctcaccatcagcagtgtagacgactagtaagtattttggacttaagttttatacgttgtcacgcctaccgtgaaccgtaacgtcggtaccctaccgtttccggcccgttacgggaccctacggaccgttacgggaacctaacgtacccgaaacggtaaccgtcggttcggaccgtcggaccctaacctacgttacccttcgttccctttcgtacccg

SEQ ID NO: 229388 - DNA, 622 bp, Homo sapiens
  misc_feature: GYAE6OF01C94AR.24.37.D04.1.454.CMB.1.raw
  modified_base (204)..(204): a, c, t, g, unknown or other
  misc_feature (204)..(204): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanagccaccctctcctgcagggccagtgacatgtaggagttgtagctggtatcaacacaaacatggccaggcctcccggctcctcatctatgatgcataccgaatacgggccacgtgcactccaagactaggtcaggtggcgtaggtcgggtcgtacgggacacggtacttcactccaccacctagtacagctaggttagtacgacgtccgtaggtaacgtagttttgacgttaagttttacttacgtgttaccgacgtaccgtaccgtacgaaaccgtaaccgttccggaccccgtttacggtttccccgggtacccgttacggggacccgtaacgtaccgtacggaacctacgtacccgaaaccgtacgtggttcggaccgtcgaccctacctacgttcgtcgttccgttccttaccg

SEQ ID NO: 229389 - DNA, 751 bp, Homo sapiens
  misc_feature: GYAE6OF01C9GC5.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctgtgactccttcagtaacacagtattattattggcctggatccggcacgaccccgaggaagagccgtggagttggttgcgagtactccattactcgagtcgggacccgtaaacccccttctaacctacgttcccgtccctcgagtacgtcgacgtcactacttcacgtggacgccgtacaaacgaaccacgtaacctcccgtaggacggacttcgggacccggttcgttacggtacccgtaccccccggccgggtaacccgaccggggtacccgttaagtttaactttaacgtcgggttacgggtccggggtaccgttttagggtaccttaaggtttcgggttacggtttcgggtaccggttagttacggttccttacgggaccctaaccgttaaccccggccggacccggttaacgttaaaacgttttaacgggtttaaccggggtttggggggttacccgggtttttacgggggaccccgtaaaccggggtaaccgggtacccccggttaaacccgggg

SEQ ID NO: 229390 - DNA, 591 bp, Homo sapiens
  misc_feature: GYAE6OF01EDXCR.24.37.D04.1.454.CMB.1.raw
  modified_base (236)..(236): a, c, t, g, unknown or other
  misc_feature (236)..(236): n is a, c, g, or t
  modified_base (322)..(322): a, c, t, g, unknown or other
  misc_feature (322)..(322): n is a, c, g, or t
  modified_base (440)..(440): a, c, t, g, unknown or other
  misc_feature (440)..(440): n is a, c, g, or t
  modified_base (576)..(576): a, c, t, g, unknown or other
  misc_feature (576)..(576): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtnactccttcagtaacacagattattattgggcctggatccggcacgccccgagggaagagcctggagttggtgcgagtatccattancatgggccgaaccccttctactacttcccgtcctcgagagtcgacgtcacctatttcactggacgccgtaccaaacgaaccagtacctccctggacgctgcggtctcgtacgccccgnggaccacggccgtatacttacgtgtcggcgggtcttacgggtcgtagttggtacggttggacgtagtcgtctcgactaaccgtccgcgtacggactaagttacgttacggtcggggttcgtttacggggcaacggngggtacccgtacggg

SEQ ID NO: 229391 - DNA, 538 bp, Homo sapiens
  misc_feature: GYAE6OF01D5LJ2.24.37.D04.1.454.CMB.1.raw
  modified_base (202)..(202): a, c, t, g, unknown or other
  misc_feature (202)..(202): n is a, c, g, or t
  modified_base (339)..(339): a, c, t, g, unknown or other
  misc_feature (339)..(339): n is a, c, g, or t
tcagactactatgtcacgaccggtgctcgatttagtagcatactgttgggtttgggggaggaactgctcagttaggacccagagggaaccatggaaaccccagcgcagcttctcttcctcctgctactctggctcccagccatcaccggaggaattgtgttgacgcagtctccaggcaccctgtctttgtctccgagggganagagcccaccctctcctgcagggccagtcagagtgttagcagcagctacttagcctaggtaccagcagaaacctggcctggctccaggctcctcatctagtggtgcgtccaccgagggccacgtggcgtcgcggacnggttcagtggcaggtcgctttgggacagaccttcactctcatcatcgacagactggacgacccgtaagtatttgcgtagttgttattactgtactagtcttgtttcgtcccttctccttcttattcgttactcgtttcggccgtaggttcctaggtcgtggtacgtagtcgtagcgtactcggtcggctgctcgtgtcg

SEQ ID NO: 229392 - DNA, 595 bp, Homo sapiens
  misc_feature: GYAE6OF01DN98V.24.37.D04.1.454.CMB.1.raw
  modified_base (202)..(202): a, c, t, g, unknown or other
  misc_feature (202)..(202): n is a, c, g, or t
  modified_base (423)..(423): a, c, t, g, unknown or other
  misc_feature (423)..(423): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaanagccaccctctcctgcagggccagtgacaatgttaggaagttgttagcctggtactacaaacacaaacagtggaccaggcctcccggctcctcatctatgatgcatccaagtcgggccactggacactccccagactaggttcaggtggcaggtcgggtctgggactagtaccttcaccttctacacctatcgagccagttgtagacgtcgtagtaagttnttttgacttaagttttaacttacgtcgtacgacgtacctaccggttgaaccgtacgtccggtaccctaccggtttccggcccgtagggacccaggtacctacggacctactacccgtaaacgtacgtggtccggcgtacgacccgtacctagttccttgttccttctacccg

SEQ ID NO: 229393 - DNA, 580 bp, Homo sapiens
  misc_feature: GYAE6OF01BX3N4.24.37.D04.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanacgccacctctcctgcaggccagtgacaatgtaggagttgtagctgtatcaacacaaacntggccaggcctcccggntcctcatctatgatgcatccaagtacggccacgtgcactcccagactaggttcagtggcaggtgggtctacgggactaggtaccttcactctcaacctagtcagcagtgtacgagcctagtaacgtattttacgacgttaagtttattacgtgtacgtacgtcctaaccggtgtaaccgtaacgtcggtaccccttaccgtttccggaccccgtagggacctacgacgtacggacctaacgtacccgaacgtaacgttggtccggcgtacgcgtacctacgtcttcgttcttcctaccg

SEQ ID NO: 229394 - DNA, 723 bp, Homo sapiens
  misc_feature: GYAE6OF01DX6NK.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccttgtctttgtctccgaggggaaanacgcccaccctctcctgcgacggggccagtgaactaagtggttaggaagtttgttacgcctggtaactcaaacaacaaacatcggccacggccctcccggtctcctcactctatcgatcgacactccgaagtcggcctacgtcgacacgtcccgagacgtacggttcaggtcggacgtaggtcgggtacgtacgggaactaggtacctttcgaaccttctacccgaacctacgtacgaacggccgtaagggttacgtaacgtacggttacccgttaagggtaacgtttacgttttacggtacgtttaaagtttttaacgttacgttggttaccgtaacggtaccgtaccgttacgaaccgttaaccgttccggtacccctttaccggttcccgggtacccgtacggggtacctacggtacgtacggtacctaccgttaacccggtaaaccgtacggttacggtcggtaccgttacggaaccctacgtacgtttccgttcgtttcccgtcgttaccccg

SEQ ID NO: 229395 - DNA, 652 bp, Homo sapiens
  misc_feature: GYAE6OF01B6EBH.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttagaagttgtagctggtatcaacacaaacatggccaggcctcccggctcctcatctatgatcgcatcccaaagtacgggccacgtcggcctacgtccccagaaccgtagggttccaggtcggctagggtggggtctggggacaaggtaccttcaaccttcctaccaccatcgacgacacgaccgtagacgtcccgtagtaagtagttttacggcggttttactacgtgtacgacgtcgtacggtccgttccggccgtcgggtcccgtacgtttaaccggtttccgggggacggggggtaccgtagggggtacggaacgggacgggacggtaaccggtaacgttcgggtagggccgttcggacccgtacccgtacgttccgttacgttaccgtttccgtaccgtttcccgttaccccg

SEQ ID NO: 229396 - DNA, 538 bp, Homo sapiens
  misc_feature: GYAE6OF01A22C6.24.37.D04.1.454.CMB.1.raw
  modified_base (206)..(206): a, c, t, g, unknown or other
  misc_feature (206)..(206): n is a, c, g, or t
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagactactatgtcacgaccggtgctcgatttagtagcatactgttgggtttgggggaggaactgctcagttaggacccagagggaaccatggaacgccccagctcagcttctcttcctcctgctactctggcctcccagatgccaccggagacattgtgttgacacagtctccagccacccttgtctttgtctccgaggggaanacgccaccctctcctgcagggccagtgacaatggttaggaagttgtagcctggtatcaacacaaacagtggaccaggcctcccggctcctcatctatgatgcatccaagtacgggccactggcactcccagactaggttcagtggctaggtcgggtctgggacngtacttcacttctacacatcagcagtgagacgctagtaagtntttgacttagtttattacgtgtacagctacgtgaacacgtcgccctacgttccggcccgtggaccgagacgtacgactacgtaccgaacgtactggtcgcgtcgctaccacttctcttctctaccg

SEQ ID NO: 229397 - DNA, 541 bp, Homo sapiens
  misc_feature: GYAE6OF01DRYL4.24.37.D04.1.454.CMB.1.raw
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
tcagactactatgtcacgaccggtgctcgatttagtagcatactgttgggtttggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccagggaagagcctggagttggttgcgagtatccattatcatgggccgaacccccttctacattccgtctctcgagagtcgagtcaccatttcactggagccgtcaagaaccagtacctccngagctgcggtctgcgaccccgcggacncggccgtatacttactgtgcggnttaggtctattgttgttgcgatgtctggcacgtccgngccgctaacttagtacggttgggcggttttggggacctggcgggtaacccgg

SEQ ID NO: 229398 - DNA, 580 bp, Homo sapiens
  misc_feature: GYAE6OF01DSKGF.24.37.D04.1.454.CMB.1.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccacctgtctttgtctccgaggggaaanagccaccctctcctgcagggccagtgacaatgttaggaagttgtagctggtatcaacacaaacntggccaggcctcccggctcctcatctatgatgcatccaagtacgggccacgtggacactcccagactaggttcaggtcggacaggtgggtctgggactagtacttcactctacacctatcagctagtgtagacgtctagaacgtatttgacttagtttatacgttgtacacgtacctaccgtgaacctaccgtcggacccttacgtttcccggcccgtacgggaccaacggtaccgtgaaccgtactacccgaaaccggtagttcggtcggtacctacggaccctaccgtattcttcgttctccgttacccg

SEQ ID NO: 229399 - DNA, 654 bp, Homo sapiens
  misc_feature: GYAE6OF01AM7WI.24.37.D04.1.454.CMB.1.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanacgccaccctctcctgcacgggccagtgacaatgtaggagttgtagcctgtatcaacacaaacntcggccaggcctcccggnttccncatctagtgatgcactccgaagtcggccacgtggccacgtacccaagacgtaggttcaggtcggcgtagggtcggttcgtggggaactacggtaccttccacttccgtacaacctagtccacgcgtaggtggtaacgcgtacccgtaggtaacgtttattttcggaccgttaagttttacttacgtacgttacgacgtacgaccgtacgaacgtaaccgtccggtacccgttaccggttcccggacccggttacggacccgtaggacccggtagtaaccctaaccgtacccgaaaccgttaggtacgggtccggtccctacggtaccctaacctcgttaccttccgtttccgttccttacccg

SEQ ID NO: 229400 - DNA, 227 bp, Homo sapiens
  misc_feature: GYAE6OF01AKPPK.24.37.D04.1.454.CMB.1.raw
  modified_base (222)..(227): a, c, t, g, unknown or other
  misc_feature (222)..(227): n is a, c, g, or t
tcagactactatgtcacgaccggtgctcgatttagtagcatactgttgggtttggggcacagggaccacggtcaccgtctcctcagcctccaccaagggcccactcggtcttccccctggcaccctcctccaagagcacctctggggcacagcggccctgggctgcctggtcaaggactacttcccacatagtagtctgagcgggctggcaaggcgcatagnnnnnn

SEQ ID NO: 229401 - DNA, 509 bp, Homo sapiens
  misc_feature: GYAE6OF01A3LES.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggcctcccggctcctcatctatgatgcatccaatagggccactggcatcccagacaggttcagtggcaggtgggtctgggacagacttcactctcaccatcagcagtgtagagcctagaagtattttgctagtttattactgtcagcaccgtgacaactcggccctactttccggccctgggaccagactggacactaccgaacgtactgtggactgcaccatctgtcttctac

SEQ ID NO: 229402 - DNA, 552 bp, Homo sapiens
  misc_feature: GYAE6OF01ETME6.24.37.D04.1.454.CMB.1.raw
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgtaggagttgtagctggatcaacacaaacatggccaggcctcccggntcctcatctatgatgcatccaatacgggccacgtgcactcccagacaggttcagtggcaggtgggctgggacaggtacttcgactctcaccagtcagcagtgtagagctagaagtatttgtacgtttactactgtcagtcgacgtcgtccgccgtcggccgtacgtacggtttccgggacgggggtaccgtaggggtcggagggacggacggaacggtaacggtcggtggcgtgccgaccgtacgtcttgtacttccgtgtcccgttcccg

SEQ ID NO: 229403 - DNA, 590 bp, Homo sapiens
  misc_feature: GYAE6OF01C3QUU.24.37.D04.1.454.CMB.1.raw
  modified_base (205)..(205): a, c, t, g, unknown or other
  misc_feature (205)..(205): n is a, c, g, or t
  modified_base (443)..(443): a, c, t, g, unknown or other
  misc_feature (443)..(443): n is a, c, g, or t
  modified_base (480)..(480): a, c, t, g, unknown or other
  misc_feature (480)..(480): n is a, c, g, or t
tcagactactatgtcacgaccggtgctcgatttagtagcatactgttgggtttgggggaggaactgctcagttaggacccagagggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtataagaagcaactacttagcctaggtactacaaacagaaaacctggaccaggcctccaggctcctcatctagtggtatactccagcgacgggccacgtggtcgtacccagcccaggtttcaaggtcggctaggtcggggtcgtaggggactaggtacgtttcaactctacacctatcgacgctagtcgtgacctagtctaggaagttnttttcgcttagtttacttacgtgaccagcgagacacngtcgacgtcggaccgtctcgtaacggttcgggacgggtacgggaaccgtaagggtggaaggtaacgtaccgaaaacggtacgtacgggtcggacttacggcctacgtacg

SEQ ID NO: 229404 - DNA, 541 bp, Homo sapiens
  misc_feature: GYAE6OF01ATSWR.24.37.D04.1.454.CMB.1.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (350)..(350): a, c, t, g, unknown or other
  misc_feature (350)..(350): n is a, c, g, or t
  modified_base (434)..(434): a, c, t, g, unknown or other
  misc_feature (434)..(434): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctcgagggaaangccacctctcctgcagggccagtgacatgtaggagttgtagctgtatcaacacaacntgccaggcctcccggntcctnatctatgatgcatccgaagtacggccacgtggccactcccaagtacgtaggttcaggtggctaggtcggtnagggacagtcttcactctaccgacatcagcagtgtagacgctagaagttagtttgacttagtttatacgttgtacagtcacgtnaactacgtcgtacctacgttcgccgtaggaccagtaccgtagacctacgtaccgaaacgtactcggtcgacgtcgaccgtactacttacgttacgttcttctacccg

SEQ ID NO: 229405 - DNA, 530 bp, Homo sapiens
  misc_feature: GYAE6OF01BXC8U.24.37.D04.1.454.CMB.1.raw
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagngccaccctctccctgcagggccagtgacaatgttaggagttgttagcctggtatcaacacaaaacntggccaggcctcccggctcctcatctatgatgcatccaatagggccatggcatcccagacaggttcagtggcagtgggtctgggacagacttcactctcaccatcagcagtgtagagcctagaagtattttgcttagtttattactgtcagtcaccgtgaccaactcggaccctaccgtttccggcccgttagggacccagacgtggacacgtaccgaacgtactggtcggctcgaccacctatccttcgtcttctaccg

SEQ ID NO: 229406 - DNA, 609 bp, Homo sapiens
  misc_feature: GYAE6OF01A2790.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagccggagtgttagtaagtacttaggctggtaccaacagaaacctggccaggctcccaggctcctcatctatgatgtctccaacagggtcacgtcggccgtccccgcaggttcagtcggcaggtgggtctgggacagtacttcactctcaccgtcagcacgcctagacgcctgagtattttcgcggttttactacgtgtcagctagtccgttccgcccgtgggcccgtcgttaaccggtttcgggaccggggggtaccgtaggggtacgggaggaacgggaacgaaccggtaacgtcggtgggtcctcggaccgaccgtacgttccgttggttcccttcctacttcccgtttaccccgaccttacttccgtacgtaaacgtaacg

SEQ ID NO: 229407 - DNA, 516 bp, Homo sapiens
  misc_feature: GYAE6OF01BVFAW.24.37.D04.1.454.CMB.1.raw
  modified_base (203)..(203): a, c, t, g, unknown or other
  misc_feature (203)..(203): n is a, c, g, or t
  modified_base (330)..(330): a, c, t, g, unknown or other
  misc_feature (330)..(330): n is a, c, g, or t
  modified_base (398)..(398): a, c, t, g, unknown or other
  misc_feature (398)..(398): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggagttgttagcctggtatcaacacaaacatggccaggcctcccggctcctcatctatgatgcactcaagtgggccactggcactcccagacnggttcagtggcaggtggtctgggactagtacttcactctacaccatcagcagtgtagagctagaagtntttagctagttttatatgctagtcacgtgacacgtcgacctcgtttccggccctcggaccagcgtacgaccacgtacccgaacgactggtcgctgcctaacntccttntcctctaccg

SEQ ID NO: 229408 - DNA, 777 bp, Homo sapiens
  misc_feature: GYAE6OF01D44PU.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctggcggagaccctgtccctcatttgctctgtctctggtgactccttcagtaacacagtattattattgggcctggactccggcacgccccgaggggaagacgccgtggagtttggttgcgagtatccattatcagtcgggaccgaaccccctttctaactacttcccgtccctcgagtacgtcgacgtccaacctatttcaacgtggacgcccgtaccaaacgaaccctacgttacctcccgtaggacgggtccttggaccggttccgtcggtacccgggacccccccggccgggaaccgtacccgggtacccgtttaacttaacgtttaaccggttcggttcgggaccgggggttaccgttttaaggggttccttaagggttttcgggtttacgggttttcggggacggttacgtttcggttccgttcggtaccctaacccggttaaccccgggtcccgggtacccggtaccttaaaacgtttttacggttaaaccggggtttcggggggttaccggggtttttacggggggacccctaaaccggggtaaccggggggaacccccgttaacccggggg

SEQ ID NO: 229409 - DNA, 657 bp, Homo sapiens
  misc_feature: GYAE6OF01AGNPC.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcacgccccagggaagacgccgtggaggttggttcgcgagtatccgatttatcagtcgggcctaacccccgttctactacttcccgtccctcgagacgtcgacgtcacctatttcacgtcggacgcccgtaccaaacgaacccagttaacctccccgtaggaggtcctacggccggttacgtggtcccgacccccggcgggaccgaccggccgttaatacgttacgtgtcggtcgggtctttagggtctacgtttggtcggttcggcgtagttcggtcctcgccgtaccgtacccggccgtaccggtactaactttacgtttaacgggttcgggggtcggttttacgggggacgaccggtaacgggcccgttaaccccgggg

SEQ ID NO: 229410 - DNA, 650 bp, Homo sapiens
  misc_feature: GYAE6OF01AUIMP.24.37.D04.1.454.CMB.1.raw
  modified_base (351)..(351): a, c, t, g, unknown or other
  misc_feature (351)..(351): n is a, c, g, or t
tcagactactatgtcacgaccggtgctcgatttagtagcatactgttggggtttgggggggaaatgctttctgagactcatggacctcctgtgcaaagaacatgaagcacctgtggttcttcctcctgctggtggcggctcccagaagggtcctgtcccatttccagttgcgtgagtcgggcccaggctgggtgaagcctggccggagacccctgtccctctatttgctctcgtctctgggtcaccttccttcagtaacactagtatttattagttcgggcctaggactccggcaccggccccgagggaagcgtccgtggtaggttggttgcgtagtactcctagtttacncgtagtcgggtacccgtaacccccttactacctacttcccgtcccgtcgaacgtacgtacgtacgtcctacctattaccacgtcggacgtccgacgaacgaacctacgtacctcccgtaggacgtcgtcgtcgtccgtcgtcccggaccccggcggaaccgaccggtccttagtacttacgtggtcggtcgggttcttacggtcgtagttggttagtcggtagtcgtgtctcgcctacgtaccgcgactacgtattacgttacggtggtcgggttacggcgacggacggtccgtaccgg

SEQ ID NO: 229411 - DNA, 598 bp, Homo sapiens
  misc_feature: GYAE6OF01AH2EE.24.37.D04.1.454.CMB.1.raw
  modified_base (377)..(377): a, c, t, g, unknown or other
  misc_feature (377)..(377): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccagggaagagcctggagttggttgcgagtatccattatcatcgggccgaacccccttctactacttccgtccctcgagtacgtcgagtccaaccnctttcactggacgccgtccaagaccagtacctccctgacgctgcgtctcgtcgaccccgcggaccacggccgtatacttacgtgtcgccgggtctttagggtcctagttcgttgttgggtcgagttcgtctcgccacctacccggcgtcccgagtaactttacgttaaccggttggggtccggttttcggggacctacggaaccgggtccccgtaaccggg

SEQ ID NO: 229412 - DNA, 528 bp, Homo sapiens
  misc_feature: GYAE6OF01EQ9LW.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacatggccaggcctcccggctcctcatctatgatgcatccaagtacgggccacgtgcatcccagacaggttcaggtggcaggtggtcgtgggacagacttcactctcatcatcagcagtgtagagctagaagtattttgcttagtttattacttgtcagcctacgtgaactacgtcgtccctaccgtttcggccctagggaccagaccgtggaactacgtaccgaaacgtacgtggtcgctcgaccaccatcgttgtcttacc

SEQ ID NO: 229413 - DNA, 715 bp, Homo sapiens
  misc_feature: GYAE6OF01COTCK.24.37.D04.1.454.CMB.1.raw
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatcgccaccggagacattgtgttgacacagtctccagccacctgtctttgtctccgaggggaaanagccaccctctcctgcagggccagtgacatgttaggattgtagctggtatcaacacaaacntcggccaggcctcccggctcctcatctatgatgcataccaatacgggccacgtggcactcccaagacgtaggttcaggtcggactagggtgggtctaggggacacggtaccttcgaccttccgtaccaccgtattaccaacggtcgtaaggttacggtaagtaacggtaccgttaggtaaacggttaagtttttacggtacgtttaacggtttttaactttaacgttacgttaccgtacggtacctaaccggtacgtaaccgtaaccgtaccgggtaccccgttaccgttttcccgggtacccggttacggggtaccgtaacggtaccggtacggtaaaccgtaacgtaacccggtaaaccgtaacggttacgggttacgggtaccgttaccggtacccgtaacccgttaaaccgtttccgtttaccggtttaccttcccgtttaacccg

SEQ ID NO: 229414 - DNA, 584 bp, Homo sapiens
  misc_feature: GYAE6OF01CYZ2L.24.37.D04.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (315)..(315): a, c, t, g, unknown or other
  misc_feature (315)..(315): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanagccaccctctcctgcagggccaggccggagtgttagtaagtcttaggctggtaccaanagaaacctggccaggcctcccaggcctcctcatctatgatgtcctccaacgngggtcacgtcggccgtccccgctaggttcaggtcggcaggtcgggtctggggactaggtacttcactctcaccgtcagcagcctagcgcctagaagtatttgtcgtttactacgtgtcagcagtccgttccgcctcggccgtcgttaaccggtttcggggaccgggggtaccgaggggtgggaggagggacgacggacgtggtcggcgtcgacaccgtacgtcgttcgttcttctacttcccgttccccgactactctagtaacgtaag

SEQ ID NO: 229415 - DNA, 560 bp, Homo sapiens
  misc_feature: GYAE6OF01DPNMY.24.37.D04.1.454.CMB.1.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (366)..(366): a, c, t, g, unknown or other
  misc_feature (366)..(366): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccaaggggaaancgcccaccctctcctgcagggccagtgacagtgtaggaattgtagctgtatcaacacaaacngtcggccagggcctccccggntcctcattctatgatgcactccgaagtcggccagtggaccactacccgagactaggttacaggttggctaggtcgggtangggacagtacttcactctacgacagtcagctagtgtagacgtctaagagtatttgacttagtttatactgtcagtacacgtcgaacaccgtcgacccgtacgttccggacccgtaggaccacgacgttcgaactacgaacccgtaacgtagtgtcggacctgtacccgacttgttccgttgttcctcgttaccg

SEQ ID NO: 229416 - DNA, 520 bp, Homo sapiens
  misc_feature: GYAE6OF01AGBJG.24.37.D04.1.454.CMB.1.raw
  modified_base (204)..(204): a, c, t, g, unknown or other
  misc_feature (204)..(204): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgtctccaggggaaangccaccctctcctgcagggccagcgacaatgtaggaagttgttagcctggtatcaacacaaacatggccaggcctcccggctcctcatctatgatgcatccaatacgggccacgtggcatcccagacaggttcagtggcaggtcgggtctgggacagtacttcactcncacntcagcagtgtagagtccgtagtaagtattttgactagtttattactgtcagtcacgtgaacacgtcgaccctacgttccggccctgggaccagtacgtcgacactaccgaacgactgtcggctcgactaccatctcttctctac

SEQ ID NO: 229417 - DNA, 666 bp, Homo sapiens
  misc_feature: GYAE6OF01CB4WS.24.37.D04.1.454.CMB.1.raw
  modified_base (202)..(202): a, c, t, g, unknown or other
  misc_feature (202)..(202): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctaccgaggggaaancgcccacctctcctgcgacgggccagtgaactaagttaggttaagggtaagtttggttacgccgttaggtaactacaaacaacaaaacgtgtcggaccaggccctcccggactcctctatctagtgactgacactccgaagtacggccacgtcgactacgtacccgagtaccgtaggttacacggtggactagggtcgggtctacgggaacacgtacttcgaccttctacaacctatcgagtacgtagtacgtaacgacgtaccgttaaggaaacgtttattttacggactttaacgttttacttacgtcgtaccgaacgtaccgtaaccggtagaaccctaaccggtccgtacccgttaccggttcccggaccgtaccggaccaaggtccgtacggaacctacgacccgaaacgtagtcggtggacctacgacctaacctcgttacttccgttctccgtaccc

SEQ ID NO: 229418 - DNA, 666 bp, Homo sapiens
  misc_feature: GYAE6OF01EUW4A.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaccatggaagccccagctcagcttctcttcctcctgctactctggctcccagatgccaccggagacattgtgttgacacagtctcagcctaccctgtctttgtctccgaggggaaanagccaccctctcctgcagggccagtcagagtgtagcagcagctacttagcctggtaccagacaacgaaacctggacctggcctcccaggctcctcattctagtcggtgccgtccacgtacgggccacgtggcgtcggacggacaggttacaggttcggcgtaggtggtcgtttaggggactaggtacttcgactctctagtccatacgaactaggacgttacgggacgacccggtaaagtacttttagacgtaggttagttactttaacgtacgtacgtacgttcgttggttttccggttcccctccgtttcccgttaccgttacgtttacgttaaccgttacggttttcgggacccggttacggggtttacccgtacgggttacggtacgggtaagtaacggttacgtaaacggaccgtaaacggttcgggtacggttaccggtcgtaccgtaacccgtacg

SEQ ID NO: 229419 - DNA, 737 bp, Homo sapiens
  misc_feature: GYAE6OF01CJJUW.24.37.D04.1.454.CMB.1.raw
  modified_base (214)..(214): a, c, t, g, unknown or other
  misc_feature (214)..(214): n is a, c, g, or t
  modified_base (406)..(406): a, c, t, g, unknown or other
  misc_feature (406)..(406): n is a, c, g, or t
tcagactactatgtcacgaccggtgctcgatttagtagcatactggtttgggtttgggggaggaactgctcagttaggacccagagggaaccatggaagccccagctcagcttctcttcctctgctactctggcctccagatcgccaaccggagactatttgtgttgacacagtcctccagccctaccctgtctttgtctccgaaggggaaacncgccctaccctctccgtgccgacgggccagtcgaactagttggttaaggtaagtttgtacgccgtggtactacaaacgaacaaacgagtcggccacgggtccctacccggctccctctactctagtgactcgaccatacccgaagtaccggggccacgtcggacctacgtcccgaggaacgtaggttaccgnggtcggacgtagggtcgggttcgacgggtacacgtacttccacctctcccactactcgacgtacgtagtacggtaacgacgtacgttaagtaacgtttgttttcggaactttacggtttttaataccgtaggttcccgaacgttacccgtaaccgtacgtaaccgtacccggttccggtaccccgtttacggtttcccggacccggttacgggaccctaacgggtaaccggttccgtaaacgaacccgttaaccggaaaccgtaacggttcggccgttaccgtacgtaccctacccggttatttcccgttacggttccttccgttaccccg

SEQ ID NO: 229420 - DNA, 639 bp, Homo sapiens
  misc_feature: GYAE6OF01EWSDU.24.37.D04.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggctcccagatgccaccggagacattgtgttgacacagtctccagccaccctgtctttgtctcaggggaaanagccaccctctccgtggcacgggccagtgacctaatcgttaaggaagtttgttagccttggtatacaacacaaacatcggacctaggcctcccggctacctcatctangatgcatccaagtacggcacgtgcactccagctaggttcagtcggacagggttcggtctagggaactgaacctttcaccttctcgaaaccctagttccaacgacctaggtcgtaagacgtcccgttaggaagttacttttaggacttaacgttttttatacgtgtacaacggtcctaaccggttagaaccttaacggtccgtacccttaacgtttccgggccccgttagggaccctaagacgttcggaacctaacgtacccgaaacggtaacgtacggtcggacgttacgccctaaaccttagtacctttcgttccgttcctaaccgg

SEQ ID NO: 229421 - DNA, 584 bp, Homo sapiens
  misc_feature: GYAE6OF01C3CC2.24.37.D04.1.454.CMB.1.raw
  modified_base (520)..(520): a, c, t, g, unknown or other
  misc_feature (520)..(520): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgcccaccggagacattgtgttgacacagtctccagcccaccctgtctttgtctccgaggggaaagagcccaccctctcctgcagggccaggtgaacaagtgttaggaagttgttagccgtaggtatacaaacacaaacatggccaggcctcccggctcctcatctatgatgacataccaagtacgggccacgtcggacactcccgaagacgaggttcgaggtcggacgtaggtcgggtccgtaggggacagtacttcgactcgtaccactatcagactaggtgtacgacgtctagtaagttatttgacttagtttaattactgtacgacgcgacgtacgaaccacgtcgtacccgtacgttccggccgtacgggaccnggtacgtcggacctacgtaccgaaccgtagtcgtcgacgtgacctactatcgtactctctaccg

SEQ ID NO: 229422 - DNA, 728 bp, Homo sapiens
  misc_feature: GYAE6OF01BNJS9.24.37.D04.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccgaggggaancgccacctctcctgcagggccagtgacaatgttaggagttgtagctggtatcaacacaaacntcggccaggcctcccggctcctcatctatgatgacataccaagtcgggccacgtggactactcccgaaggtactagggttcaggtcggcgtaggttgggtctaggggaactacggtacctttcacgttcctaccgaacctagtacaaggtccgtaagttacggtacgacgtcgtaaaggtaacgtttacgttttcggactttaaggtttttaacttacggttacggttaaccgaagggttacccgtaaacccgggttaccggaaacccgtttaaaccgggtttcccgggtaacccccctttaaccggggttttccccgggaaccccggtttaccggggaacccgtacggttaaccggtacgggtaaacccaaccggttaaaccccggaaaaccggtacgtttacgggtccgaccgttaccggaaccctaccgtacgttcccgttcgttaccccgttactacccg

SEQ ID NO: 229423 - DNA, 658 bp, Homo sapiens
  misc_feature: GYAE6OF01E1SCQ.24.37.D04.1.454.CMB.1.raw
  modified_base (216)..(216): a, c, t, g, unknown or other
  misc_feature (216)..(216): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctnatttgctctgtctctggtcgacctccttcagtaacacgagtattattatgggcctggactccggcacgccccagggaagacgccgtgggtagttggttggcgtaggtactcctattactcacgtcgggcccgtaaccccctttctacctacgtttccccgtcccgtacggacgtacggtccgacggtcctaaccctatttccacgttcgggacgtcccgtaccaaacgaaccacgtacctccccgtaggacggtcttggccggttactcggtccggacccccgcgggaccaccgggtccgtacttacttacgtggtcggtcgggtcttaggtctagttgttggttcgtcggattgtcgtgtacctaccgtcggcgtcgacttaacgttacgttacggtcggggtacggtttcggggacctacggtcgggacccgtacccggg

SEQ ID NO: 229424 - DNA, 227 bp, Homo sapiens
  misc_feature: GYAE6OF01EPPEF.24.37.D04.1.454.CMB.1.raw
  modified_base (221)..(227): a, c, t, g, unknown or other
  misc_feature (221)..(227): n is a, c, g, or t
tcagactactatgtcacgaccggtgctcgatttagtagcatactgttgggtttggggcacagggaccacggtcaccgtctcctcagcctccaccaagggcccatcggtcttccccctggcaccctcctccaagagcacctctgggggcacagcggccctgggctgcctggtcaaggactacttccacatagtagtctgagcgggctggcaaggcgcatagnnnnnnn

SEQ ID NO: 229425 - DNA, 701 bp, Homo sapiens
  misc_feature: GYAE6OF01BOCEE.24.37.D04.1.454.CMB.1.raw
  modified_base (204)..(204): a, c, t, g, unknown or other
  misc_feature (204)..(204): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaangcccaccctctcctgcgagggccagtgacaatgttaaggagttgttagccgtggtatacaaacaacaaaacagtcggccaggcctccccggcttccgtcattctatgatgcactaccgaagtacgggccacgtggccactcccaagacgtaggttccaggtcgcgtaggggttcgggtcgtacggggactacggtacctttacgaccttcgtaacaaccctagttaccgaacgtacgtacggttaggtaacgacgttaccgtaggtaaagtttacgtttttagtaacgtttttacgtacgttacgtaccaggtacctacggtacgaacccgtaacgtccggtaccccgttacgttcccggacccggttagggaaccctagtaaccggttacggaacctaccgttaacccgaacggtaaccttcgggtacggtccctacggtacccctaacgtaccgtttcgttaaccgtttccttacccgtccgtttacccccccgg

SEQ ID NO: 229426 - DNA, 844 bp, Homo sapiens
  misc_feature: GYAE6OF01CKINO.24.37.D04.1.454.CMB.1.raw
  modified_base (202)..(202): a, c, t, g, unknown or other
  misc_feature (202)..(202): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccaccctgtctttgctccgaggggaaancgcccaccctctcctgcagggccagtgactaatgttaggaagttgtagcctggtancaaacacaaangtcggccacggcctcccggctccacntctancgatcgcactccaaagtcgggaccagtcgggacctacgtaccccgaaggtacgtacgggtttaccaggttaccggggaccgtaaggggttcgggggttacctacggggggtaacctaaacgggtttaaccctttccgtaaaccttcccgttaaccaaccctaacgtttaccgaacggtacgttaacggttacgggtaaacggtacccggacctttaagggtaaaagtttcggtttttcggtaacctttaaagggttttttaaacctaccgtttacggttacccgtaaacgtccccgtaaacccgggtttaacggaaacccgtaacccggttacccgggttaacccccttaacccggggtttttacccggggtaacccccggttaacgggggtaaccccgtaagggttaacccggttacggggaaaccccttaacggtaaacccccggttaaaaacggacccggtttgggttaccgggacgttacccgtaaccccgtaaccgttaacctttcggttaaccctttccggtttcccttaacccccgg

SEQ ID NO: 229427 - DNA, 780 bp, Homo sapiens
  misc_feature: GYAE6OF01DX3Q5.24.37.D04.1.454.CMB.1.raw
  modified_base (219)..(219): a, c, t, g, unknown or other
  misc_feature (219)..(219): n is a, c, g, or t
tcagactactatgtcacgaccggtgctcgatttagtagcatactgttgggtttgggggggaaatgctttctgagactcatggacctcctgtgcaagaacatgaagcacctgtgttcttcctcctgctggtggcggctcccagaagggtcctgtcccatttccagttgcgtgagtccgggcccaggactggtgaagcctggcggacgacccctgtccctnattttgccttctgttctcgtggtcgtaccttccttacaagtaacacagtatttattagttggcctggtactccggacaccgaccccgaagggaacgacgtccgtagggtacggtttggttcggacgtaagttactcctaatttactcgtaacgttcgggacccctaaccccctttctactaccgtttcccgtcccgtcggaagtacggtcgacgttccgaaccttatttcacgtcgggtacctcccgtaccaaacgtaaccctacgtacccgttcccgtaggaacggtctcgggtccggttcgtaccggtcccgacccccggacggaccgtaccggtaccgttaacgtttaccgttacgtggtcgggaccgggttacgtttacggtacgtttaggtttcggttacggtttcgggtctaggtttcggtccggtacggtaaccctaccccggttaccggtcccggtacgttaacgttaaacggttttaccggtttaccggggttcggggtttacggggtttacggggacgtaacccgggtaccgggaccccggttaacccggg

SEQ ID NO: 229428 - DNA, 820 bp, Homo sapiens
  misc_feature: GYAE6OF01AQ3X5.24.37.D04.1.454.CMB.1.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccaccctgtctttgtctccgaggggaaanacgcccaccctctcctgcagggccagtgacaatgttaggaagttgtagcctgtatcaacacaaacntggccaggcctcccggctcctcattctagtgatgacataccgaagttacgggccctagtggcctacgtccccaagtaaccgtagggtttcaaggttcgggactaagggttcggggtcgttaggggaacctaaggtaccgtttaccacgtttccctaccgaaccctaagttcccgaacggtacctaaacgggttcggttaaacggtaaccggttaccccgttaagggttaaaacggtttaacgtttttttacgggtaaccgttttaaacggtttttttaacgtttaacccgttttaacgggttaccgttaaaccgggtcccgttaaacccgggtttaacgaacccgttaaacccggtttcccggggtaaacccccctttacccgggttttaccccgggtaccccgggttacggggtaaccccgtaacgggttaaccgtaccgggtaaacccgtaaccgttaaccccggtaaaccgtaaccgttcgggtaccgggtacctccggaaccctaaccgtacgtttaccgttacggtttccccttaacgttaccccg

SEQ ID NO: 229429 - DNA, 750 bp, Homo sapiens
  misc_feature: GYAE6OF01ASEBZ.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacatttgtgttgacacagtctccagccacctgtctttgtctccgaaggggaaangccacctctcctgcgagggccagtgaactaagtggttaaggtaagtttgttacgccgttaggtactaccaaacaacaaaacagtcggacccagggtccctccccgggcttaccccgtcaacttcctaatcggaattcggacctaaccttaccgaaaggttacggggccctaacgttcggacctacgtaccccgaagtaccgtaaggtttccgaggtcgggctaggggttgggtcctaggggaacctaggttacctttactacgttccgtacccaacctagttaccgagtacgttaagggttacgtaacggtaccggtaccgttaagggtaaacgtttactttttacggtacgtttaagttttactttacgtcggtaacacggtacctaacggttacaaccgtaacgtccggtacccctttaccggttcccggacccgtaacgggaccctaaggtaccgtacgggaacctaccgtaaccgaaacggttacgtgggtaccgccgtacgaccgttacctagttacccttgtttcccgttcgttacccg

SEQ ID NO: 229430 - DNA, 644 bp, Homo sapiens
  misc_feature: GYAE6OF01EC6ZH.24.37.D04.1.454.CMB.1.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccacctgtctttgtctccgaggggaaancgccaccctctcctgcagggccagtgacatgttagagttgtagctaggtatcaacacaaacntggccaggcctcccggntcctcatctangatgcactccgaagtcgggccacgtcggacacgtccaagtactaggttcaggtgacgtagggtcgggtctgggaactacgtacctttccacttccgtaccaacctagttacacgtcgtaaggttcgtaggacgtcgtagtaagttatttcgtacgttaagttttactacgttgtaccgagtaccctacgttcgaaccgtaacgtccgtacccgttaccgtttcccggaccgtacgggacccaggtaccgtacgggaccctaacgttaccccgaaacgttacgtcgggtacgtaccgtacggttaaaaccctctttaccgttacggtttaccttccgtaccgtttcccccg

SEQ ID NO: 229431 - DNA, 752 bp, Homo sapiens
  misc_feature: GYAE6OF01CD8RG.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctccagagaccgccggagaaggtgtgttgtcgcacgtcccaggccaccctgtcgttgtctccgaggggacacagccatcctctcctgcacgggccagtcacgcctctccgtccaacccttagcctggttaccaaacaaacgccctggcccacgcctccacgactcgtcatctatgaactacacgtaaccgaaaacgggcccgacgtcgggacccgttacccacggtacccgtacgggttccgcgttcgggacgtagggttcggggttacgtacggggaactacggtacctttaccgacgttcctacctaacccgtacgttaccgaacgtccgaaccggtacccggttagggaaccgtaaccgttaggtaaacgtttacgttttacgaaccgttaaagtttcggttaaactttacgttcgtacgtaacgcgtaacgtcgtacgtaacctaaccgtccggaccccttaccgtaacttaccgttaacgttacccgttttacgggaccccggtaacggggaaccctaagggtaccgtacgggtaacctaacggtaccgaaggtaaccgtaacggttcggtacggtaccgtacgacccgtaacttacgtccgtttgtttaccccg

SEQ ID NO: 229432 - DNA, 676 bp, Homo sapiens
  misc_feature: GYAE6OF01CT7C1.24.37.D04.1.454.CMB.1.raw
  modified_base (299)..(299): a, c, t, g, unknown or other
  misc_feature (299)..(299): n is a, c, g, or t
  modified_base (472)..(472): a, c, t, g, unknown or other
  misc_feature (472)..(472): n is a, c, g, or t
  modified_base (555)..(555): a, c, t, g, unknown or other
  misc_feature (555)..(555): n is a, c, g, or t
tcagactactatgtcacgaccggtgctcgatttagtagcatactgttgggtttgggggaggaactgctcagttaggacccagagggaaccatggaagcccagctcagcttctcttcctcctgctactctggcctcccagatcgccaccggagactattgtgttgacacagtctcacgccaccctgttctttgtcctccggaaggggaaacgacgccctaccctcctccgtgcgacgggccagtagaactaagtaggttaggtaagtttgtacgccgttaggtactacaaacaacaaacngtcggaccgacgggtccctccccggtctcctacattcgtatagtactcgactactaccgaagtacgggacccacgtcgacctaccgtacccgaagtaccgtacgggttacaggtacggacgtagggtcgggtacgtacgggactaacgtacttcacctctaccaacgactacngtactaggtgtagacgtacgtaagttaacgtgttttcggaacgtttagtttacttacgtacgtaccgaacgtactaccggtanaaccgttacggtcccggtaacccttccggttcccggacgtacgggacctaggtaccgaacgactaacgaaccgtaacgtagtggtcgtacgccacgtacctagttcctcgttctcgtaccc

SEQ ID NO: 229433 - DNA, 724 bp, Homo sapiens
  misc_feature: GYAE6OF01EF2QA.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctccgaggggaaancgccaccctctcctgcacgggccagtcgactaagtggttaaggaagtttgttacgccgttaggtatacaaacaacaaacagtcggccacggtcctacccggcttcctacactctatgatcgacacgtaccgaagtcgggaccctagtcgggaccacgtaccccgaagtaccgtacggtttacgaacggtcggacgtaacgggttggggtaccggttacgggaaacgtacggtaacctttaccgacctttaccaccgaacctaacgtcgtaacggtacgtaacgggttaggtaacggaccgtacccgttaaggtaaacgtttacgtttttacggaccttttaaggtttttaacttacgttacgtaccgtacggtacccgtaccgttaacggaccttaaccgtccggtaccccgttaccggttccggacccgttacgggacctacggaaccgtcgtaacctacgtacccggaaacgtacgtcggtcgactcggacctaccgtatccttcgttcctcgtacccg

SEQ ID NO: 229434 - DNA, 592 bp, Homo sapiens
  misc_feature: GYAE6OF01EP880.24.37.D04.1.454.CMB.1.raw
  modified_base (235)..(235): a, c, t, g, unknown or other
  misc_feature (235)..(235): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaaggtcctgtcccatttccagttgcgtgagtcgggcccaggactggtgaagcctggcggagaccctgtccctcatttgctctgtctctggtnactccttcagtaacacagtattattattgggcctggatccggcacgccccagggaagagcctggagttggttgcgagtactccattatcatgggccgtaaccccttctactacttcccgtcctacgagagtcgagtcacctatttcacgtggacgccgtaccaaagaaccagtacctcccgtagacggctacgcggtctcgtaccgacccccgcggaccgaccggccgtatacttactggtcgcggtcttaggtctagttgtggttggcgtattcgtctcgcctacgtaccggcgacgactaactttacgttaacggtgggtcggtttcggggacctacgagggtcccgtaaccggg

SEQ ID NO: 229435 - DNA, 539 bp, Homo sapiens
  misc_feature: GYAE6OF01DE3XG.24.37.D04.1.454.CMB.1.raw
  modified_base (199)..(199): a, c, t, g, unknown or other
  misc_feature (199)..(199): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctcaggggaaanagccacctctcctgcagggccagtgacaatgtaggaagtttgtagcctggtatcaacacaaacatggccaggcctcccggctcctcatctatgatgcatccaatacgggccacgtggacatcccagacaggttcagtggcaggtggtctgggacagtacttcacgttctacaccatcagcagtcgagacgactagtaagtagttttgactagttttattactgtacagactaccgtagacaactcgtacccgtaacgttccggcccgtcgggaccagtacgtggactactaccgaacgtacgttaggtcggactgacctacattccttgtccttctaccg

SEQ ID NO: 229436 - DNA, 667 bp, Homo sapiens
  misc_feature: GYAE6OF01DYC0R.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggagacattgtgttgacacagtctccagccaccctgtctttgtctcgaaggggaaagcgcccaccctctcctgcagggccagtgacaatgttaggaagttgttagcctggtatacaacaacaaacagtcggaccaggcctcccggctcctcatctatgatgactataccgaagtacggccacgtcggacactcccgagacgtaggttacgaggtcggacgtagggttcgggtacgtcgggaacctaggtaccttaccgaaccttccgtacccaccgtaatccgaagtcgtaggttcgtaaggacgtccgttaagaaaggtttcttttacggactttaaggttttacttacgttagtacgtacgacccgtaacgtacgaaacgtaccgtcgaccccttacgtttcccggacccgttacgggacctaaggtccgtaggaaacccttaacgtacccgaaacggttacgtcggtacggccttaccgacctaccgtactttcctccgttacttcccgttacccg

SEQ ID NO: 229437 - DNA, 574 bp, Homo sapiens
  misc_feature: GYAE6OF01CFE35.24.37.D04.1.454.CMB.1.raw
  modified_base (203)..(203): a, c, t, g, unknown or other
  misc_feature (203)..(203): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaanacgccacctctcctgcagggccagtgacatgtagattgtagcctgtatcaacanaaacngtgccaggcctcccggntcctnatctatgatgcatccaagtacggcacgtggcatcccaagacctaggttccagtggctaggtgggtctgggactggtacttcactctcaccatcagctagtgtaagcgtacgtagaagttagttttcgacttaaggttttaacttacgtagtacgacgtactaccgtagaacctaacgtccggacccttaccgtttccggcccgttacgggacctagacgtggaacctacgtaccgaaacggtaacttcggtcgcttacgacctaccgtattacgtcgttcttccgtaccg

SEQ ID NO: 229438 - DNA, 624 bp, Homo sapiens
  misc_feature: GYAE6OF01A7Q8H.24.37.D04.1.454.CMB.1.raw
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (565)..(565): a, c, t, g, unknown or other
  misc_feature (565)..(565): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagacccctgtccctctatttgctctgtctctggtnacttccttnagtaacacagattattattgggcctggactccggcacgccccgagggaanagcctggacgttggtgcgtagtactccattatcatcgggccctaaccccttctactacttcccgtcccgtcgagacgtcgactcaacctactttcacgtcggacgtcccgtacaaacgaaccacgtacctccctggacgcgtgccggttctcggtaccgacccccggtacggaccgaccgggaccgtaagttacgttaaccgttggtcggtcgggtaccgtttagggtcctagtttggtggttgcgtatcgtctgctaccgtcccgcgngacctaagttacgttacggtcgggtcggtttggggacctacggaccgggtccgtaccgg

SEQ ID NO: 229439 - DNA, 565 bp, Homo sapiens
  misc_feature: GYAE6OF01A2HPU.24.37.D04.1.454.CMB.1.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
  modified_base (555)..(555): a, c, t, g, unknown or other
  misc_feature (555)..(555): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctnatttgctctgtctctggtnactccttnagtaacacagattattattgggctggatccggcacgccccgagggaagagcctggagttggtgcgagtatccgattatcagtcgggaccgtaaccccctttcgtactacttcccgtccctcggagacgtcgacgtcaccgtatttcgacgtcggacgccgtaccaaagaaccagtacctccgtagacgctgcgtctgccgaccccgngacncggacctatatactgtgcggtnttagtctagttcgtgttggcgtatcgtctgcctacgtccgcgtcactattacgttacggtgggtcggtttgggacacgnggcctaccgg

SEQ ID NO: 229440 - DNA, 792 bp, Homo sapiens
  misc_feature: GYAE6OF01E46DL.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggcctcccagccatcaccggaggattgtgttgacgcagtctccaggccaccctgttctttcgctccgaggggagagacgccccaccctctcctgccgacgggcctaggtccaggaggttgttacgcaggcagtcttacgttacgccgtaggtaccagacgaacgtaacctcggaccgtcggcctacccgacggtcctccgtactactacgttacggtcggtcgtccggtacccgaccggacgggaccacggtcgggccggtacggaccggtacgtacggttcgaagggtcggacgtacggttcgggtaccggtttaggggaaccgtacggttaccttaccgtaaccgttccgtactacttcgaacgtaccgaacgtacgaacggtcggaacggtacccgtaggttacgtttacggcgtaaggttacgtttaacgttaccggttacgttaaccgtacggtttcgttttacgggtttcccgtttaccccgtttcccgtttacccgtttaccgtttaacgttttaccggtttaacccgttaacggtttttcccggaccgttacggggtttacccgaacgggttcggtacgggtaacgttaccggtaacgtaacgggtacccgttaaacggttcgggttaccgtacgttccgacgttcccgtaacg

SEQ ID NO: 229441 - DNA, 753 bp, Homo sapiens
  misc_feature: GYAE6OF01CIZJ9.24.37.D04.1.454.CMB.1.raw
  modified_base (206)..(206): a, c, t, g, unknown or other
  misc_feature (206)..(206): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatcgccaccggagacattgtgttgacacagtctccagccaccctgtctttgcctccgaaggggaaanacgcccaccctctcctgcgacgggccagtcgaactaagttggttaagggtaagtttggttaacgccgttaggtaactaccaaacaacaaaacagtcggccaagggtccctcccggctcctcactctatgatcgacactaccgaagtacgggccacgtggaccaccgtcccgaagtaccgtagggttaccgaaggttcggacgtacggggttcgggtcgtaggggaacctaacggttaccttaccaccttccgtaccaaaccctagttacgacggtacgtaggttacggtaacggacgtaccgttaagtaaggtttacgtttttagacgtttaagttttacttaccgttagttaccgtacgtacccgtaaccggttacgtaacccgtaaccggtcccggtaccccgttacgggtttacccggacccggttacgggaaccgtaacggaccgtacggaaacctaccggtaacccgtaaacggtacgttacgggtacggtaccgtaccggaacctaccgttacttccggtttacttccgttccgttacccg

SEQ ID NO: 229442 - DNA, 693 bp, Homo sapiens
  misc_feature: GYAE6OF01ARM0G.24.37.D04.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgctcaggggaacngccacctncctgcaggcagtgacaatgtagatgtagctgatcaacacaacntggccagctcccggctccncatctatgatgcataccaagtacgggccacgtcggacacgtcccgaagactaggttccaaggtgggactagggtcgggtactaggggaacacggtacttaccgaccttccgtaccaacctagttccaggtcctaggttacgtaacggacggtacccgttaggtaaacggttacgttttacggacctttaagttttaagtttaaccgttacggtaccgtaacggtacgtaacccggtacgtaaacgtaaccggtcggtaaccccgttaaccgttttccgggaccccgttaggggaacccgtaacggtaccgtacggggtaaccctaacggttacccgaaaacggttaaacgttcgggtaccgggtaccctacggtaacccggtaaccctacgtttaccgtaccgtttccgtttacctaacccgg

SEQ ID NO: 229443 - DNA, 777 bp, Homo sapiens
  misc_feature: GYAE6OF01EJTNC.24.37.D04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctccgaggggaaangccaccctctcctgcagggccagtgacaatgttagagttgtagctgatacaacacaacntggaccaggcctacccggctcctacattctagtcgatcgactactacccgaaagtacgggccctaacgtggacctactaccccgaggtaaccgtaggttccaaggttcgggacgtaggggttcggggtctcgggggaactacggtaccctttcgaaccttcctacaacccgtataccgagaccgtagttacggtaagtaccggtcccgtagggtaacgttacgtttttacggaaccgtttaaggttttttaaacttaccgtttcggttaacccgtagggtaaccccgtaacccgggtttaacgtaacccgtaaacccggttcccggggtaacccccgttaaccgggtttttccccgggaccccgggtttaacgggaaccctaacgggtacgttaaaccggggtacctaacccgttaacccgtaaaaccggtaaccggtttcggtacgggttcccgttaacggacccgtaacccgttacgttacccggtttacgttaccgtttccgttaaccccgg

SEQ ID NO: 229444 - DNA, 706 bp, Homo sapiens
  misc_feature: GYAE6OF01D5SNC.24.37.D04.1.454.CMB.1.raw
  modified_base (305)..(305): a, c, t, g, unknown or other
  misc_feature (305)..(305): n is a, c, g, or t
  modified_base (463)..(463): a, c, t, g, unknown or other
  misc_feature (463)..(463): n is a, c, g, or t
  modified_base (513)..(513): a, c, t, g, unknown or other
  misc_feature (513)..(513): n is a, c, g, or t
tcagactactatgtcacgaccggtgctcgatttagtagcatactgttgggtttgggggaggaactgctcagttaggacccagagggaaccatggaagcccagctcagcttctcttcctcctgctactctggcctcccagatcgccgaccggagactagttgtgttgacacgtagtcctccacgccctacccgttgttccgtttgtacctaccgaaggggaaacacgccctaccctctccgtcgcgacgggtccagtacgactaagtggttaagagtttgtagccgtagtatacaacgaacaaacngtcggaccacggtcctacccgctacctacactctagtgactcgacctacgtaccgaaggtaccggcctacgtcggacctaactcccgaagtacgtagtacgacggttcgacggtcggtacggtcgtacgggaactcgtacttccgactctacgacctntacacgttacgagtacggtagcttacggattaacgttgtttctaagtttnttttaacgtcgtagtaccgcgttacgtaccgtagtaaacccgttcgtacccgtaccgtttaccgttcccgggacccggttacccggaacggtcgttaacggccgtaaaccaaccgtaccgtaaacgggttcggtacggtccgttaacgtaccgacgttacccgtcttacccgttgtttaccctacgtttcccc

SEQ ID NO: 229445 - DNA, 716 bp, Homo sapiens
  misc_feature: GYAE6OF01BXAMB.24.37.D04.1.454.CMB.1.raw
  modified_base (217)..(217): a, c, t, g, unknown or other
  misc_feature (217)..(217): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtccgggcccaggactggtgagcctgcggacgaccctgtccctntatttgcttctgtctcgtggtgaccttccttcaagtaacactagtatttattagttcgggcctggactccggcacgccccgaggaagacgccgtggtaggttggtgcgagtactcctattactcaagtcgggacccgtaacccccttctacctacgttccgtcccgtcgacgacgtcgacgtcacctattcacgtgacgccgtacaaagacctacgtacctccgtagacggtcctggtccggtctcggtacccggaccccggtaccgggaaccgaccgggtaccgttaattacgtttacgtaggtccgggcgggtactttacgggtactaggtttcggtggtttacggccgtagtcgttaccgtcgacccgtaacccgttacccggccggtaccggtaaccgttaacggtttaaccgtttacgggggttccgggggtttacgggttttcgggggaaccctaacccggggtaacggggtaacccccggttaaacccgggg

SEQ ID NO: 229446 - DNA, 586 bp, Homo sapiens
  misc_feature: GYAE6OF01D5NGN.24.37.D04.1.454.CMB.1.raw
  modified_base (458)..(458): a, c, t, g, unknown or other
  misc_feature (458)..(458): n is a, c, g, or t
  modified_base (514)..(514): a, c, t, g, unknown or other
  misc_feature (514)..(514): n is a, c, g, or t
  modified_base (574)..(574): a, c, t, g, unknown or other
  misc_feature (574)..(574): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggactccggcacgccccagggaagagccgtggagttggttgcgtagtactcctattatcagtcgggcctaacccccttctacacttcccgtcctcgagacgtcgacgtcacctatttcacgtggacgtccgtaccaaacgaaccagtacctcccgtgacggctcggcgtcgtcgcgacccccgcgaccncgtccgtatacttacgtgtacgcgggtacttacggtctagttggttgttggacgtntcgtctgaccacgtaccgcgcgtactagtttactcgggtacgggtcggttgggacacggnggacccgtacgg

SEQ ID NO: 229447 - DNA, 530 bp, Homo sapiens
  misc_feature: GYAE6OF01CONRU.24.37.D04.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
  modified_base (402)..(402): a, c, t, g, unknown or other
  misc_feature (402)..(402): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaattgttagcctggtatcaacacaaacatggccaggctccccggctcctcatctatgatgcatccaatagggccactggcatcccagacaggttcagtggcagtgggtctgggacngacttcactctcaccatcagcagtgtagagcctagagtattttcgntagttttatactgtcagcacccgtgacctaactcggacccctacgtttcccggcccgttcggggacctacggcgtcggaacactcccgaacgtactggtcggctgaccaccatacctcgttcttctcg

SEQ ID NO: 229448 - DNA, 880 bp, Homo sapiens
  misc_feature: GYAE6OF01EZ3ZY.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgagggaagacgcccaccctctccgtgcgagggccagtgacaagtgttaaggaagtttgttagccttaggtatacaacacaaacatggccaggccgtccccggctcctcacttctatgatgcactaccgtaagtacgggaccacgtggaccactcccaagacgtacggttcaggtcggactagggttcgggtcgtacggggactacggtacctttacacgttacctaccgaacctactacgacgtaccgtaaggtacggttaacgtaccggtacccgttaaaggtaaacgtttacgttttttaacggaccgttttaaacggttttttaaactttaacccgttcggttaaccgtaaccgggttaaccccgtaacccggggtttaaaccgtaacccggtttaaaacccggttccccgggttaaccccccgtttaaccccgggttttttacccccggggggtaccccccgtttaacggggggtaaacccccccgtaaacggggtttaccccggttaaaccggggttaaacccctaaaacccggtttaaccccgggaaaaaaccccggtttaacccgggtttacggggttacccggggaacccgttttaacccgaacccccgttaacccgttaaaccgtttccccggtttacccgggttttaacccctttaacccccggtttaaccccccg

SEQ ID NO: 229449 - DNA, 576 bp, Homo sapiens
  misc_feature: GYAE6OF01DLWVO.24.37.D04.1.454.CMB.1.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctcgaggggaanagccaccctctcctgcagggccagtgacatgtgcagcaattgcctggtaccagcagaaacctggccaggctccaggctcctcctctatgctcgtctccgaccacgggtcccctggtccgtcccacgccgtacgggtttcggttgggcggtcgggtcgtcggggacagtacttttcactctacaccatcacggcggcctccagtctgaagtnttttcgcttactttatttctgttacaactactagtggtctacgtcggccttcgtactacgtttcggccgagggacccaaacgtggacgtagtaacgaaacgtacgtgtcggtctcggctaaccgcttcttcgttcttactactttcccttccccgtctaaccg

SEQ ID NO: 229450 - DNA, 655 bp, Homo sapiens
  misc_feature: GYAE6OF01CCZL0.24.37.D04.1.454.CMB.1.raw
  modified_base (217)..(217): a, c, t, g, unknown or other
  misc_feature (217)..(217): n is a, c, g, or t
  modified_base (393)..(393): a, c, t, g, unknown or other
  misc_feature (393)..(393): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctnatttgctctgtctctggtgacctccttcagtaacacagtattattattgggcctggactccggcacgcccccgaggggaagagccgtggtagttggttgcgagtactccattatcagtcgggccgtaacccccttctacctacgttccgtccctcgacgacgtcgacgtccacctntttacactcggacgaccgtacaaacgaaccacgtacctccctagacggtctcggtccggttcgtcgtccggacccccggcggaaccgaccgggtcccgttagtactttacgtcggtcgtcgggtcgtttaggtcgtagtttgttggttggacggtagttcgtctcggtccaccgttacccggcgtccgacttacgtttacggttaacgggttcggggttcggtttacggggacctacggtaccggggacccgtaacccgggg

SEQ ID NO: 229451 - DNA, 655 bp, Homo sapiens
  misc_feature: GYAE6OF01B02M6.24.37.D04.1.454.CMB.1.raw
  modified_base (200)..(200): a, c, t, g, unknown or other
  misc_feature (200)..(200): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (407)..(407): a, c, t, g, unknown or other
  misc_feature (407)..(407): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctcgaggggaaancgccacctctcctgcagggccagtgaacaagttggttaaggaagttgttagcctggtactacaacaacaaaacngtcggaccacggcctcccggntcctcatctatgatgactataccaagtcggccagtgacactcccagactaggttcaggtggcgtagggtcggtcgtgggaactacggtactttccacttcctacaaccgtanacaacgctaagcctaagacgtccgtaaggtaaagtttacgttttcggaccggtttttaactcggttacgtacgagtaccgtacggtcccggttcccggaccgttcgggtacccgtacgtttaaccgggtttcgggggccgggggtaacgttagggggacggagggaacgggtacgtaacggtacggtaggtggacctcggaccctaacctgttccgttggttaaccttcgtacgttcccgttaccccg

SEQ ID NO: 229452 - DNA, 873 bp, Homo sapiens
  misc_feature: GYAE6OF01CSQ4H.24.37.D04.1.454.CMB.1.raw
  modified_base (202)..(202): a, c, t, g, unknown or other
  misc_feature (202)..(202): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatcgccaccggagacattgtgttgacacagtctcagccacctgtcttgtctaccgaggggaanacgccacctctcctgcgacgggccaggtcgaactagttcggttaaggtaagtttgttacgccgttggtaactaccgaaactaaccaaacgtacgtcggaccccgaagggtccccttacccccggggcttacccccgttactacttaccgttaagtcggtaacttacggacctaacgttaaccccgaaaggtttaccgggggccctaaaccggtcgggtacctaaccgttaccccgaaacgggtaccgttaagggtttacccgagggtttaccggggacttaagggggttccgggttacgtacggggaacctaacggttaaccttccgaacttcccgtaccaaccgtattaccgaacgtacgtaaggttacggtaacgtaaccggtacccgtttagggtaaaacgttttacggttttacgtacgtttaaacggtttttacgttaccgtaccggtttaaccgtaaccggtacccgtaaacccgggttactaaacccggtaacccggttacccgggttaacccccctttaccggtttaccccggggccccgtttaacggggaccctaaccggtaccgtaccggaaacctaccggtaaccccgtaaacggtaacgttcggtacggtacctaccggaaccgtacccgtacttcgttacctcctttacccgtacccg

SEQ ID NO: 229453 - DNA, 658 bp, Homo sapiens
  misc_feature: GYAE6OF01CH3NU.24.37.D04.1.454.CMB.1.raw
  modified_base (155)..(155): a, c, t, g, unknown or other
  misc_feature (155)..(155): n is a, c, g, or t
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatcgccaaccggganacattgtgttgacacagtctcagccacctgtctttgctcgaggggaancgccacctctcctgcgagggccagtgacaatggtaaggattgtagctgtanacaacacaaacntgaccaggcctcccggctcctcatctatcgatcgctatccgaaagtcgggaccacgtcggactactcccgaaggtaccaagggtttccaaggtcggacgtaggttcggggtacctggggaaccaggtaccctttcgaaccttccaccgaacctagtccgaaggtaccgtaggtacggtagaccggtacctaggtaaacgtttagttttgaccttaaggttttactacgtacgtaccgtaacgaccgtaaccgtagtaacccggtaacgtccgggtaccccttacggtttaccggccccgttaacggggactaacggcgtacggtaccctacgtacccgaacgtacctggtccggtctccgggactaccgacttcgtccgttctcccgttacg

SEQ ID NO: 229454 - DNA, 788 bp, Homo sapiens
  misc_feature: GYAE6OF01DXAHK.24.37.D04.1.454.CMB.1.raw
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
  modified_base (456)..(456): a, c, t, g, unknown or other
  misc_feature (456)..(456): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatcgccaccggagacattgtgttgacacagtcctccacgcccacccttgttctttgtctccgaaggggaaancgccctaccctctccgtgccgacgggccagtcgactaagttggttaaggaagtttgtacgccgttaggtactacaaactacaaacngtacggccaggtcccgtacccggcttcctacattctangtatgactactaccaagtcggccagtcggacactacccgaagtaccgtggttaccaggtacggcgtaggtcgggtcgtagggaacctacgtacttccgaaccttccgtccctaaaaccgtntacccgaaggtccgttaagggtacggtaacgtaccggtaccgttaaagggtaacgttttacgtttttacggaaccgttttaacgtttttactaaccggttgtaacccggtaaccgtaccggtacccgggttaacgtaaccccggttaaacccggttcccggtaacccccgttttacccgggtttacccgggaacccccgttaacggggtaaccctaaaccggttaacggttaccgggtaaactaaccgttaccccgaaaggttacgttcgggtccggtaccctacggtacccctaacgttcgtttaccttaccggttccttccgtaaccccg

SEQ ID NO: 229455 - DNA, 585 bp, Homo sapiens
  misc_feature: GYAE6OF01C7Q6Z.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaaggaagttgttagcctggtatcaaacacaaaacatggccaggcctccccggctcctcatctatgatgcatccaagtggccatggcatcccagacaggttcagtggcagtgggtctgggacagtacttcgacctctcaccatcagcagtagtagacgtccgtagaaagtattttgacttaagttttaattactgttacgagtacaccgtagaacgtaaccgtcggtaccccttacgtttcccgggaccccttacgggaccctagaccgttacgggaacctacgtacccgaaaccgtaacgtcggttaggccttaggacctacctacgttcgtacgttccttcgtaacc

SEQ ID NO: 229456 - DNA, 820 bp, Homo sapiens
  misc_feature: GYAE6OF01CCG2E.24.37.D04.1.454.CMB.1.raw
tcagactactatgtcacgaccggtgctcgatttagtagcatactgttgggtttgggggaggaactgctcagttaggacccagagggaaccatggaagcccagctcagcttctcttcctcctgctactctggcctccagatcgccacgtggaagaagtagtcatgacgcagtcctccacgccaccctgtctgtcgtcaccggaaggggaaacacgcccaccctctcctcgcggacgggccaggtagagtaagtggttcggacacgactaacgttacgccgtaggaccagcaacgaaaccgtcggaccgacggcctcccggacggtccctccgttcctacgtactcgcctcgtccctacccgaccggtccgggccccgtcggtccgtacccgacggtccgtacgggtttcggtcgggtcgggtcgggtcgtcggactaacggttctttaccgaacgttcctaccaaccgtactaccggacggtcccggtacccgttaccgtaacggttaccgttaaggtaaacgtttacgtttttacggtaacttttaacctttttacggtttaccgttacgtttaaccgtaaaccgtttaacgttaacggttacgggtaacggttaccggttaccggttaccccgtttaacccggttaccggttaacccgggttttaccgggaaacccgggtaacggggtaaaccctaaacgggtacgggtaaacgtaaccgttaaaccgaaaacggttaacgttcgggtaaccgtacgtcccgtaaccgttacttaccggttcttacgttaccctttaccgtaccctttcccgtaccccg

SEQ ID NO: 229457 - DNA, 742 bp, Homo sapiens
  misc_feature: GYAE6OF01EPJKO.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattggtgttgacacagtctccagccaccctgttctttgtcctaccgaggggaaagcgcccaccctctcctggcgacgggccagtcgaactaattggttaaggaagtttgtacggccttaggtaataccaaacaacgaaactagtcgggcccaagggtccctccccggcttcccgtacacttactaagtcgatcgactaactacccgtaaagttacgggaccctaacgtcggacccaacgtccccgtaaagaccgtaggggttaccaagggttcgggacgtaggggttcggggtaccgtagggggaacctaggtaaccttcaaccttcctaccaaaccctatccgtaagtcctaaggtgtaagtaccgacgttagtaagttcgtttaggtacgttaagttttacttacgtcgtaccgtacgaccgtaaccggtacgtaaccgtacgttacccggacccgtttaacccggttcccggtacccggttacgggaaccgtaccgtacggtacgtaaccgtaacccgttaccgtaaccggtaacggtggttacggaccgttcgaccctacacgttcttaccgttcctattaccccg

SEQ ID NO: 229458 - DNA, 591 bp, Homo sapiens
  misc_feature: GYAE6OF01DV6W9.24.37.D04.1.454.CMB.1.raw
  modified_base (203)..(203): a, c, t, g, unknown or other
  misc_feature (203)..(203): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccaggccaccctgtctttgtctccgagggganagagcccaccctctcctgcgagggccaggccggagtgttaagtaagtacttaggctaggtaccaacaagaaaccctggccaggcctcccgaggcctcctcatctatgattcgtcctaccgaacgagggtccacgtcggcccgtccccgacaggttcaggtggctaggtcggtcgtgggacagtacctttcaccttcctaccaccgtcacgcaacgtacctaggacgtccgtagtaagttacttttcggtacggtttactacgtgtcgagtcgtacgtccgtccgccgtcggccgtcgttaacggttcgggacgggggacgaggggtggagggaggagcgaagtgngcngcgactntcgtgtactctactcctccnctactcngtaacg

SEQ ID NO: 229459 - DNA, 516 bp, Homo sapiens
  misc_feature: GYAE6OF01BV7E7.24.37.D04.1.454.CMB.1.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctccgaggggaaanagccaccctctcctgcagggccagtgacaatgtaggagttgtagcctggtatcaacacaaacatggccaggcctcccggctcctcatctatgatgcatccaagtacgggccactggcatccccagactaggttcagtgcaggtggtctgggacngacttcactcncacntcagcagtgagagcctagaagtatttgacttagtttatactgtcngcacgtnacacgtcgccctacgttccgccgtcggaccagactgacctatacccgaacgtactggtcgcgtcgacctaccattactcgttcctcgtaccc

SEQ ID NO: 229460 - DNA, 655 bp, Homo sapiens
  misc_feature: GYAE6OF01DDZYD.24.37.D04.1.454.CMB.1.raw
  modified_base (203)..(203): a, c, t, g, unknown or other
  misc_feature (203)..(203): n is a, c, g, or t
  modified_base (320)..(320): a, c, t, g, unknown or other
  misc_feature (320)..(320): n is a, c, g, or t
  modified_base (402)..(402): a, c, t, g, unknown or other
  misc_feature (402)..(402): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccacctgtctttgtctcgaggggaaanacgccaccctctcctgcagggccagtcgaacaatggttaaggaagttgttacgcctggtatacaaacacaaaactgtcggaccaggcctccccggctcctacatctatgatgactanaccaagtacggccacgtcggacactcccgaagacctaggttcaggtcggctaggtcgggtcagggacagtacttcgacttcncacctatcagtcagtagtagacgtctagtaagttagttttcgattaagttttaacttacgtgttaccgacgtaccgtaaccggttacgaacctaaccgtccggtaacccctttacggtttacccgggcccgttacggggaaccctacggtaccgttaccggaaaccgtaccgtacccgtaaaacgtaccgttacggtccggtaccgtacgtacccgtaaccttaacgttcttaccggttcctttccgtacccg

SEQ ID NO: 229461 - DNA, 960 bp, Homo sapiens
  misc_feature: GYAE6OF01DRRAT.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctccagatcgccgaccggagacatttgtgttgacacagtctccacgcctacccttgttctttcgtcctaccgaaggggaaacgacgccctaccctcctccgtgccgagggcctaggtcgaactaagttaggtttaaggtaagtttgttacggccgttaggtactaaccaaaacgaacaaaacgtacgtcggaccgacgggtccctccccggtccttacccttaccgacttacttacgtacggtacgtacggtacctaacgtaacccgtaaacggttaccgggacccgtaacggtcggtaccctaaacccgttaccccggaacggtaaccggttaacgggttaccggtaacgggtccgggtacggttaagggggttcggggttaccggtacggggtaaaccgtaacggttacccttaccgtacccgttacctacccgtaaaccgtacttaaccggacggtaccgttaaaggtttaccgggaacggtaccggttaaccggttaaagggttaaacggttttacgttttttacgggtaaccgtttttaaaggttttttaccgttaacgggttaccggttaaccggtaacggttacccgtaacccgggttacgtaaaccccgtttaacccgggttccccgggtaaccccctttttaaccggggtttccccggggaaccccgtttaccgggggaaaccctacgggttaacccgaccggtaaaacccgtaccgttaaaccccggtaaacgggttacccggtacgggtttccggaccgtttaaccgacccttaaccgtttcggtaccgttttcccttaccgttaccccgttacccg

SEQ ID NO: 229462 - DNA, 789 bp, Homo sapiens
  misc_feature: GYAE6OF01ESEHG.24.37.D04.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgtctccaggggaancgcccaccctctcctgcgagggccagtnacaatggttaaggaagttgttagcctggtatcaacacaaacngtcggccaggcctcccggctcctcatcctatgatcgacatccgaaagtcgggccctacgtcggcctaacgtccccaaggtacctagggtttcaggtcggacgtagggttcggggtaccgtacggggaacacggttaccttaccgaaccttccctaaccacctaatccgagaccctacggtaccgttaaggaccgtacccgttaaggtaacgttttagttttaccgggtaccggtttttaacctacgtttggtacccgtaaggacccgttaccgggttcccggttttaccccgcccgggtttaccggggaacccccgtttacccgggttttaaacgggtttccccggggggggacgggggttaacccggtaaggggggttcggaaacggggtaacggggtaaccgaaccgggttaacggtcgggtttacgggacccgttcggtaacccgtaacccggttagtttcccccggttagtttaccccgtttaccgttacccgtttcccccgttacccccgg

SEQ ID NO: 229463 - DNA, 779 bp, Homo sapiens
  misc_feature: GYAE6OF01EE8EV.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagacccctgtccctcatttgctctgtctctggtgactccttcagtaacacagtattattattggcctggatccggcacgccccagggaagagcctggacgtttaggttgcgagtatccatttatcagtcggacccgtaacccccttctacctacttcccgtccctcgagtagtcgagtccacctatttccaacgttcgggacggtcccgttacccgaaacgtaaacccgtacgttaaccctccccgtagtacggggtaccttcgggtccggttccgttcggttacccgggacccccccggcgggaacccgtaaccgggtcccgttaagttaaccgtttaccgttcggtacggcggggttacgtttaacgggttctagttttcggtttagggtttcgggtccggttacgttcggttaccgtcggtacccgtaaccgttaacccccgggcggtcccgggtaacccttaaacggtttttaacggttttaacccgggtttacggggggttcccgggttttttacgggggggaccccttaaaccggggtaaccgggggtaacccccgttaaacccccggggg

SEQ ID NO: 229464 - DNA, 837 bp, Homo sapiens
  misc_feature: GYAE6OF01CJ363.24.37.D04.1.454.CMB.1.raw
  modified_base (202)..(202): a, c, t, g, unknown or other
  misc_feature (202)..(202): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagagacccaccggagaaattgtgttgacacagtctccaggcaccctgtctttgtctccgagggganagacgcccaccctctcctgcgacgggccaggccggagttagttagtaagtacgttaggctaggtaaccaagaagaaaccgtggaccacggcctaccgaggctccctatatctagtcgtatcgttacctaccgaacgcgggttaccacggtccggccccgttccccgaccgtaggtttccagggtcggacgtagggttcggggtcctaggggaacctaggtacccttacgtacgtcccgtaaccgtacccggtcaaacgccggtaacggtacccgtaaggaccgttacccgttaggtaaacgtttacgtttttacgggttaaccggttttaccgttaacgttcggtaaccgtacggtaccggtacggttccccggttcccggtacccggttaccgggtaccccgttaacggtttaacccggggttttacccgggggaaccggggggggttaacccggtacggggggttacggggaaacgggtacggggtaaccgggtaaacggacgggtttacgggcgggtaccgtaccgggtaccgtaacccgtacggtttccgttagtttacccgttccgtaaccttccccggtttacccgtaccccgttattcccggtaaacgttaaccgtaacgtttacggg

SEQ ID NO: 229465 - DNA, 602 bp, Homo sapiens
  misc_feature: GYAE6OF01DQGRG.24.37.D04.1.454.CMB.1.raw
  modified_base (152)..(152): a, c, t, g, unknown or other
  misc_feature (152)..(152): n is a, c, g, or t
  modified_base (200)..(201): a, c, t, g, unknown or other
  misc_feature (200)..(201): n is a, c, g, or t
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatggccaccgganactattgtgttgacacagtctcagccacctgtcttgctcgagggaaannccacctctcctgcacgggccagtnaacaatgttacggattgttacgctgtatacaacacaacagtggaccacggcctcccggntacctcatctaatcgatcgacacttacaacgtacggcctacgtgaccactccccaagtacgtacggttacgaggttggacgtaggtacgggtcgtagggacncggtaactcactctacaccntaccagtctagtcgtagcgtctagtaacgttntttacgnttaattttacgtactgtactcgaccgttacgtcgaactacgtccgacccttaccggttccggcccgtacggaccacggtacctacgggaacctaacgaccgtaaacgtaggtcggtcgaccgtgacctaccgtacttagtttcgttctcttaccccg

SEQ ID NO: 229466 - DNA, 795 bp, Homo sapiens
  misc_feature: GYAE6OF01CVWLR.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtgttcttcctcctgcgtggtggcgctcccaggaaggtcctgtcccatttccagttgcgtgaggtccgggcccaggctggtgaacgcccgtggcggacgtaccctcgtccctactatttgctcgtgttctcgtggtcaccttccttacaagtaacagtagttattattagtcggctggtactccgcgaccgacccgagggaacgcgccgtgggtacggttggtcgacgtagtactacctattacgtcgtacggtaccggtaccccgtaaccccttactacctaccgttcccgtacccgtacgtacggtacgtcgtacgtacctaaccttacgttaccgacgtcggtaccgtacccgtaacgaaaaccgtaccgtacgtacccgtcccgtagggccggtacgttcggtaccggttcgtacggtaccccggacccccggacggtacccggtacggttacccgtaagtttaccgttacggtcgggtacgggttccgggttacgtttaacggttcgtttaggttcgggttcgggttacggtacgttgttaccggttcgtacggaccgtacccggtacccgtcgggaaccgttaaccgtttaaacgggtttaccggtttacgggggttcgggtttacccggggtacgggaacccggtaaccggggtacccgggtaacccggttacccggg

SEQ ID NO: 229467 - DNA, 733 bp, Homo sapiens
  misc_feature: GYAE6OF01EFZMW.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctccagaagggtcctgtcccatttccagttgcgtgagtcgggcccaggactggtgaagcctgcggacgaccctgtccctcatttcgcttctgtcctcgtggtgaccttccttacaagttaaacactaagtatttattagttcgggcctggacgtccggcacgaccccgagggaacgacgccgtagggtacgttgggttcgacgtagttacgtcctaattagtcgagtcgggacccgtaacccccttcgtaacctacgtttcccgtcctacgagtacgtacgacgtcaaccctatttccgacgtacggacgtaccgtaccgaaacgaaccgtacgtaccctccgtaggaacggtctacgggtcggttccgtacggtcccggaacccccggcgggaaccgtaccgggtaccgtttaagttacgtttacgttacgggtccgggtacgggttacgtttaggtcctaggtttcggtcgggtttggacgtagttcgtacgttcacctaccgtacccggtcgtaccgtaacttaagtttacggttaacgggtcgggttacgggttacgggaccgaacgggtaccgggacccggttaacccggg

SEQ ID NO: 229468 - DNA, 665 bp, Homo sapiens
  misc_feature: GYAE6OF01AHMFY.24.37.D04.1.454.CMB.1.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanagcccaccctctcctgcagggccagtgacatgtaggagttgtagcctggtatcaacacaaacntcggccaggcctccccggctcctcatctatgatgcatccaagtacgggccacgtggctacgtcccagactaggttcaggtggctaggtcgggtctgggactaggtacttcacgtctacacctatccgagtcgtaggttcgtacggacgtaccgttaaggtaagtttagttttacgacctttaaggttttaacttaccgtgttacaacggtcctaacccggtagtaacccgtaaccggttccggtacccccgttacggttttaccccgggacccgttacgggacccgtaacggtaccgtacgggaaacctaccgtaacccgtaaacggtacgttacgggtacgtaccgtaccggaccctaaccgttacgttaccgttccgttcccgttccgttaccccg

SEQ ID NO: 229469 - DNA, 617 bp, Homo sapiens
  misc_feature: GYAE6OF01CHCX9.24.37.D04.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (384)..(384): a, c, t, g, unknown or other
  misc_feature (384)..(384): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggctcccagatgccaccggagacattgtgttgacacagtctccagccaccctgtctttgctccgaggggaaangccacctcncctgcagggccagtgactagtgttaaggagttgttagccgtggtactcaacaacaaacatcggaccaggcctcccggctcctcatcctatcgatgcatccaagtacgggccactggacactcccagactaggttcagtggctaggtgggtctgggacagacttcacttccncaacctatcgagctaaggtgaagcgtcgtagaacgttatttgacttaagttttactacgtcgtacgtaacgaccgtaccgtacgaccgtaaccggttcccggtaccccttaccgtttccggaccccgtacgggaccctaacggtaccgtacgaacctaccgtaacccgaaaccggttacgtcggtcggcctaccggaccaacccgttcttacttccggttctccgttaacccg

SEQ ID NO: 229470 - DNA, 795 bp, Homo sapiens
  misc_feature: GYAE6OF01DGEJ8.24.37.D04.1.454.CMB.1.raw
  modified_base (204)..(204): a, c, t, g, unknown or other
  misc_feature (204)..(204): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccacgccaccctgtctttgtctccgaggggaanacgccaccctctcctgcgacgggccagtagaactaagttggttaaggtaagtttggttacgccgttaggtactacaaacaacaaaactagtcggaccacgggtccctcccggtctccctactacttcctaagtgaacttgacctaactacccgtaaacggtaccggggtacccaacggttcgggaaccctaaccgttacccccgaaaggtaacccggttaagggtttaccgtaacgggttcggggtaccggtaaggggttccgggggttaccggtacggggtaacctaacggttaaccctttccgtaacccttccctaaccaacccgtacgttaccgaacggtaccgtagggttaacgtaacgggacgtaccgttaagggtaaacgttttacgtttacgtacgttttaagttttacgtttacgtcggtaaccacggtaccttaaccggtaacgtaaccgtaccggttaccggtccccgttacggtttcccggacccggtaacggaccctaacggtaccgtacgaaccctacgtaaccgtaaacggtagtcggtcgctaccgactaccttcttacttcgtccttcgtacccg

SEQ ID NO: 229471 - DNA, 914 bp, Homo sapiens
  misc_feature: GYAE6OF01AVLFG.24.37.D04.1.454.CMB.1.raw
  modified_base (200)..(200): a, c, t, g, unknown or other
  misc_feature (200)..(200): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccacggagtaaattgtgttgacacagtctccaggcaccctgtctttgctcgagggganagacgccaccctctcctgcgagggccaggccggtagtgttaaggtaagtacgttaggcttacggtaaccaaacgaacgtaaaacccgttcggaccacgggccttaccccgagggtcctccctacctattaccttagtaggacttcggtccttacccgaaaccggtacggggttccaaccggtttccgggccccgttacccccccggctaaccggggttttaccaacgggtttcgggaccgtacgggttcgggggtaccgttaggggaaccctaaggtaaccctttccaacccgtttctacccgaaccccggttcacggtccaacggacccttaacggaccgtcccgttaggttaaaccggtttaagttttttccgggtacccgggtttttaacttaacgttcggttaccaaacggtccgtaacgggttcccggtttacccccgccgttcggggtccccgttaaccgtttaaacccgggttttccgggggggacccgggggggtaaacctacgggggggtaggtaacggggacggggttaaccggaaaccgggtacggttaggggtccgggtaccgtacgggtacccgtaacccggttaacgttcccgttttacgggtttcccctttaaccgggtaccctttttccccccgggtttaacccccgtacccggttaaaccgttttcggaaaaacccgtttaaacccggttaaagggg

SEQ ID NO: 229472 - DNA, 734 bp, Homo sapiens
  misc_feature: GYAE6OF01D55B1.24.37.D04.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagactactatgtcacgaccggtgctcgatttagtagcatactgttgggtttgggggaggaactgctcagttaggacccagagggaaccatggaagcccagctcagcttctcttcctcctgctactctggctcccagatgccaccggagacattgtgttgacacagtctccagccacctgtctttgctccgaggggaaangccacctctccngcagggccagtgacaagtgttaggagttgtagcctgtatcaaacacaaacagtggccaggcctcccggctcctcatctaatcgatgctaatacccaaagtacgggccctaacgtgggcaactccccgaaggacctagggtttccaaggtggaccgaagggttcgggtacgtacggggaactaacggtactttaccactttcaccaacccgaattaccgaagaccgtaaggttacgtaacggtaacggtacccgttaaggtaaagttacgtttttagacgtttaagtttttaacgttaacgttcggttacgacggtaccgaaccgttacggaaccgtaaacccgttcgggtacccccgtttaaacggttttcccgggaccccgttacggggaacccgtaaggtaaccggtacgggtaaacctaacccttaaacccggaaaacccggttaaacgtcgggttacggaccgttacggaacccgtaaccctaacgtttccgttaccgttccgttacccttaacccg

SEQ ID NO: 229473 - DNA, 753 bp, Homo sapiens
  misc_feature: GYAE6OF01CHDW7.24.37.D04.1.454.CMB.1.raw
tcagactactatgtcacgaccggtgctcgatttagtagcatactgttggggtttgggggaggaactgctcagttaggacccagagggaaccatggaagccccagctcagcttctcttcctcctgctactctggctcccagagaccacggagaattgtgttgacacagtctccgggcaccctgtctttgtctccgaggggagagacgcccaccctctcctgcagggccaggcggagtgttaagtaagtacgttaggctaggtaaccaacgaagaaaccgtggaccaagggcctcccgaggccttcctactactctagtggacttcggtcctacgaacgtcgggtcacgtcggcccgtcccggcgtaggttccagggtcggacaggggttcggtacgtaggggaacagtacctttaccgaacttcccaaccgaccgttacgaacggccgtacgggtaccctaaggaccgtaccgttaaggtaacgttaggttttacggttacggttttaacttacgttgtacgacggtacgacgtccgttaccggtccgtaccgggtccgttaccgtttacgggtttcggggacccggggggtaacgggtaggggtacgggaacgggtaggggaacggtaacgggtacggtacggtacgggtaccgtcggaccgtaaccgtacgttccgttccggttcttaccgtcccgtttccccgttaccccgtccgtacttaccgtaggtaacttacggttaacggttacgg

SEQ ID NO: 229474 - DNA, 845 bp, Homo sapiens
  misc_feature: GYAE6OF01CQ9LO.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtgttcttcctcctgctggtggcggctcccagaacgggtcctcgtccctatttccagttgcgtgacgtcgggcccaggactggtgaacgcccgtcggacggaccctcctccgtcctattcgttctctgtcgtctcgtcggtacctccttactacgtaactaacatagttacttaagttcggtcggtcggtacgtaccggtccgaccgtaccccgaaccggaaggtacgccggtacggtaggttacggttcggtacgtacgtagtacctacttactacgtacgtacggtaccgtaacccccttacctacgtaccttacccgtccgtcacggacgtacgtacgtaccgtacctacttcgtacgtacggaccgtaccgtaccgaaacgtaccgtaacgtacctaccgtcggtacggtccgtacggtcggtccccggtacggtcccggtaccccgggaccccggaaccgggtacccggaccggttaactaacgtttccgttaacgggtcggttaaccgggtcggtttaacgtttaccgggttacgtttacgggttcggttacgggttacgtaccggtttacggtccggttacccggtcgttaaaccccggtcccgggtaaccccgttacgggtacccgtttaaacggtttaccggtttaacgggggttaccgggttccggggtttacggggtacccggttaccgggaaacgggttccccgggtacccggtaacccggg

SEQ ID NO: 229475 - DNA, 614 bp, Homo sapiens
  misc_feature: GYAE6OF01CEP16.24.37.D04.1.454.CMB.1.raw
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanagccacctctcctgcagggccagtgactagtgtaggtagttgtacgtcgtgtactacaacaacaaacngtcggaccgacggtccctcccggctcctctacttctagtgtatcgactactaccgtaaggccggccacggtcgacacctacccgagtacggtagttacgaggtcgacgtagggtcggtgaggacacgtctactactctaccactancgacgngtaggtagacgtacgtacgtagtagtttacgtttcgtactttaagttttactacgttcgactacgtacgtacgtacgaaccgtacggtccgtacccttacggttcccggaccgtacggaccgtacgcgtacgactacgtaccgaacgtgtcggcgtccgtacgaccgtctacttctacttcctctacccg

SEQ ID NO: 229476 - DNA, 984 bp, Homo sapiens
  misc_feature: GYAE6OF01CLY7M.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggcctcccagatcgccaccgggagactattggtgttgacactagtcctaccacgccctacccttgttcctttgtcctaccggaaggggaaacgaccgcccctaccccttcctccgtggaccgaacgggggaccagtagaactaagttaggttaaggtaaggttttggttaacgccgttaggttaactaccaaacaaactaaacgtacgtcgggacccgaacggtcccgtaccccggtctccgtaccacttacctatacgtactagcctaacgtaccctaaggtacgggacctaacgtacggtacctaaccgtacccgaaggtaccgtaacgggtttaccgacgggttgggaaccggttacggggttggggttaccggtaacgggtaaaccgtacggttaaccctttacccgtaaccttaccgtacctaacccgtaagtacccgtaacggtaccgttaagggttaacggttaaccggtacggttaacccgtttaagggtaaacgttttaagttttccgggttaacgttttaaacgtttttaacgtttaacccggtttacggttaacccgtaacggtaccccggtaaaccggtttaccgaaaccccgggtttaaccgttaccccggggttaacccccgttttaacccggggtttccccgggtaaccccggggtttaaccggggacccgttaaacggttacccggtaaccgggtaaaaccccgttaacccgttaaaccccgggttaaaaccggtaacccggtttacggggtacccgggtacccgtttaacccgacccgttaaccccgtttaaacgttccccggttttaacgtttccccgtttacccgttaaccccgg

SEQ ID NO: 229477 - DNA, 760 bp, Homo sapiens
  misc_feature: GYAE6OF01D522B.24.37.D04.1.454.CMB.1.raw
tcagactactatgtcacgaccggtgctcgatttagtagcatactgttgggtttgggggaggaactgctcagttaggacccagagggaaccatacggaaaccccagcgcagcttctcttcctcctgctactctgctcccagccatcgacggagtattgtgttgacgcagtcctccgaggcctacccttgttcttttcgtcctaccggaggggagacgaccgccctaccctcgtccgtgccgacgggacctaggtcgacggtagttagttacgacgacgcgtacgtacctttacgttacggccgttacggtaccacgaccgtaaccgtaaacccgtcggtaccgtcggtcccgtcccgacggtccctccgtactacgttcgttacggttcggtaccggtccgtacccgaccggacggtcccgtacggtcgggtacggtaccgggaccggtaccggttacgggttacgacggttacgggcgttagggtcggttacgtttagggtaacctacggtaccttacctacgttcctacgtataccgtagtacgacgtacgacgtacggacgtacgtacgttagttcgtacgtagttacgttacgttcgttacgtcgtcgttcgtttcggtttcgttccgttaccttccgttacgttacgttacgtttacttacgtttcgtacggttacggttaccgtacggacgttttttacggacgtacgtacgtacgtacgtacgtcggtcgtacgtacgtccgtacgtcgttacg

SEQ ID NO: 229478 - DNA, 723 bp, Homo sapiens
  misc_feature: GYAE6OF01B6BVX.24.37.D04.1.454.CMB.1.raw
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (435)..(435): a, c, t, g, unknown or other
  misc_feature (435)..(435): n is a, c, g, or t
tcagactactatgtcacgaccggtgctcgatttagtagcatactggttggggtttgggggagaaactgctcagttaggacccagagggaaccatggaagccccagctcagcttctcttcctcctgctactcgtggcctcccagatcggccaccgggagaccattggtagttgacacagtcctccagccaccctgtcttgcctcgaggggaancgccacctgacctgcgagggcctagtgaacaagttggttaggagtttgtaagcctaggtatacaacaactaaacngtacggccaagggccctaccccggtctaccgttacagttaccgtatggtaactgacctaccgttacgaaacgtaggggtccccagttgggacccaacgtacccccgaagtacgacggtttcgaaggttcgacgtacgggtcgggtacnggggaacctacgtaccttcgaaccttccaacgaccctagtaccagacgtaggtactaacggacgtacccgtaaggttaacgttacgtttgaacgtttaggtttataaccgtttcgataccgtacgtaccgttaacgccgtaaccggttcgtaacccccgtacgttcccggtacccgtacggtacccgaacggtccgtaagacccgttaaccaacccggaaacgtcccggtttaggcccggtaccaacggttccacccgttatcccgttcgttaccgttccgttacccg

SEQ ID NO: 229479 - DNA, 952 bp, Homo sapiens
  misc_feature: GYAE6OF01CAXM3.24.37.D04.1.454.CMB.1.raw
  modified_base (222)..(222): a, c, t, g, unknown or other
  misc_feature (222)..(222): n is a, c, g, or t
tcagactactatgtcacgaccggtgctcgatttagtagcatactgttgggtttggggggggaaatgctttctgagactcatggacctcctgtgcaagaacatgaagcacctgtgttcttcctcctgctggtggcggctcccagaagggtcctgtcccatttccagttgcggtgagtcgggcccaggactgggtagaagcctggcggacgacccctgtccctntattttcgccttctgtcctcgtggtacaccttccttacaagtaaaccacgaagttattttaagtttagttcgggtccttagggtaacgtcccggacctaccggacccccgaaaggggaacgacggtaccggttagggtaggtttgggtacggacggtacgttaactacctaagtttactcgtaacggttccgggtaacccgtaaaccccccttttactaaccgttaaccgtttccccggttaccccgtacggtaaacggtaccggttaccggtacgttaaccctacccgttaacgtttaccaacggttacgggaaccgtaccccggtaaacccaaaacggtaaacccgttaaccggttaacccgttaccccggttaaccgggtccgttaccggggttcccgggttacccgttaccgggtacccccggtaaacccccccgggtccgggtaaacccggtacccgggtttaacccgttaacgttttaaccggtttaaccggtttcggggttaccgggtacccggggtttaccggtttaacgggttaaccgtttaagggtttttcgggtttacggggtttaccgggtaacgttcggttcgttacccggtacgtaccgtaaccccggtaccggtacccgtacgtaacgtttaacgtttaaccgggttcggggttaccgggttacgggttacgggaccgtaaacgggtacccgggtaacccgtaccggtaccccgg

SEQ ID NO: 229480 - DNA, 970 bp, Homo sapiens
  misc_feature: GYAE6OF01EHXGK.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccaggagggtcctgtccctatttccagttgcgtgaggtccgggccaggacgtgggtagaacgccgtggccgggacgtaccccttcgtccctctattttcgcttctgtccttcgtggtacgtacctttccttacgaacgtaacacgtaagttaattttagtttaggttacgggtcccgtagggtaccgtcccgggaccgaacccggaccccggaaagggggaacgtacggtccggtaggggttacggttttcggggtttacggacggttaacggttaaccttaccttaagttttaaccgtaccggtaacggttacccggggtaacccccgttaaaccccccttttctaacccgttaccgtttccccgtacccgttacggtaaggtaccggtaccggtacgtaccctaacccgttacgttttaccgaacgggttaccgggtacccgtaaccccggtaaacccgaaaaccggtaacccgtaaccggttacccgttaccccggtacggtaaccgggtccggttaccgggttccccgggttaccgttacccggggtaacccccggtaccccccgggacgggtaaaccccggttacccgggtaccgtttaacggtttaccggtttacgttacggggtaccgggttccgggttaacgtttacgggtaccgttaggtttacgggtttcgggtttacggacgtttaacggttcggttccgtacggtccctaaccggtacccggtcgtaaccgtacgtttaaacggttttacgggttagggttccggggttacgggttacgggaccggtaaccggggtaacccggtacccggtacccggg

SEQ ID NO: 229481 - DNA, 829 bp, Homo sapiens
  misc_feature: GYAE6OF01DAXQR.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgtgacacagtctccagccacctgtctttgtcctccgaaggggaaagacgcccaccctctccgtgcgacgggccagtgaactaagtgttaaggtaagttgtagctaggtatacaaacacaaacatacggaccacggtccgtaccccgggtctacccgtactactaccgttatacggtaattcggacctaacgttacccaaacggttaccggggaccctaacgttacgggaccctaacgtacccccgaaaggtaaccggtaggttaccgtagggttacggcggtaacgggttcggggtacgttacggggaactacggtaacctttccgaccgttactacccgacctaacgtaccgaagtccgtaaggttacggtaacggtacggtacccgtttaaggtaaaggtttacgttttacggtaacgttttaaggtttttaacctttaacgttcggttaaccacggttacccgtaacccgggttagaaaccctaaccggtttccccgggtaaccccgtttaccgtttccccgggtaccggttaaccggggtaccgtaacggtaaccggttacggaaacccgttaacgtaaccccggtaaaacgtcgtacgggttaccgaccgttaccgggaacctttaccccgtagttacccgtttcggtacccttttccgtaaccccg

SEQ ID NO: 229482 - DNA, 593 bp, Homo sapiens
  misc_feature: GYAE6OF01A9SME.24.37.D04.1.454.CMB.1.raw
  modified_base (201)..(201): a, c, t, g, unknown or other
  misc_feature (201)..(201): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgctccaggggaaangccacctctcctgcagggccagtgacaatgtagagttgtagctggtatcaacacaaacatggccaggcctcccggctcctcatctatgatgcatccaagtcggccactggcatcccagactaggttcaggtgcaggtcggtctagggactaggtacttcgacttccacgaccatcagtcgtaggttcgtaagacgtaccgtagtaacgttacttttggacttaaggttttattaccgtcgttaccacgtacaaccggttgaaccgtaaccgtcggaccccttaaccggtttcccggacccgttacgggaccctaggtaccgtacggacctaacgtacccgaaacgtacgttggtaccgctcgacctacgtactaccttgttccttcgtaccg

SEQ ID NO: 229483 - DNA, 761 bp, Homo sapiens
  misc_feature: GYAE6OF01E3X3X.24.37.D04.1.454.CMB.1.raw
  modified_base (170)..(170): a, c, t, g, unknown or other
  misc_feature (170)..(170): n is a, c, g, or t
tcagactactatgtcacgaccggtgctcgatttagtagcatactgttgggtttgggggaggaactgctcagttaggacccagagggaaccatggaacgccccagctcagcttctcttcctcctgctactctgcctcccagatcgaccgaccggagctattgtgtgacacngtctcagccctacctgttctttgctacggaaggggaacacgccctacctcgtcgtcggcgacggtccagtacgaactaagtggttaaggtagtttggttacgccgttaggtaactacgaaaccaacaaacgtacgtccggaaccgtaccggtaccccgtccccggtccttcctacctattacttagtacgtataccgacctaaccgtaacgtaaccgggtaccggacccgtacgtcggacctaaccgtaccccgaaggtaccggtacgttacgacggtacggtacggttacggggtacggttccgggttaacgggaaccttaacggttacccctttacgaccttcccgactacgtactcgaacgtgtagtacggtacgtactacgtaaggttacgtttagtttacgttacgtttaatttacgttcgttacgtacgtaccgtacgtaacgacgttaacgtaccgtacccgtaccttacgggttccctacggacgtaccgtacggacgtacgaaccgttacgtaacgaaccgttgtacgggtacaccgtaccgtcgaaacctttcctacggtttccttccgttaccgttcccg

SEQ ID NO: 229484 - DNA, 738 bp, Homo sapiens
  misc_feature: GYAE6OF01C9MXZ.24.37.D04.1.454.CMB.1.raw
  modified_base (417)..(417): a, c, t, g, unknown or other
  misc_feature (417)..(417): n is a, c, g, or t
tcagactactatgtcacgaccggtgctcgatttagtagcatactgttgggtttgggggggaaatgctttctgagactcatggacctcctgtgcaagaacatgaagcacctgtgttcttcctctgctggtggcgctccagaaggtcctgtcccatttccagttgcgtgacgtcgggcccaggactggtgaacgcctggccggacgacccctgtccctcattttgctctgtctcgtggtcgacctccttcaagtaacacagtattattatggcctggatccgcacgcccagggaacgagccgtggtagtttggttgacgaggttactccaatttactacacgtcgggtacccgtaaacccccttctaacctacgttcccgtcctcgagtacgtacgacgtacaactacttcactggacnccgttacaaacgaacctacgtacctcccgtagaacggtcgttggcccgttccgtggtacccgaccccccggcggtaacccgaccgggtaccgttaattacgtttaccgtcggttcggccgggttaccttttaaggcccgttaagtttcgggtcgtttacgggtacgttacttcgggttaccttacggacccgttaacccgtacccgggcccggtacgtaaccgttaaactttaaccgggttttaaccgggtttggggttcccggggtttttaacgggggaccttaaccggggtaaaccgggtaccccggttaaacccgggg

SEQ ID NO: 229485 - DNA, 564 bp, Homo sapiens
  misc_feature: GYAE6OF01A84CO.24.37.D04.1.454.CMB.1.raw
  modified_base (204)..(204): a, c, t, g, unknown or other
  misc_feature (204)..(204): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanacgccaccctctcctgcagggccagtgacaatgttaaggagttgtacgcctggtactcaacaacaaacagtggccaggcctacccggctcctcatctatgatgcatccaagtcgggccacgtgcactcccagactaggtcagtggcagggtggtcgtgggacaggacttacactcctacaccatcagcagtgtagacgcctaggaattagtttgacttaagttttacttaacgtggtacacgactaccgtcgaactaaccgtcgaccccttacgttcccggcccgtacggaccagacgtcggacactaccgaacgtaagtcggtcgacctgcctaaccacttcctcgttctccgtacccg

SEQ ID NO: 229486 - DNA, 747 bp, Homo sapiens
  misc_feature: GYAE6OF01EE6NT.24.37.D04.1.454.CMB.1.raw
  modified_base (202)..(202): a, c, t, g, unknown or other
  misc_feature (202)..(202): n is a, c, g, or t
  modified_base (277)..(277): a, c, t, g, unknown or other
  misc_feature (277)..(277): n is a, c, g, or t
  modified_base (565)..(565): a, c, t, g, unknown or other
  misc_feature (565)..(565): n is a, c, g, or t
  modified_base (705)..(705): a, c, t, g, unknown or other
  misc_feature (705)..(705): n is a, c, g, or t
  modified_base (717)..(717): a, c, t, g, unknown or other
  misc_feature (717)..(717): n is a, c, g, or t
tcagactactatgtcacgaccggtgctcgatttagtagcatactgttgggtttgggggaggaactgctcagttaggacccagagggaaccatggaagcccagctcagcttctcttcctcctgctactctggctccagatcgccaccggagacatttgtgttgacacagtctccacgccacctgtctttgtctcgagggaaancgccacctctcctgcgacggccagtcgaactagttgttaaggtattgttacgctaggtactacaacaacaaacgngtcggacctacggccgtcccggtctcctactacttacgtactagagtcgtactacctacgtaacggtaccggacctacgtacggaccctacgtaccccgaaggtaaccgttagggtttacacgggtacgggtacgtacggggttcgggtccgtaaggggtacctaacggttacttaccgacctttccgaacctacgtaacgtcgtacgtaccggtaagttaggtaacgtaccggtcggttaaagttaaacgtttgtttaacggtacttttaaggtttactttaccgtntaacggtacgtccctaacgtacgtaaccgtaaccgttcccggtacccgttaccggttcccgggaccgttaccgggaccttaacggtaccggtacgtaaccctacggtaacccgtaaccggttaacgtcgggtcgtacccnctaacccgtacnccggtttacttcgttccctctttaaccccg

SEQ ID NO: 229487 - DNA, 654 bp, Homo sapiens
  misc_feature: GYAE6OF01B2U1N.24.37.D04.1.454.CMB.1.raw
  modified_base (206)..(206): a, c, t, g, unknown or other
  misc_feature (206)..(206): n is a, c, g, or t
  modified_base (422)..(422): a, c, t, g, unknown or other
  misc_feature (422)..(422): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgttctttgtctccgaggggaaancgcccaccctctcctgcgacgggccagtgacaagttggttaaggaagtttgtagcctggtatacaaacacaaacagtcggaccgaggcctccccggctcctcatctatagtatgctataccaagtacgggccacgtggacactcccgaagacgtacggttacgagtcggactagggtcggtcgtagggactagtactttcgactcctaccaacctntaccgacgtcgtacggttagtacgacgtacctaggtaagttaagttttcggtactttaggttttactaacgttcgtactacggtcctaaccggttacgaaccgtaacgtccggtaccccttacggtttacccgggacccgttacgggacctacggtacgtacgaccgtaccgtaaccgaacggtacgtcggtcgtcgtaccgacctcctagtcccttcgttctccgttaccg

SEQ ID NO: 229488 - DNA, 710 bp, Homo sapiens
  misc_feature: GYAE6OF01DE0PU.24.37.D04.1.454.CMB.1.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (461)..(461): a, c, t, g, unknown or other
  misc_feature (461)..(461): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggagactattgtgttgacacagtctccagccacctgtcttgtctcgaagggaanacgccacctctcctgacaggcctagtcgaacagttggttaaggaacgtttgtacgtcctaggtactacaacaacaaacngtcggaccgaggccctcccggactccgtcatctaagtgactcgctaactaccgaaggtacggaccctacggtacggcctaaccgtcccaaggtacgtacggtttaccgagggtacggtacggtaggggtcgggtttaccgacggggtaacctacggttaccgttttacccacgtttaccnccctaaacgtagttaccgacgtacgtaggtacgtagacgtacgtaagttaacgttgttttacgacgtttagtttaacgtaccgtttaggtcgaacgtaccgttaaccgtagtaaccgaaccggttccgaacccgtttaccggttacccggaccgttaccgggacctaacggtcgtaacgaccgttacgtaaccgaaacggtgtcgcggtactacggtaccacgttctaccttcgttaccttcgtacccg

SEQ ID NO: 229489 - DNA, 675 bp, Homo sapiens
  misc_feature: GYAE6OF01BLB67.24.37.D04.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggctggtgaagcctgcgganaccctgtccctcatttgctctgtctctggtnacctccttcagtaacacagtattattattggccgtggatccggccacgccccgagggacgagtccgtggagttggttagcggagtactcgtattatcagtcggaccgtaacccccttctacacttcccgtcctcgacggagtcgtactacacctactttcacgtgacgacccgtacgaacgtaaccacgtaccgtccgtacggtacggtcgtcggtcgggtactcggttcccggacccccggtccgggaaccgtaccgggtccgttaattacgttaacgtcgggtgggtccgggtacgtttacgggtactagtttggttacggtttgggccgtagttgtacgtcggtcctaccgacccggtcgcgtaaccgtaactttacggttacgggttcggggttcgggttttcggggacccgtaacggaccggggtccgtaaccggg

SEQ ID NO: 229490 - DNA, 807 bp, Homo sapiens
  misc_feature: GYAE6OF01B2LZB.24.37.D04.1.454.CMB.1.raw
  modified_base (206)..(206): a, c, t, g, unknown or other
  misc_feature (206)..(206): n is a, c, g, or t
  modified_base (262)..(262): a, c, t, g, unknown or other
  misc_feature (262)..(262): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggctcccagatgccaccggagacattgtgttgacacagtctccagcccaccctgtctttgtctccgaggggaaancgcccaccctctcctgcagggccagtgacaagtgttaggagttgttagcctggtancaacacaaacatcggccaggcctcccggctcctcatctatgatgcatccgaagtacgggcccacgtggctactcccaacgtactaggttaccaggttacggcgtagggttcggggtcgttacgggggaacctaacggtacctttccgaacccttcctaccctaacccgtaacgttacccgaacggtaccgtaacggttacggttaacgggtaaccggtaccccgtttaaaggtaaaccggtttagttttttacgtaaccggttttaaacggttttttaaactttaccgtttaggtcccgttaaacggtaccccgttaacccggttaacggtaaacccgttaaacccggttacccgggttacccccttaacccgggtttttacccggggtacccccggttaacggggtaaccccgtaacgggtacccgtaacggggtaccctaaacgtttaacccccggaaaaccggttaaccgttacgggtcgggtaccgttacgaccccgttaaccgtacgtttaccgttccgtttcccgttccgttaaccccg

SEQ ID NO: 229491 - DNA, 702 bp, Homo sapiens
  misc_feature: GYAE6OF01DEQY7.24.37.D04.1.454.CMB.1.raw
  modified_base (633)..(633): a, c, t, g, unknown or other
  misc_feature (633)..(633): n is a, c, g, or t
  modified_base (639)..(639): a, c, t, g, unknown or other
  misc_feature (639)..(639): n is a, c, g, or t
tcagactactatgtcacgaccggtgctcgatttagtagcatactgttggggtttggggggggaaatgctttctgagactcatggaccctcctgtgacaaagaacatgaagccaccttggtggtttcttcctcctgcgtggtggcgcctcccaaggaacggtcctcgtccctatttccagttgcgtgaggtccgggcccaggactgggagaacgccgtggccggacgacccctgtccctcgtatttcgcttctgtctcgtggtactaccttcctacaagtaacactaagtatttagttagttcgggcctggacgtccgacaccgacccggaagggaacgacgcggtggtaggttggtacgagtacgtactactattacgtcacggtccgggtaacccctacccctttacacctaccgttcccgtccctacggaagtaccgtacgtacgtacccacttacgtttccgaacgtcgggacccggtacccgtaacccgaaaacggtaaccctacgtaccccgttccgaggtaccgcgttcgggtaccgttcgtaccggacccgaccccggacgaccgtaccgtacgtatacgttcgtacgggtcgtacggttctaggacttcgttggtcgtggacgtntcgtcncgaccacgtaccggcgtacatagttacgttgggtcggtacgggtcgacgacgcgtaccgtacg

SEQ ID NO: 229492 - DNA, 864 bp, Homo sapiens
  misc_feature: GYAE6OF01C9B64.24.37.D04.1.454.CMB.1.raw
  modified_base (184)..(184): a, c, t, g, unknown or other
  misc_feature (184)..(184): n is a, c, g, or t
  modified_base (247)..(247): a, c, t, g, unknown or other
  misc_feature (247)..(247): n is a, c, g, or t
tcagactactatgtcacgaccggtgctcgatttagtagcatactgttgggtttgggggggaaatgctttctgagactcatggacctcctgtgcaagaacatgaagcacctgtgttcttcctctgctggtggcgctccagaggtcctgtcccatttccagttgcgtgagtcgggcccaggctggngaagcctggcggacgaccccttgtccctctatttcgcttctgttctcgtggtcacctccttanaacgtaacacgagtatttattagttcggcctaggacgtccggcaccgacccgaagggacgcgtccgtggtacgttggtcgacgtagtactacctatttacgtcgtacggtccggtaccccgttaacccccttcgtaaccttaccgttacccggtacccgtacggtaacggtacgtacgtacgttaccctaccgttactttccgaacggtcggaccgtacccgtaaccgaaaaccgtaacccgtacgttaacccgtcccgtaggtaccggtcgtacgggtcggttcccgtaccggtaccccgggaaccccccggacgggtaacccgtacccgggttaccgttaagtttacgtttacccggtgggtccgggttaccgggtttcgttaacggttcgttaggttttcggttacgggttacggtaccggtttagttcccggttacggtcccggtaccccgttaacccggttacccgggtaccgtaacccggtttaaacgtttaaaccgggttttttacgggtttaacccggggggttacgggggttttaccgggggtttacccggggaaaccccgttaacccgggggaacccgggttaaacccccgggtttaacccccgggg

SEQ ID NO: 229493 - DNA, 884 bp, Homo sapiens
  misc_feature: GYAE6OF01DR81H.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtgttcttcctctgctggtggcgctccagaggtcctgtcccatttccagttgcgtgaggtccgggcccaggactggtgaacgcctgcggacaccctcgtccctctatttgcttctcgtcttcgtggtcgtaccttccttactaagtaacacgtagtatttatttagttcgggacctggactcccggacaccgaccccgaagggaagacgtccgtggtagtttggtcgacgtacgtactccgtaatttacgtacgtaggtaccgggtaacccctaaaccccccgtttctaaccgtaccttttccccgtacccgttacgacggtacgttaccgacgttaccctaaccttaacgttttccgaccgtcgggtaccgacccgttaaccaaaacggaaacccgtccgttaccgttaccccggagtaacgggtccgtacggtcccgggttacgtacccgggtacccggacccccccgggtacgggtaacccgtaacccgggtacccgtttaacttaacgttttaccggacggttccgggtaacccgggtttacggttttaaccggttaccgttttaacggttttcgggtttacgggtttacgggtaccggtacggtttacgggtttaccgtaaccggtccccgttaaacccgggtacccggtcccggtaaccggtaaacgtttaaaaccgttttacggggtttaccgggttacgggggttacccggggttttacggggacccgtaaccgggtaacccgggggtaaccccgttaacccgggg

SEQ ID NO: 229494 - DNA, 566 bp, Homo sapiens
  misc_feature: GYAE6OF01DMLT7.24.37.D04.1.454.CMB.1.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (440)..(440): a, c, t, g, unknown or other
  misc_feature (440)..(440): n is a, c, g, or t
tcagactactatgtcacgaccggtgctcgatttagtagcatactgttggggtttgggggggaaatgctttctgagactcatggacctcctgtgcaagaacatgaagcactgtgttcttcctctgctggtggcggctcccagaaggtcctgtcccatttccagttgcgtgagtcgggcccaggactgggtgaagcctgccggagaccctgtccctnatttgctctgtctcgtggtnactccttcaagtaacacagtattattattgggcctggatccggcacgccccagggacagcctggagttggttgcgagtatccattatcatcgggaccgaacccccttctactacttccgtcctcgagagtcgacgtcaacctattcactggacgtccgtacaacgaaccagtactcccgtgacgctggcgtctcgtacgccccgnggacacggcgtatattactgtgcggtcttaggtctagttggtgttgggcgtagtgtctgctacaccgcgcgacttaacttacgttaggtcgggtcggtttacgggacacggcggaccgtacccggg

SEQ ID NO: 229495 - DNA, 837 bp, Homo sapiens
  misc_feature: GYAE6OF01APSK5.24.37.D04.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (445)..(445): a, c, t, g, unknown or other
  misc_feature (445)..(445): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagactattgtgttgacacagtctccagccaccctgtctgtgtctcgaggggaaancgccaccctctccngcgacgggccagtgagagttgtggcagactaacgttacgcctaggtaccagacaacgtaaaccgtcggccacggtccgtaccgacggtccttccctcctcgtactcgtccgtcgtcctcccgaccggtccgggtccccgttggtcccgtccccgacggtcccggttagggtttccggttcggggtccgggttcgggtccgtacgggaacgttagttaccgtttaccnccgttacctaccgaaccgttactacccggacgtccccggtacccgttaccgtacgttacgttaacgtaacggttttacgttttacggtaaccttttaactttttaacgttttcccgttaacgtttaacccgtaaacgtttacgttacggttacgggttaccgttaacccggttccgggttaccccgtttaaccggtttaaccggtttacccggtttacggggtaccccgtaaaccgggggtaaacccttaacgggtaggtaaaccgtaacgttaaacccggtaaaaccggttaccggttacggggttacgttaacccgtacggtaacccctacccgttacttcccgtttaccgttacctttaccgttaccccgttccccgttaacccgtacc

SEQ ID NO: 229496 - DNA, 677 bp, Homo sapiens
  misc_feature: GYAE6OF01ED1IP.24.37.D04.1.454.CMB.1.raw
  modified_base (601)..(601): a, c, t, g, unknown or other
  misc_feature (601)..(601): n is a, c, g, or t
  modified_base (634)..(634): a, c, t, g, unknown or other
  misc_feature (634)..(634): n is a, c, g, or t
  modified_base (655)..(655): a, c, t, g, unknown or other
  misc_feature (655)..(655): n is a, c, g, or t
tcagactactatgtcacgaccggtgctcgatttagtagcatactgttgggtttgggggaggaactgctcagttaggacccagagggaaccatggaacgcccagctcagcttctcttcctcctgctactctggcctcccagatcgccaccggagactagttgtgttgacacagtctccacgccctaccttgttctttcgtcctaccggaaggggaaacacgccctaccctctccgtgacgacgggaccagtagtaactaagttggttaaggtaagtttggtaacgtcgttaggtactaccgaaacaacgaaaacgtcgtacggaccgaacgggtcccctcccggtctccgtactacttcgttatagtatacgactaacctaccgtaaggtccggtacccagtcgacaccgtacccgaagacggttagtcgaggtggtacgaggggttggccgtagggtacaagttaccttccacttcaccgtacacgtcgagtcgtagtagaggtactacgtagtaagtttcgttagtacttacgttttatcgtgtacacgtagacctaagtcctaaccgtcggtaccgttccggtaccgtcgtacgtacgngtaactccggaactactaaccggaatacgggtntccggtacaccggcttacgtnttaccgttatcccgtactcccg

SEQ ID NO: 229497 - DNA, 839 bp, Homo sapiens
  misc_feature: GYAE6OF01D5HE2.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtccattccagttgcgtgagtcgggcccaggactggtgaagcctgcggacgaccctgtccctcatttgcttctgtctctggtcgaccttcctcagtaacacagtattattagtggcctggtacgtcccggcaccgaccccgaagggaacgacgtccgtaggtaggttggttcgacggtagttacttaccgattactcgaacgtcgggacccgtaacccccttctacctacgttcccgtcccgtacgagtacgtcgacgtacctacctactttcaaccgtcggaccgtcccgtaaccgaaacgtaaccgtaacgttacccgttacccgtagggtaacggtccgttcgggtacccggttccgtacgggttacccccggaacccccccgggtacccggggtaacccgtaccccggggttaacccgttaacgtttaaccgttttacccgtttcggggtacgggtacccggggtttaaccgtttaagggttcccgtttaaggttttcgggggtttacggtttcgggtaacccgggttagtttccggtacccgtttcggaaccctacccggttaaccccgggtaccggtccgtaaacgtttaacgtttaacgggtttacccggggttcgggggtttaccggggtttagggggaaacccctaccgggaacccggggtaccccggttaacccggg

SEQ ID NO: 229498 - DNA, 746 bp, Homo sapiens
  misc_feature: GYAE6OF01BHYP2.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagactattgtgttgacacagtctccagccctacctgtctttgtctccgaaggggaaagcgcccaccctctcctgcgagggccagtgactaagtgttaaggtaagttggtacgccgtaggtactacaaacaacaaacagtcggaccgaggccctcccggctcctcatctatgactcgactaactaccgaaaggtaccgggcctaacgtcggactaaccgtacccgaagtaacgtaggttaccgaggtacggacgtaggggttcgggacggttacggggaactacggtactttaccgaaccgttcctaccgaaccgtacgtacgtacggtaccgtaagggtttcgaacggaacgtacgttaaaggttaagtaaaggttttattttacgtaacggtttaagtttttacgtaccgttaggtaccgttaccggaccgttaaccgggtacgtaaacccgttaccgggttcccggttaaccccttacggggtttccccgacccgggttacgggaacctaacgggacgttaaccggtaactacccgtaaaccgtaaacggtcgttcggtaccggattaccgcgtactattccgttgtccttacccg

SEQ ID NO: 229499 - DNA, 759 bp, Homo sapiens
  misc_feature: GYAE6OF01EP66U.24.37.D04.1.454.CMB.1.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgttctttgtctccgaaggggaaancgcccaccctctcctgcagggccagtgacaagttgttaaggaagttgtagccttaggtactacaaacaacaaacagtcggccaggtccctcccggctccncatctatgatcgacactaccgaagtacgggccaacgtcggactacgtacccaagacgtacggttcgaaggttcggacgtaggggttcgggtaccgtacgggggaacctacgtacctttaccgaccttacccgtaccaacctacgtaccgaagtcggttaaggtacggtaacggacggttacccgttaaggtaaacgtttagtttttacgggaaccttttaacgggttttttaaactttaccggtttacggttaccgtaacggttacccgtaaccgggttaacgaacccgttaacccggttccggtaccccctttacggtttaccccgggtaccgtaacgggaccctaacggtaccgtaccggtaaccaacttaacccggtaaacgtaccgtacggtacggcccttacggaccctaaccgttacttccgttaccgtttccgttcgttaccccg

SEQ ID NO: 229500 - DNA, 693 bp, Homo sapiens
  misc_feature: GYAE6OF01CTXS1.24.37.D04.1.454.CMB.1.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
  modified_base (437)..(437): a, c, t, g, unknown or other
  misc_feature (437)..(437): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacatttgtgttgacacagtctccagccacctgtctttgtctcgagggaancgccaccctctccgtgccagggccagtcgaactaatggttaacggaagtttggttacgccgttggttacacaaacgacaaacngtcggaccacggtccctccccggattccctacacgttcttaagtcggactcgacctaactacccgaaaggttcgggaccctaggtcggacctactacccgaggaccgtaggtcaggtggctaggtcggtcgaggcacgtactcactctcaccngtcgagacgagtgtaacgcgtaccgtagtaattctttcggactttagtttaacttcgtggttacaaccgtcgtaacccgtgaaccctacggtcccgtacccgttaccggttccgggtccccgtagggtaaccacgggtaacttcgggaaaccctgtaaccccggtaaacggtaaccgtttgggccgttaacccggtacgtaccccgttaacccttacggttccctttaacccgggtttccttaccgttaaccccgg

SEQ ID NO: 229501 - DNA, 808 bp, Homo sapiens
  misc_feature: GYAE6OF01CUEHB.24.37.D04.1.454.CMB.1.raw
tcagactactatgtcacgaccggtgctcgatttagtagcatactgttgggtttgggggaggaactgctcagttaggacccagagggaaccatggaagccccagctcagcttctctttcctcctgcttactctggctcccagatcgccaccggagacatttgtgttcgacacagttcctccagccctaccctgttcttttcgtcctaccggaagggggaaacacgcccctaccctctccgtggacgacggggcctaggtacgaactaagttggttaagggtagtttggtacgccgttaggtactaacctaaacaacaaacacgtacggaccgtaacggtccccgtcccccggtccttaccctacctacttaccttagttacggtaattcgacctaacgtaacccgtaaacggtaccgggacctacggtacgggaccctacccgtaacccgaacgtaacccggtagggttacgtagggtacgggtacgtagggggttacgggtaccggtacgggtaacgtaaccggttacctttaccgaccttacctactaacctacgtacgacgtcgtacgtaggtacgacgtacgttagtaagtttacgtttagtacgtttagtttaacgttacgtcgtaacgtacgtaccgttaaccgtacggaacccgtaaccgttcccggttaccgttacccggttacccggtaccggtaccggaccacgtaccgtaaccggcctaacctaaccggtaaacgacgttcggtcctacccggtaagtccctaccggttcttaccggttacgttccctaccgttcccc

SEQ ID NO: 229502 - DNA, 728 bp, Homo sapiens
  misc_feature: GYAE6OF01BIPFE.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccgggagacattgtgttgacacagtctccagcccaccctgtctttgctccgaggggaanacgccaccctctcctgcagggccagtgacaatgttaggaagttgtagcctggtatcaacacaacatggccaggcctcccggctcctcatctatgatcgcatcaagtcgggccacgtggacactcccgagtacaggttcaggtggacaggtcgggtctagggacacggtcttccacttcctacgacctagtaccacgtacgtaggtcgtaacggacgtaccgttaggtaacgttacgtttttacggacgtttaacggtttttaacttacgttacgtaccgtacggtacctaaccggttacgaaccgttaaccggttcccgggtaacccccgttaccggtttacccccgggtacccggttaccggggaaccccgtaacggttacccggtacgggtaaacccgtaccgttaaaccccggtaaacccggttaacggttacgggttacccgggtacccgttacccggacccgtaaaccccgttacgtttaccccgtttacggttccccttttacccgttaacccccgg

SEQ ID NO: 229503 - DNA, 761 bp, Homo sapiens
  misc_feature: GYAE6OF01BLRVN.24.37.D04.1.454.CMB.1.raw
  modified_base (305)..(305): a, c, t, g, unknown or other
  misc_feature (305)..(305): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagagggtcctgtcccatttccagttgcgtgagtcgggcccaggactggtgaagcctggcggacgaccccttcgtccctctatttgcttctgtctctggtgaccttccttacagtaaccacagtatttattagtggcctggacgtccggcacgcccgaggaagngccgtggtagttggtgcgtagtactctattatcgtacgtcgggacccgtaacccccttctaacgtacgttccccgtccgtcggacgtacgtcgtacgtaccgtaccttactttcgacgtcggacgtaccccgtaccgtaaacgaaccgtaccgtacccttcccgtacggtacgggtccgtacgggtcccggtttacgtccggtaccccggaacccccggggcccgaaccgtacccgggttaccgttaagtttacgtttacggttcgggtccgggtaccgggtttacgttacggttaccttaggtttcgggtttacggttcgggacgttgttccggtctccggtctaacccgtcccggtacggtaccctaatttacggtttaacggtttccggggttagggggttcccggggtttacgggacccggttaacggcccgggggtacccgttaacccggg

SEQ ID NO: 229504 - DNA, 711 bp, Homo sapiens
  misc_feature: GYAE6OF01DI3FD.24.37.D04.1.454.CMB.1.raw
  modified_base (290)..(290): a, c, t, g, unknown or other
  misc_feature (290)..(290): n is a, c, g, or t
tcagactactatgtcacgaccggtgctcgatttagtagcatactgttggggtttggggggaggaactgctcagttaggacccagagggaaccatggaagccccagctcagcttctcttcctcctgctactctggctccagatcgccaccggagacattgtgttgacacagtctcagccacctgttctttgtctaccgaggggaagacgcccaccctctcctggcgacgggccaggtcgaactaagttggttaggtaagttgttagccgtggtactacaaacaacaaacgngtcggaccgacggtcccgtcccggtctcctcatctatgactgacctactacccaaggtacgggcctacgtcggaccacgtcccgaagacgtaggtcgaggtcggcgtagggtcgggtacgtagggactacgtactccgtaccactaccgacctagtcgaagtacgtaggttacggtaacggacgtaccggttaggtaaacggttttgtttttacgtacgttttaagttttaacttacggtcgtaacgtaccgtaccgtaaccggtagtaaacccgtacccggtccggttaccccgttacggtttcccgggaacccgttacgggaacctacggtaaaccgtacgaacgtaccgtaacccgtaaacggtacgtgggtccgtctacgtacctacttacgttccgtttcgcccttacgttccccg

SEQ ID NO: 229505 - DNA, 844 bp, Homo sapiens
  misc_feature: GYAE6OF01AUV7P.24.37.D04.1.454.CMB.1.raw
  modified_base (280)..(280): a, c, t, g, unknown or other
  misc_feature (280)..(280): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaacgcgcccaccctctccgtcgcgacgggccagtcgacaagtggttaaggaagttgtacgctggtatccaacaacaaacngtggccaggcctcccggcttcctcattctatgagtcgctactaccgaagtacgggcctacgtcggcctaacgtcccgaagtaccgtacgggtttaccgaggtgggcgtagggttcggggacgttacggggacctaacggttaccttccgtacccttacctaccctaacccttagtacccgtaaggtacccgtaagggttacggtaacggtaacggtaccccgtttaaggtaaacgggttttaacgtttttacggtaacccgttttaaagggttttttaacctttaaccggtttaccgggtttaacccgtaaccggttaaccccggtttaaacccgggtttaaccggtaaacccgttaacccggttacccccgggttaccccctttacccgggtttttaacccccggggtaccccgggttaccggggaaccccgttaacgtacccgggtaacggtaaaccgtaacccgttaaaccccgaaacgttaacccggtagggttcccggaccgttaccggtacccgtaacccgttaaccgttctttacccggttccttaccggttacccc

SEQ ID NO: 229506 - DNA, 926 bp, Homo sapiens
  misc_feature: GYAE6OF01DG0JZ.24.37.D04.1.454.CMB.1.raw
tcagactactatgtcacgaccggtgctcgatttagtagcatactgttgggtttgggggggaaatgctttctgagactcatggacctcctgtgacaagaacatgaagcacctgtgttcttcctcctgctggtggcggctcccagaaggtcctgtccctatttccagttgcgtgacggtcgggacccaggactggtgaacgtcctggccggacgacccttcgtcccctctagttttcgaccttcgttcgttaccttcgttggtacgtaccttccctttcgaaacgttaaaccaacgtacgttaagttttaacgttttaacggtttcggggtacccgttacgggtacgttaccccgggaccgaacccggaccccccggaaagggggaaaccgacggtaccccgttaggggttaggtttcggggtttaccggacggttaaggttaaccttacccgttaagtttaacgttaccgtaacggttaccggggtaacccctaaacccccccgtttacttaacccgttaaccgttttccccgtaccccgttacggaacgttacggttaccgtacgttacccgtaaccttaaccgtttaccgacggttacgggaaccgtccccgtaaccaaaacggaaccctacgttaacccgttccccgtaggaccgggtacgtacggtacccgggttcgtacggttaccccgaccccccgggcggaaccgtcccggtaacccgttattaacgttttaccgtgggttacgggtaccgggtaccgtttaacgggtcgttacgtttgggttcgtttacggccgttagtcgttaccgtacggacccgttccgtacccggtccgtacgtaacgtttaaacgtttacggtttacgggttacgggggttccggttacggggaccctacggggtaccggtaacccggtaccgg

SEQ ID NO: 229507 - DNA, 731 bp, Homo sapiens
  misc_feature: GYAE6OF01CNAHE.24.37.D04.1.454.CMB.1.raw
  modified_base (510)..(510): a, c, t, g, unknown or other
  misc_feature (510)..(510): n is a, c, g, or t
  modified_base (698)..(698): a, c, t, g, unknown or other
  misc_feature (698)..(698): n is a, c, g, or t
  modified_base (704)..(704): a, c, t, g, unknown or other
  misc_feature (704)..(704): n is a, c, g, or t
  modified_base (718)..(718): a, c, t, g, unknown or other
  misc_feature (718)..(718): n is a, c, g, or t
  modified_base (731)..(731): a, c, t, g, unknown or other
  misc_feature (731)..(731): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagccatccgaccgggaggtaattggtgttgacgcagtcctccgaggcctacccgtgttcctttgctaccggaggggagagaccgcccacctccgtcctggcgacgggcccagtaccgagtcgttaggtcgacgagacacggtcttaacgtcggtaccgtacggtaaccagaccaaacgtaaccgtcgtccgacggtccctaccgacggtcctacctcgtactacgtgtcggtaccgccgtcccggaacggacggtaccgtacggtcggtaccggaccgtaccggaaacgttcggtacgtacggtacggtagttacggggttcgtacgggtttaccgggaactacggttaccccttacgaccttacgttaccnggtttaacaccgtaccgtaacggacgttaacggtaccgggtaaccctacggttaagttaacgttcgaccggttaagtttaccgttaagttccgtagtacgttacgttcggttttacgttccgttccccttaccgttccttacgtattccgtacgtttcggtaccgtggtaccgtcgcgtagtacgtanacgtanacgtcgagtccgancgactagtccgtn

SEQ ID NO: 229508 - DNA, 760 bp, Homo sapiens
  misc_feature: GYAE6OF01C4M7M.24.37.D04.1.454.CMB.1.raw
  modified_base (229)..(229): a, c, t, g, unknown or other
  misc_feature (229)..(229): n is a, c, g, or t
  modified_base (619)..(619): a, c, t, g, unknown or other
  misc_feature (619)..(619): n is a, c, g, or t
  modified_base (643)..(643): a, c, t, g, unknown or other
  misc_feature (643)..(643): n is a, c, g, or t
tcagactactatgtcacgaccggtgctcgatttagtagcatactgttgggtttgggggggaaatgctttctgagactcatggacctcctgtgcaagaacatgaagcactgtgttcttcctctgctggtggcgctcccagaaggtcctgtccctattttccagttgcgtgacggtccgggcccaggactgggtagaacgccgtggccggacgtaccccttcgtccccttntagttttcgccttcgttgttccttcgttggtactacccttccttacgaagtaacacgtagttatttagttacgttcgggccttggacgtccggccgaccggacccggaagggaacgtacggtccgttgggttacggtttggtcggacgtacgtactacctaattcgtacgacggtccgggtaacccccgttaacccctttacgtaaccgttacccgttccccgtacccgtacggacgtacgttacgacgttaccaccttatttaccgacggtcggaccgtacccgtaacgaaacccgaaccgttacgtacccttccggtaggtacgtcgtacgggtcccgttcgtccgcccgaccccggtacgaccggtaccgtcgtatttacgttacgnggtcggtacggttctttaacggtnttacgggtttcgtaggttcggacttagtcgttccgcgaccgtaccggccggtacgattaacgtttacggttcggttacgggtgggttacggttcgggacgacggcggtaccgtacgg

SEQ ID NO: 229509 - DNA, 885 bp, Homo sapiens
  misc_feature: GYAE6OF01CHTIA.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtgttcttcctcctgctggtggcggctcccagaagggtcctgtccctatttccagttgcgtgagtccgggcccaggactggtagaacgcccgtggccggacgaccccgtgtccctctattttcgccttcttgtcctcgttggtgtaccttccttacgaacgtaaccaacgagttaacttttagttttaacgttcgggggtacccgttgggtaccgttaccccgggccgtaacccggacccccccggaaagggggtaaacggtaccggtaccccggttaggggtacgggtttttcggggttcggtaccggttaacgttacgttaccccttaagtttaacgtcgtaacggttccggggtaccccctaaaccccccgtttaccgtaccgttacccgtttcccgtaccccgttacggaacgtacgttccggtacgtaccctaaccgttactttaccgacgttacgggaccgtacccgtaaccgaaacgtaaccgtaccgtaacccgtccgtaggtaccggtcgtcggtccgtcgtcggtccccgacccccggtcggaacccgtcggtacccgttactacgtttacgtcggtcgggtccggttacgtttacggtcgttagtttgggtttcggttacgggcgttacgttcggttcctacggtaccctaccggtacccgtccggtaaccggtaacgtttaacggtttacgggtttacgggttcgggggtttaccggttttacgggggaccgtaacgggtaccgggtaacccggttacccggg

SEQ ID NO: 229510 - DNA, 741 bp, Homo sapiens
  misc_feature: GYAE6OF01CT7PZ.24.37.D04.1.454.CMB.1.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctccagatcgccaccggtagactagttgtgtagacacgagtcctccgacgccctaccctgttcgttgtccgtaccggaaggggaaacncgcccaccctcctccgtgccgagggcctagtnaacgtagtaggttaggatttgtagccttaggtactacaaacaacaactgccggaccgaggtccccgtaccccggcttacctactactacttagtggactcgactactaccgtaaggtaccgggcctacggtcggacctaaccgtcccgaaaggtaccgtaggttacgacgggtcgacggttaggggtcggtacgacgggtaactacggttaccttacaccgtacgtaccacctacgacgcgacgtaggtacgtacgacggacttaggtaagtttcgtttacgacgttttaagtttaacgtagttcgtacgtacgtaccggttaacgtaccgtaactacccgggttacccgtacccgtaacggttccccggacgttacgggacttaacgtacggaaccgtaacctaaccgtaccggaaaaccgtcgggttacgccgggtactaccgtaccgtacccttgttaccgtccttacccgttcgttaacccccg

SEQ ID NO: 229511 - DNA, 702 bp, Homo sapiens
  misc_feature: GYAE6OF01AN7NE.24.37.D04.1.454.CMB.1.raw
  modified_base (170)..(170): a, c, t, g, unknown or other
  misc_feature (170)..(170): n is a, c, g, or t
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (592)..(592): a, c, t, g, unknown or other
  misc_feature (592)..(592): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcgctccagagggtcctgtccatttccagttgcgtgngtcgggccaggactggtgagcctggcggagacccctgtccctntatttgctctgtctcgtggtnaccttccttacagtaacacaagtactttattagtcgggccgtggacgtccggcaccgccccgaaggaagcgtccgtggtagttggttcgcgtagtactacctattacgtctacggtcgggaacccgtaaccccctttactacctaccgtttccccgtcccgtacggaacgtacggtacgacgttaccaaccttagtttaccaacggtcggtacgtcccggttaacccgaaacggtaaccctcgtaccctcccgtggacgtctacgcgtacgtcgtccggtccgaccccggacgtaccgcggtacttactacgttctcgtacggcggttacttcggtagttacgttggttcggtacggngttactggttctccgtacgtacccgtccggcgtaacgtcgttaaacgtttacggtttacccgggtggggttacgggttacggggacctaacgggtaccgggtaaccccgg

SEQ ID NO: 229512 - DNA, 811 bp, Homo sapiens
  misc_feature: GYAE6OF01BZN3D.24.37.D04.1.454.CMB.1.raw
tcagactactatgtcacgaccggtgctcgatttagtagcatactgttggggtttgggggggaaatgctttctgagactcatggacctcctgtgcaagaacatgaagcacctgtgttcttcctcctgctggtggcggctcccaggaacgggtcctgtccctatttccagttgcgtgacggtccgggcccaggactgggtagaagccgtggacggacgaccccttgtccctagtatttcgcttctgttcctcgtgggtctaccttccttagaagttaaccatagttaatttagtttaggttcggtaccgtaggacgtcccggacgaccggaccccggagggaacggtaccgtccggttagggtaggtttgggtcggacggtagttacgtacctaatttacgtacgtacggtaccgggtaccccttaaccccttactacctaccgttcccgtaccgtacggacgtacgtccggtactaccgtacttacgttacgacgtacggaccgtacccgtaaccgaaacgtaaccctacgttaacccgtccggtacggacggtccgtacgggtccgttaccgtaccgggtaccccggaaccccggacgggtaaccccggtaccgggttaccctttaaacgtttaccggttaccggttcgggttccgggtaccgggtttcgtttaacggttacgttacgttgggttcggttcggtacgtagttcgtcgtacgtccgtaccgtcggaccgttagaccgttaaggttacgttacgggttcgggtacgggttcgggaaccgtacgggtaccgggccgtacccggg

SEQ ID NO: 229513 - DNA, 745 bp, Homo sapiens
  misc_feature: GYAE6OF01CMEPF.24.37.D04.1.454.CMB.1.raw
  modified_base (154)..(154): a, c, t, g, unknown or other
  misc_feature (154)..(154): n is a, c, g, or t
tcagactactatgtcacgaccggtgctcgatttagtagcatactgttgggtttgggggaggaactgctcagttaggacccagagggaccatggaagccccagctcagcttctcttcctcctgctactctggcctcccagatcgcccaccggganactagttgtgttcgacacagtcctccagcccaccttgttctttgtacctaccgaaggggaaactccgccctaccctctcctggcgacgggtccagttacgaactaagttggttaaggagtttacgtaggcctggtaactacaaactaacaaactgtacggacctcgggtccctcccggtctcctacctacttacctagtcgactcactaactaccgaaggttaccggctacggtacgacctactacccggaaggtacccgttaggtaccgtaggtcggacgttacgggtcgggtacgacgggtactacgtacctttaccgactcgtaacacctacgtccgtagacggtagtacgtaacggtacgtacctaagggtactttaacgtttgtaaccgtttaagttttaactaccgtcgtaactaccgtacgtaaccgttgtaaaccctaccggttcccgtacccgttaacgggttcccgtacccggtacgggaccgtaccgtaacgtaccgtaacgtaccgtaaccgtaacggtaacggtttccgacgtttacgaccgacgttaccttactacgtttccgtcctaccgttcccg

SEQ ID NO: 229514 - DNA, 709 bp, Homo sapiens
  misc_feature: GYAE6OF01BJ65B.24.37.D04.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctnatttgctctgtctctggtnactcctcagtaacacagattattattgggcctggatccggcagcccccagggaagagccgtggagttggttgcgagtagtccattatcatcgggcgaacccccttctacattcccgtcccttcgacgtacgtcgacgtccacctactttccacttcgggacgcccgtacccaaaggaaccctacggttacctccccgttaggacgggtaccttcggccggtccgttcggtaccggacccccccgcggggtaacccgtaccgggcccgttaacttacgtttaacccgtggtacgggtccggggtcttttaacgggtacctaaggtttggttacggtttgggtccgtagttcgggttctacggtcctaaccggtacccggcggtaccgtactaaacgttttaacgtttacccggtcggggggttacggttttcggggggaccctaccgggacgggggtaacccttaacccggggg

SEQ ID NO: 229515 - DNA, 759 bp, Homo sapiens
  misc_feature: GYAE6OF01C331R.24.37.D04.1.454.CMB.1.raw
  modified_base (208)..(208): a, c, t, g, unknown or other
  misc_feature (208)..(208): n is a, c, g, or t
  modified_base (748)..(748): a, c, t, g, unknown or other
  misc_feature (748)..(748): n is a, c, g, or t
tcagactactatgtcacgaccggtgctcgatttagtagcatactgtttgggtttgggggaggaactgctcagttaggacccagagggaaccatggaagccccagctcagcttctcttcctcctgcttactctggctcccagatcgccaccggagacattgtgttgacacagtctccagcccaccctgttctttgtctccgagggaaangcccaccctctcctgacgaggccagtgaactagttggtaaggtaagtttggttacgccgtggtactacaaacaacaaactacgtacggacccacggtcccgttacccgggccttacctacacttccgttaagtcgaacgttcgacctaacgtaacccgtaacggtaccggtacctacggttacgacccgtaacccgttacccgaacggttaccggtaaggttacggaggttccgggaacgtaggggttcgggttaccgggtaggaaccgttacgtaaccgttctaaacccgtccttaacccgaactacgtacgtaacggtaccgtaggttacgtaacggaccggttaaccgttaagtaacggtttaacgttttaacgtcgtttaagtttttaccgttagtcggtaactaccggtaaccgtcgggtaacgaaccgtaccggtaccgtacccgttaccgtccggtacgaccggtactacggtccgtacgaccgtactacggaaccgtctcggtacgccgtacacctactactgtttaccgtnttacctacccg

SEQ ID NO: 229516 - DNA, 725 bp, Homo sapiens
  misc_feature: GYAE6OF01DJJD2.24.37.D04.1.454.CMB.1.raw
  modified_base (252)..(252): a, c, t, g, unknown or other
  misc_feature (252)..(252): n is a, c, g, or t
tcagactactatgtcacgaccggtgctcgatttagtagcatactgttgggtttgggggggaaatgctttctgagactcatggacctcctgtgcaagaacatgaagcacctgtgttcttcctctgctggtggcgctcccagaaggtcctgtccatttccagttgcgtgagtcggcccaggactggtgaacgccgtggcggacgacccttcgtccctctattttgctctgtctcgtgtcactcctcagtaacantattatagttggctggactccggctacgcccgtaagggaacgcgtccgtggtagttggtttgacgtagtactaccgatttacgtcgtacggttcggaccccgtaaccccctttcctaacctacctttcccggtacctcggtaacgtacggtaccgacgttaccaacctttactttacgaccgtacgggaccgtacccgtaaccgtaaacgtaacccgttacgtacccttcccgtaggacgtcgtcggtcggttctccggtaccggacccccggcggtaccgtacccggtccgtaattaacttcggtacgttcggtaccgggtcttaacggtcttaggtttagttcgggttgtcggtatttccggtaccgtcgaccgttacccgaccggtacggcctaacggtttaactttacggttacggggttacggggttcggttacggggactaacgggtccggggtaaccgtacccggg

SEQ ID NO: 229517 - DNA, 710 bp, Homo sapiens
  misc_feature: GYAE6OF01AWTF0.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggagacattgtgttgacacagtcctccacgcccaccctgttcctttgtcctccggaaggggaaacacgccctaccctctcctgccgacgggccagtgactaagtggttaggaagtttgtacgccttggtactaccaaacaacaaaactagtccggaccacggtccctccccggcttcccgtacctactcctagtcgtacttcgtacctacccgaacggtacgggtaccacggtcgggtaccccgtcccccggacgtacgggttaccgagggtcggtcgtagggttcggggtaccgtcggggaacctacgtaccttccaccgttcctaccgaccgtacacgcaccgtcgtagacgtccgtagtaacgttgtttcggtaccgtttactacgtgtcacgtcgaccgtcccgtccgccgtcggcccgttacgttaccgggtcgggggaccgggggtacgtagggggtacggagagggaccgtaacggtacgtgggtacgcgtacggtcccacgttcgttccttacgtccttacgcctttaccccgaccctactcgttggtaaaccg

SEQ ID NO: 229518 - DNA, 714 bp, Homo sapiens
  misc_feature: GYAE6OF01DKAPJ.24.37.D04.1.454.CMB.1.raw
  modified_base (213)..(213): a, c, t, g, unknown or other
  misc_feature (213)..(213): n is a, c, g, or t
  modified_base (321)..(321): a, c, t, g, unknown or other
  misc_feature (321)..(321): n is a, c, g, or t
tcagactactatgtcacgaccggtgctcgatttagtagcatactgttgggtttgggggaggaactgctcagttaggacccagagggaaccatggaagccccagctcagcttctcttcctcctgcttactctggcctcccagatcgcccaccggagactattgtgttgacacagtctccagcccacccttgttctttgtcctcgaaggggaacncgcccaccctctccgtgcgacgggcctagtgacagttggtaggtaagtttgtacgcgttggtactacaaactaacaaatgtacggccgacggtccctcccggcttccnctaagttctagtgacttcgactaacgtacaacggtacgggccacggttggacctaccgacccgtaggaccgtagggtttaccacggttaccggacgtaggggttcgggtaccggtaacggggtactaacggtaccctttacccgaccgttaccgttacccaaaccgtacgtcgacgtacgtaggtacgtacggtacgtacgtaggtaagtttacgtttacgttactttagtttacgttacgtacgttacgtacgtaccgtacgtacgtaaccgtaaccgtccgtacccgttcgtttacccgccgtacggactacggactacggacctaccgtaaccggtacgtacggtcgtcgaccgtagtaccctacgacttacgtcttccgtacttacccg

SEQ ID NO: 229519 - DNA, 873 bp, Homo sapiens
  misc_feature: GYAE6OF01DQ3N8.24.37.D04.1.454.CMB.1.raw
  modified_base (296)..(296): a, c, t, g, unknown or other
  misc_feature (296)..(296): n is a, c, g, or t
tcagactactatgtcacgaccggtgctcgatttagtagcatactgttgggttgggggaggaactgctcagttaggacccagagggaaccatggaagccccagctcagcttctcttcctcctgctactctggctcccagatcgccaccggagacatttgtgttgacacagtctccagcccaccctgttctttgtcctcgaggggaaagacgcccaccctctccgtgcgagggccaggtcgaactaagttggttaaggtaagtttggttacgccgttaggtactacaaacaacaaacngtacggccacgggcccgtacccggtcttccctacacgttactatggtaacttcgacctaactacccgaaaggttaccgggaccctacggtacggacctaaccgtaccccaaaggtaccggttacggttacgacgggtaggtaccggtaaggggttcggggttacggtaggggtaaaccgacggtttaaccccttccgtaacccgttacctaaccccggaaaccttacgttacccgaacggtaccgttaacggggttaacggttaacggtaaccggttacccggttaagttaaacgggttttacgtttttcgggtaaccgttttaacggttttttaaccgttaccgttacgtaccggttaacgtacccggttaaccgggtacgtaaaaccgtacccggtttccggtacccccgtttaccgggtttacccgggtccccggttaaccgggtaactaccggtacccggttagaaccccgttacgtaaccccgtaaacggttacggtacggtacccgggtaccggtactaccccggttaactaccgttttaccgttcgttacccgtttacccgttaccccgg

SEQ ID NO: 229520 - DNA, 707 bp, Homo sapiens
  misc_feature: GYAE6OF01BXOT4.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggaggaattgtgttgacgcagtctccaggcaccctgtctttgtctccgaggggagagacgccaccctctcctgcagggccagtcagtagtgttagcagcagctacttagcctaggtaccagcaagaacctggcctggcctccgaggcctcctcatcgtagtggtcgccgtccaccggacgggccctacggtcgggaccgtccggacgggaacgtacgggtttacgagggttcggcgtagggtcgggttacgtttacggggactaaggtaccctttacaccgttccttacactctaacgtaccggaactacggaccgtacgggaaccgtacccggtaagttacgtttcgaacgttaggttacgttaacttttacggtcgttaccgtagttccgttttggtttcccggtcccctttccttcccgtttaccttacgttaccgtttaccttacggttttaccggtacccgttacgggttcccggaaggttccggtacggttaacgtacgttacggaaacggtaccgtaacgttcgggtacggtacctacggccctacgttaccg

SEQ ID NO: 229521 - DNA, 675 bp, Homo sapiens
  misc_feature: GYAE6OF01A3GP6.24.37.D04.1.454.CMB.1.raw
  modified_base (505)..(505): a, c, t, g, unknown or other
  misc_feature (505)..(505): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagagggtcctgtcccatttccagttgcgtgacgtccgggcccaggactggtgaacgcctggccggacgacccctgtccctctatttgcttctgtctcgtggtcacctccttacagtaacactagtattattagttgggcctggactccggcacgccccgagggagacgccgtggtagttggttcgcgaggtactccgtattactcgagtcgggacccgtaaccccctttctacctacgtttccccgtccctacggagtacgtcgacgtcctaacctactttccacgtcggacgtccgtaccaaacgacctacgtacctaccgtgacgacgtggtccgtcgtcgtaccgacccccggaggtaccnccggtactagtacttacgtgtcggcgggttacttacggtcgtagttcggttggttcggcgtagttcgtcgtcgacctaccgtacccggcgtacgacttaaggtttccgttaacggggttcgggttccgggtttacgggacctaaccgggaccgggtcccgttaacccggg

SEQ ID NO: 229522 - DNA, 669 bp, Homo sapiens
  misc_feature: GYAE6OF01B6XXM.24.37.D04.1.454.CMB.1.raw
  modified_base (210)..(210): a, c, t, g, unknown or other
  misc_feature (210)..(210): n is a, c, g, or t
  modified_base (286)..(286): a, c, t, g, unknown or other
  misc_feature (286)..(286): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
tcagactactatgtcacgaccggtgctcgatttagtagcatactgttggggtttgggggaggaactgctcagttaggacccagagggaaccatggaagcccagctcagcttctcttcctcctgctactctggcctccagatcgaccaccggagacatttggtgttcgacacagtcctccacgccacctgtctttgtcctccgaagggaanacgccacctctccagcgaggccagtacgataagtagttaaggaagtttgtagcgttagtactacaacaactaaacngtacggacgacgacccgtcccggctacctacgactctagagtaagctactaactccgaacggtacgggtcctaaggtccgacactcccgaagtaccgtagggtactacggtcggacgttagggtaccgggttcgaagggacctaacgttacccttacacgttaccacaaccgtacgagacgtactaggtacgtacgacgtacgtagtaacttacgtttgaacttaacggtttntaccgtnttcgaacgtactaccgtagacctaacggtccgtccctacggttaccggccgtacggaactcgacgtaacgccttaaccgtaccgaacgtaaggtcggtcggccctaggtacccattaccgttaccgttcgtacctcgttaccc

SEQ ID NO: 229523 - DNA, 762 bp, Homo sapiens
  misc_feature: GYAE6OF01EGNSP.24.37.D04.1.454.CMB.1.raw
  modified_base (218)..(218): a, c, t, g, unknown or other
  misc_feature (218)..(218): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggaggctcccagaagggtcctgtccctatttccagttgcgtgagtcgggcccaggctggtgaagcctgcggacgaccctgtccctntatttgctctgtctcgtggtgaccttccttacagtaaccacagtattatttagttgggcctggactccggcacgccccgaagggaagacgccgtggtagttggtgcgtacgtactccattatcaagtcgggaccctaacccccgttctaacctacgttcccgtccctacgacgtacgtcgtacgtacctaacccgtactttccgaacgttcggacgtacccgtaccgaaaacgtaacccgtacgttaccgtccccgttaggaccgggtaccgttcgggtacccggttcgttaccggtaccggtacccccccgggtacgggaacccgtacccgggtaccgtttaactttacgtttaccgttacgtcgggtccggggttctttaacggggtacttagtttgggttcggttcgggtcgttacgttcggttcgtcgtaccgtaccggttaccccggcggttccgaacgttaacgtttaacgggttccgggttacggggttcgggtttaacggggaccctaacggggtaccgggtacccgtacccgggg

SEQ ID NO: 229524 - DNA, 720 bp, Homo sapiens
  misc_feature: GYAE6OF01ECF77.24.37.D04.1.454.CMB.1.raw
  modified_base (152)..(152): a, c, t, g, unknown or other
  misc_feature (152)..(152): n is a, c, g, or t
  modified_base (487)..(487): a, c, t, g, unknown or other
  misc_feature (487)..(487): n is a, c, g, or t
  modified_base (537)..(537): a, c, t, g, unknown or other
  misc_feature (537)..(537): n is a, c, g, or t
  modified_base (703)..(703): a, c, t, g, unknown or other
  misc_feature (703)..(703): n is a, c, g, or t
  modified_base (712)..(712): a, c, t, g, unknown or other
  misc_feature (712)..(712): n is a, c, g, or t
tcagactactatgtcacgaccggtgctcgatttagtagcatactgttgggtttggggaggaactgctcagttaggacccagagggaaccatggaagccccagctcagcttctcttcctcctgctactctggcctcccagatgaccaccgganacattgtgttgacacagtctcagcctaccctgtcttgtctaccgagggaacacgccacctctccgtgacacgggcctagtcgactaagtggttaagaagtttgttacgaccgttaggtacttaccaaacaacgaaaacgtcgtacgggaccctacgggtccctcccggtcttcccttacggacttaccgttagtacgtagtcgtaacgtactaacccgtaagtaccgggaccctacgtcgacctacgtaccgacgtaacgtaccggttacgacggtgggtaaccgtggggttacgggtacttaggggaactacggtactttaccgactcctaacncccgaagttccgacgtgtacgtaggttacgacgtactaggtaaacgtttntttacggtacttagtttaacgtagttcggtacgacgtacccgtacgtacgtaacgtaccggtccggtacccttacgggttacccgtacgtaccggtacaaacgggtccttacgggactaaccgtacccgtaacgtagtcggacgtcccacgccgtaatcgtacttntaacccgtnttaacccg

SEQ ID NO: 229525 - DNA, 713 bp, Homo sapiens
  misc_feature: GYAE6OF01B9QD8.24.37.D04.1.454.CMB.1.raw
  modified_base (199)..(199): a, c, t, g, unknown or other
  misc_feature (199)..(199): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccacgggagaaattgtgttgacacagtctccaggcaccctgtcttgctcgagggganagagcccacctctcctggcaggccagccggtagtgttagtaacgtacgttaggctcggtaaccaagacgaacctggaccagggccctacccgaggccttcctacatctatgatcgtacctaccgaacgtgggtccacgttcgggaccctcccgcgtagggttccagggtgcgtagggtcggtacgtaggacctagtacctcgactctacgaccgtgacgcctacgtctaaggcacgtagtaagttcgttttcggtaccggttttactacgttcgtacgtacgcggtacgttcccgttacccgccggttaccggtcccgtacgtttaaccggggtttccgggggaaccggggggtcggtacgggggttaacggacgggtacggggaacgtacgggttaacggtgggtacggaccgtccgaccgtaccgtacggttcgttccggtttacctacgttacccgttcccggttacccccgtccgttaaaccgttcgttaacgtaaccgttggttaacgg

SEQ ID NO: 229526 - DNA, 604 bp, Homo sapiens
  misc_feature: GYAE6OF01A8W7H.24.37.D04.1.454.CMB.1.raw
  modified_base (203)..(203): a, c, t, g, unknown or other
  misc_feature (203)..(203): n is a, c, g, or t
  modified_base (407)..(407): a, c, t, g, unknown or other
  misc_feature (407)..(407): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaancgccaccctctcctgcgagggccagtgacatgtaggagttgtagctggtatacaacacaaacagtcggccaggcctcccggctccgtcatctatgatgctactaccgaagtacgggccacgtggaccacctcccgaagaccgtacggttcgaggtcggacgtggtcgggtcgtacgggacacgtaccttacactcctcacctancgagtcgtagtgtacgacgtacgtagtaacgttagtttgacttagtttactcgtgtcacgtccgacgtacgaactaccgtcgtacccttaccgttccggacccgtacgggacccaggtaccgtacggacctaaccgtaccgaacgtacgtcggtcggctcgaccgtaccctattccgttacgttcctacgttacccg

SEQ ID NO: 229527 - DNA, 596 bp, Homo sapiens
  misc_feature: GYAE6OF01EABF0.24.37.D04.1.454.CMB.1.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (449)..(449): a, c, t, g, unknown or other
  misc_feature (449)..(449): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctnatttgctctgtctctggtnactccttcagtaacacagtattattagttgggcctggatccggcacgccccgagggaagacgcctggagttggtgcgagtatccattatcgagtcgggaccgaacccccttctactacttcccgtccctcgagacgtcgagtcacctatttcacgtggacgtccgtaccaaagaacctagtacctccctgacgctgcgtctcgtcgacccccgngacgacggcctatattctggtgcgggtcttaggtctagttcgtggttggcgtagttcgtcgtgacctacgtaccggcgcgactaactttacgttaccgggtggggttccggtttaggggacctaccgggtagggtacccgtaccggg

SEQ ID NO: 229528 - DNA, 715 bp, Homo sapiens
  misc_feature: GYAE6OF01AGNWS.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagataccactggagaagtagtcatgacgcagtctccagcccaccctgtctgtgtctccgaggggaaancgcccaccctctcctgcgagggccagtgagaatgtggcagcaacttagccgtgtaccagcaacgaaaccgtggccaggcctccgaggcctcctcctctatcgcctcgtcctcccgaccgacgggcccctgggtccgtcccgacgtccgtagggttcggttcgggcgggttgggggtcgtcggggactaggttactttaccgacgttcctaccaccctagtcccgtacgggccccgggtccctacccgtagttaccgtaggtaaacgttacgttttcggtacctttacgttttactttcgttacgttacctaactacgttagttcggtacgtacgtcggttaccccttccggttaactttaccggttttaccgggacccgggtaacggggtaaccctaaacggtacgggaacgtaaccgtaaccgtaaaacggtacgttggtacggtacgtacgaccctaaccgtacgttccgttcgttacgttaccttacccgttcccttccccgtaccg

SEQ ID NO: 229529 - DNA, 963 bp, Homo sapiens
  misc_feature: GYAE6OF01BC6Q8.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggcctcccagatcgccaccggagacattgtgttgacacagtcctccgacgccctacccttgttcctttgtcctaccggaaggggtaaacgaccgccctacccttccgtcccgtgaccgacggggaccctaaggtacgaactaagttaggttaacgggtaagtttggtttaacgccgttagggttaactaccaaaacgtaaccgaaaaacgagttccgggacccgtaacgggtccccgtcccccggtccttaccctacgtaaccttccgtaagtcgtccttccgtcctaccccgaaccgtccgggtccccgttcgggtaccctaccccgacggtaccgttacggttccgggtttacgggcgggttcggtcgtacgggaacgtacgttacgtttccaacgttccgtacctaaccgcgttacccgacggtccccgttacccgttacgtaaccgttcgttaacgggtaacggttttacctttttaccgggtaacccttttaactttttttaaccgttcccgtttagtaaccccgttaaacgtttacgtttaacggttcgggttaaccgtaccggttttacccgggtacccccttttaacccgggtttacgtttttaaccccggtttacccgggggtaaccccgggtaaaacccgggggtaaacttaaaacccgggtttacgggtaaacgtaaaaccccgggtttaaaccgaaaacccgggttacgttcgggtttaaccgggtaaccttacccggacccgttaaaccttacgttaccgttaccgttacccttttaccttacccgttccccccttaaccgtaccgttacccgttaacgg

SEQ ID NO: 229530 - DNA, 895 bp, Homo sapiens
  misc_feature: GYAE6OF01CFCJ2.24.37.D04.1.454.CMB.1.raw
tcagactactatgtcacgaccggtgctcgatttagtagcatactgttgggtttgggggggaaatgctttctgagactcatggacctcctgtgcaagaacatgaagcactgtgttcttcctctgctggtggcgctcccagacggtcctgtccctatttccagttcgcggtgacggtccgggacccagggacgtgggtagaacggtcccgtggaccggacgtaccccgttcgtccccttctagttttcgccttcgttcgttcttcgttcggttcgtacccttccttacgtaacgtaaccaactaagttattttagttaacggttcgggtcctacggtaccgtcccggaccgacccgaccccggtaagggaacgaccggtccgttagggtaggtttcggtcggacgtacgttaacgtccgtaatttaacgtcgtaacggtcccggtaaccccgttaacccccctttagtaccctttacccgttccccggtacccgtacggtaacggtacgttacccggtaaccgttaccctaaaccgtttcgtttaaccgtaacgggttcgggaacccgtaccccggtaaacccgaaacccgtaaacccgtaccgttaaccccgtacccggttacggtaccggttccgtacgggtcccggttccgttcccgggtacccggaccccccggaacgggtaaccccggtaccggtaaccgtttaacttaccggtttacggttcgggtacggttaccgggttaacgttacgggttacgttacgggtttcgttaccgggttaggtacgtcggttacgtcctccgtaccgtacccggtaccgccggtaacttaacgttacggttacggtttacgggccggtttagggtcggacggtacggccggtacgtacccgg

SEQ ID NO: 229531 - DNA, 676 bp, Homo sapiens
  misc_feature: GYAE6OF01BZ8VG.24.37.D04.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
  modified_base (647)..(647): a, c, t, g, unknown or other
  misc_feature (647)..(647): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccacgganactattgtgttgacatagtctccagccctacctgttctttgtcctaccgaggggaaacncgccctaccctctcctgaccacgggccagtcgactaagttgttaagggaatttgtacgccgttaggtaactactaaacactaaactagtcggaccgacggtccctacccggtctaccgtactactcgtaagcgtactcgactaacgtaccgaagttccgggaccctacggtacggacacccgtacccgagtacgttacgggttaccaggtcggacgttagggtcgtacgtacggatacgtctttacgaccttcgtaccgactacgtacgacgtacgtaacggtcgacggtacgtacgtaaggtaagtttcgtttagtaaccgtttaagtttaccttacgcgttaccacgtaccgtacgtacgacgtaccgtccgtacctccgtttacggccctagaccgtaacgcgtacgaactcgtaccgacgtagcggtcaccgtanccgtattactcgttacttctcgttacccg

SEQ ID NO: 229532 - DNA, 835 bp, Homo sapiens
  misc_feature: GYAE6OF01EVJWN.24.37.D04.1.454.CMB.1.raw
  modified_base (224)..(224): a, c, t, g, unknown or other
  misc_feature (224)..(224): n is a, c, g, or t
tcagactactatgtcacgaccggtgctcgatttagtagcatactgttgggtttgggggggaaatgctttctgagactcatggacctcctgtgcaagaacatgaagcacctgtggtttccttcctcctgctggtggcggcctcccaggaagggtcctgtcccatttccagttgcgtgaggtccggcccaggactggtagaagcctggcggagacccctgtccctntatttgctctgtcctcgtggtctaccttcccttacaagtaaccacgtagtaatttatttagtcggtccgtggacgtcccggccgtaccgacccccgaagggaacgacggtccgtagggtaggtttgggtggaccggtaaggtacctaccgtaagtttactcggtaacggtccgggtaaccccgttaacccccttacgttaccgttaccgttcccccggttccgtacgtacggtacgtaccgtaaccgtacctaaccgttactttacccgacggtacgggaaccgtccgtaacccgaaaccgtaaccgtacgttacccgtccgtacggacggtcgtcggtccggtaccgtccggtacccggacccccgaccgggtaccggaccggtaccgtttaacgttaaccgttacgtcggttacgggtccgggttcgttaacggttacgtttagggtttaggttcgggtttcggtacgttacggttcgtacggtcccgtaccgtacccggtaccggtacccgggtacgtaacgtttaaacgtttaccgggttacggggttaccggggttcgggggttacgggacccgtaacggggtaccccggacccgggttaccccgg

SEQ ID NO: 229533 - DNA, 882 bp, Homo sapiens
  misc_feature: GYAE6OF01CPON3.24.37.D04.1.454.CMB.1.raw
  modified_base (202)..(202): a, c, t, g, unknown or other
  misc_feature (202)..(202): n is a, c, g, or t
tcagactactatgtcacgaccggtgctcgatttagtagcatactgttgggtttgggggggaaatgctttctgagactcatggacctcctgtgcaagaacatgaagcactgtgttcttcctcctgctggtggcgctccgagaaggtcctgtcctatttccagttgcgtgaggtcggcccaggtcgtggtagacgctgcggacncctgtccctatatttgctctcgtcgtcgtggtactaccttccttacgaacgttaaccaactagttattttaactttaggttcgggtaccgttacgggtacgtccccggaccgtacccggaccccggaaggggaaacgtcggtccggtggggtaggttttcgggtacggacgtacgttaccgtacctaagtttacctacggttacggtacccggggtaaccccttaaccccctttacgtaaccctttaccggtttacccccggttacccgtacgggtaacggttaacgggttacccggtaaccggttaaccctaaaccctttaacgttttacccggaacccggtttcgggtaacccggttaacccccggaaaccgtaaaaccgtaaccccgttaaccggttaaccccgttacccggttaggaaccgggttcccggttaacgggttccccggttaccgtacccgggttaccccggaccccccgggtacggtaaaccggtcccgggttaaccgtatttaccgttacgtcgggtacggtacgggttacttaggtacctttacgggttgttgggtacgtcggttattcggtcgtaccgtactaccggtccgacgtaccgttaagttaactttccgggtacgggttcgggtacggttaccggactaaccggtacggcggtacccgg

SEQ ID NO: 229534 - DNA, 746 bp, Homo sapiens
  misc_feature: GYAE6OF01EGIRY.24.37.D04.1.454.CMB.1.raw
tcagactactatgtcacgaccggtgctcgatttagtagcatactgttggggtttgggggaggaactgctcagttaggacccagagggaaccatggaagccccagctcagcttctcttcctcctgctactctggcctcccagatgccgaccggagacattgtgtgacacagtcctccagcccaccttgtctttcgctaccgaagggaaacgcgcccacctcctcctgcgacggccagtagacgtaatggttaaggtagttgtagtcctaggtactacgaacaacgaaaacacgtacggccgtaacgcccgtcccggactcctaccgtatctagtacgtatcgactacgtaccgtaacgacgggtaccaccgtcggactaaccgtacccgaaggtaccgtaacggttcgacggtaggacggtaggttggggtccgtaggaactaacggttactaccgtaccttccacctaacacgtacgacgtacgtaacggtgtaacggacgtactaaggtaacgtttagtttcgagtttaacgttttattaccgtagtccgtacgtaccgtaccggtactaaccggacccgttcccgggtaaacccttcccgggttacccggtaaccgtaccggggtaaccctaaggtaccgtaagggaaccccttaacgaacccggttaaaacggcttacggggttcccgacgttaaccgaaccctcgttaaccgtttaccttccggttactttacccgtaaccg

SEQ ID NO: 229535 - DNA, 573 bp, Homo sapiens
  misc_feature: GYAE6OF01A1PRM.24.37.D04.1.454.CMB.1.raw
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (300)..(301): a, c, t, g, unknown or other
  misc_feature (300)..(301): n is a, c, g, or t
  modified_base (326)..(326): a, c, t, g, unknown or other
  misc_feature (326)..(326): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatcgccaccggagacattgtgttgacacagtctccagccaccctgtctttgcctcgaaggggaaanacgccacctctcctgcagggccagtnactaagtgtaggagttgtagctgtatacaanaacaaacngtcggccagcctcccgntccncatctaannatcgactactaccaagtcggccagngacacgtaccagactggtcagtcgcaggtggtcaggacacgtactcacttctacacatcagctagtgaacgacgtctaaggtacttatttcgacgttagtttacacgtgtaccagtacccaacgtagaactaaccgtcgaccgttacgttcccgaccgtcggaacctaggtaccgtgaaacctacgaaacccgtaaagtacgtcggtcgaccttcggactaaacctctattcgttactccttaaccg

SEQ ID NO: 229536 - DNA, 804 bp, Homo sapiens
  misc_feature: GYAE6OF01EF32F.24.37.D04.1.454.CMB.1.raw
  modified_base (205)..(205): a, c, t, g, unknown or other
  misc_feature (205)..(205): n is a, c, g, or t
  modified_base (283)..(283): a, c, t, g, unknown or other
  misc_feature (283)..(283): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggagacattgtgttgacacagtctccagccaccctgtctttgtctccgaggggaaancgccaccctctcctgcgacgggccagtgactaagttggttaaggtagttgttagccgtaggtactacaacaacaaacngtcggaccgacggtccctccccggtcttcccgtactacttaccttagtgtaactcggacctaacgttaccgaaagtacggggcctacgtcggaccactacccgagtacgtacggttcgaggtggcgtagggtcgggtacgacgggtaacacgtaccttccgtaacctccgtacctacccgaattaccggaagtaccgtaaggttacggtaacggtaccgtaccgttaagtaacgtttaacgttttacggaacgttttaacggtttttaccttacgtaacggttaccgaaccggttaacccgtaaccgggtaacgtaaacccttaaccgggtccccggttaaaccccggtttacccggttttaccccggggacccggttaaccggggaaccctaacgggtaacccgtacggtaaacccgtaacccgttaaccgaaaccgggtacgttacgggttccgtacccgtacccgtacccgtaaacccttacgtttaccttccgtttacccgttaccggttaaccccc

SEQ ID NO: 229537 - DNA, 754 bp, Homo sapiens
  misc_feature: GYAE6OF01BZHHF.24.37.D04.1.454.CMB.1.raw
  modified_base (160)..(160): a, c, t, g, unknown or other
  misc_feature (160)..(160): n is a, c, g, or t
  modified_base (169)..(169): a, c, t, g, unknown or other
  misc_feature (169)..(169): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
tcagactactatgtcacgaccggtgctcgatttagtagcatactggttgggtttgggggaggaactgctcagttaggacccagagggaaccagtggaacgccccagctcagcttctccttcctctgctactctggcctccagatcgaccaccggagactntttgtggtnacactagtcctaccgacgccctcccgttgttctttcggtaccgtacggaaggggaacnccgtacccncccttccgtcgcgcgacgggtaccagtagtaacgtaagttggttaaggtagttaggtacgtcgtaggtacaccaaacaacaatacggtcgaccgacgtcccgtcccgctccttgacttcggtagtggtacctaccgcgacgcgtacgccgtggaccggtcgacgtacgtcggtagcggtaggcgttaggtcggttagtacggactacgttcgtacctacgttccagtacgtcaaacgtgaacgagtcggacgtacggtaacgttacgttagttacgtaggtacgtttaagtacgtttacgtacggttctacgggtttccgtttccggtttacctccgtttcccgtttaagttcccgttaaccgttacgtttacggttacccgggtttaccgttaccggttaagggtcccttaggtaccgttacgggtactaccgtaacggtcgtaacgggtttaccgtcgggtaaccgtgttaaaccctccggttaactcgggtaaacctttcccgttgttaaccccg

SEQ ID NO: 229538 - DNA, 695 bp, Homo sapiens
  misc_feature: GYAE6OF01DOI33.24.37.D04.1.454.CMB.1.raw
  modified_base (201)..(201): a, c, t, g, unknown or other
  misc_feature (201)..(201): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccaccctgtctttgtctcgaggggaanacgccaccctctcctgcgacgggccagtcgaactaagtgttaaggaagtttgttacgccgtggtatacaacaacaaacagtcggccgacggccgtcccggctcctcactctatgatcgactactccgaagtacggcctacgtcggcacgtcccagacgtaggttcaggtcggcgtagggtcggggtacgtacgggactacggtacttaccgacctcctaccgaccctatacgacgtacgtaaggtacgtaaggacgttaccgttaggttaaacggttgttttacggtacgtttaagttttaacttacggttcgttacgtacggtaccgtaaccgtacgaaccctaacggttcccggtaccccttaccgggtttcccggtcccggtaacgggtaccacggtaacggttaccggaacccgtaatacccgtaaaccggtacgttcggttacgccgtcggaaccctaccgttactcctttacgttccttcgttacccg

SEQ ID NO: 229539 - DNA, 760 bp, Homo sapiens
  misc_feature: GYAE6OF01A48TK.24.37.D04.1.454.CMB.1.raw
tcagactactatgtcacgaccggtgctcgatttagtagcatactgttgggtttgggggaggaactgctcagttaggacccagacggaaccatggaagccccagcgcagcttctcttcctcctgctactctggctcccagataccactggagaagtagtcatgacgcagtctccagccaccctgtctgtcgtctccgagggaacgacgcccaccctctcctgcacgggccagtgagatgttggcagctaacgttgcctaggtaccagacaagaacctggaccaggcctcccgaggcctccctccgtctagtcgcctcgtaccctcccgaccgaccgggtcccccgtgggtccgtccccgaggtcccgtagggtttccggtacggggtccgggttgggttcgtacggggtaaccgtagtaacgtttccaaccgttccttacccacctacgtacccgacggtcccgttacccgtaccgtacggtaccgttacggtaacgtttacgtttttaccggtacctttaaccttttacgtttccgttacgttaaccctaaaccgttaacgttacgttcgggttaccgttaaccggttccggttacccgtttacccgttaacgtttaccgtttacgggtacccgtaacggggtaaccctaacggtacggtaacgtaacgtaaccgtaaaagtaccggtagtacggaccttacggccctaacgtacgttaccgtacgttcccgttactacccgttccccgttccggtaccc

SEQ ID NO: 229540 - DNA, 878 bp, Homo sapiens
  misc_feature: GYAE6OF01CFB6Q.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtgttcttcctcctgctggtggccgctcccgagaacgggtcctcgtccctatttccgagttgcgtgaggtccgggcccaggacgtggtagaacgccgtggacggtacgtaccctcgttccctcgtattttcgcttctcgtcttcgtggtcgaccttccttacaagtaacacgtagtacttttagttacggttcggtccgtacggacgtcccgggaccgacccggaccccggaaaggggaacgtaccggtccggttagggtacgggtttacggttcggaccggttaacgttaccgtaccgttaatttaacgtacgtacggtaaccggggtaacccccttaacccccttacttaaccgttacccgtttacccccgttcccgtacggtaacggttacgtaccggtaaccgtacccgtaaccgttaacttcgtaccgtacgggacccgttaccccgaaccgaaacgtaacccttacgtaacccgtcccggaggtaccggtccgtacgggtcccggttacgtaccgggtaccccggacccccggacggacccgtacggtaccttacgttaacgttcgtcgggtacggtcggtacctttcggtactagggtttggtcgttcggtaccgttgttccggtcgtaccgtacccgtaaccggttacccgccggttattaaccggtttaaacgttttccgggtaacccggggtttacggggttccgggtttaacccggggaccgtaaacccggggcccgggtttaccccggtaacccgg

SEQ ID NO: 229541 - DNA, 723 bp, Homo sapiens
  misc_feature: GYAE6OF01BDB7V.24.37.D04.1.454.CMB.1.raw
  modified_base (466)..(466): a, c, t, g, unknown or other
  misc_feature (466)..(466): n is a, c, g, or t
tcagactactatgtcacgaccggtgctcgatttagtagcatactgttgggtttgggggaggaactgctcagttaggacccagagggaaccataggaagccccagctcagcttctcttcctcctgctactctggctcccagatcgaccaccggagacattgtgttgacacagtctccagcccacctgtctttgtctccgagggaagacgccacctcgtccgtgcgaacgggccaggtcgaactaagttggttaacggtaagtttcgttacgaccgttggtaataccaacgtaacgaaaacgtgtaccggccgaaccggtcccttaccccggcttaccctactacgttccttaagtggtaactcgaacctactaccaaacggtcggaccctagtcgactaccgaccgaggacgtacggttgacgtaggccggtaggttacggtacgcgggtactacgtacgtcctacnccgtactaccgacttcgagtactagggtacgaaggtacgtaccgttaaggtactttagttttacgtacgtttaacggtttatttaaccgtgtaaccgtacggtacctacggtacctaaccgtacgtcccgtaccgttaaccggttccggaaccgtacgggacgtaggtaccgtaccgtacgaccgtaaccggtaaaccgtaggttcggttacgaccgtccgacctaactcgtttacctaccgtcttcccggtaaccc

SEQ ID NO: 229542 - DNA, 766 bp, Homo sapiens
  misc_feature: GYAE6OF01DMQT1.24.37.D04.1.454.CMB.1.raw
  modified_base (213)..(213): a, c, t, g, unknown or other
  misc_feature (213)..(213): n is a, c, g, or t
  modified_base (351)..(351): a, c, t, g, unknown or other
  misc_feature (351)..(351): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctccagatcgaccaccggagacattgtgtgactacagtctccagccctacccgtgttccttgcctaccgaaggggaaacncgccaccctctccgtgccaagggccagtagaactagtaggttaaggagttgtacgcgttaggaactaccaaaactaacaaaacgtgtcgggaaccacgggtaccctcccggtctaccgtcaacttccgtaagtgtaanacgtacgaactaacccgaaggtacggaccctaagcggacctaactacccgaagtaccggttagttaccgaaggtaccgacgtagggtaccgggtacgtaacgggtaaccacgttaaccggtttacccaagttaccccgtaaccgaacccgtacgtaccgtaacgtacgtaacgggttacggtaacgtacggtacccgtaaggttaaacgttacgtttttaccggagtttaacggtttaacttacgttacgttacgaacgtacggtaacccgtagtaaccgaacggttccgtaacccttacggttcccggtaccgtacgggaacctacggtaacgtacggaactaacgtaaccgtaacggtaacgtcgtcgccgtacgtaccgacgttacgtccgtttacgttctaccgttaaccg

SEQ ID NO: 229543 - DNA, 709 bp, Homo sapiens
  misc_feature: GYAE6OF01AMU3C.24.37.D04.1.454.CMB.1.raw
  modified_base (223)..(223): a, c, t, g, unknown or other
  misc_feature (223)..(223): n is a, c, g, or t
  modified_base (591)..(591): a, c, t, g, unknown or other
  misc_feature (591)..(591): n is a, c, g, or t
  modified_base (610)..(610): a, c, t, g, unknown or other
  misc_feature (610)..(610): n is a, c, g, or t
tcagactactatgtcacgaccggtgctcgatttagtagcatactgttgggtttgggggggaaatgctttctgagactcatggacctcctgtgcaagaacatgaacgcacctgtgtttcttcctctgctggtggcgctccagaggtcctgtcctatttccgagttgcgtgacggtccggcccaggtactggtagacgcctggcggacgtccctcgttccctatntttcgcttcgtgtcttcgtggtcaccttcctagaacgtacagagttatttcttacgtcggtccgtgaccgtccgccgaccgcccgaaggaagcgtcgtcggtagttggtcgacgtacgtataccgtattactacgacgtaccgggtaccccttaaccccgttctaccgtaccgtttccccgaccggtacggtacgtacggtcgtaacctcgtaaccttagtccgtaacggtcggaccgtacccgtaacgaaaccgtaaccgtccgtacctccggtacgcgtacgtcgtccggttacctcgggtacccgacccggacgtacgtcccggtacgtacttaccgtgtcggtccgggtcgttagttacggttntagttggtcgttgaccgtntcgtcgtccgacgtccgaccgtacggtctaacgtttacgttacggttcgggtccgggtttacggttagggaccctaacgggtccggaaccggttacccg

SEQ ID NO: 229544 - DNA, 759 bp, Homo sapiens
  misc_feature: GYAE6OF01CX8FJ.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtgttcttcctctgctggtgcgctcccagaaggtcctgtcccatttccagttgcgtgagtccggcccaggactggtgaagcctggcggacgacccctgtccctctattttgcctcgtgttctcgtggtcgaccttccttacaagtaacacagtattatttagttcgggcctgggactcccggaccaccgacccccgaggggaacgacggtccgtagggtacggtttgggtcgtacgtacggttaactcccgtaatttacgtacgtaccggttacggggacccccgttaaacccccctttacctaaccgttccgttttacccccggtacccccgttacggaacggttaacggttcccgggaacgttacccctaaccttactttaccgtaccgtacgggaaccggtccccgtaacccgtaaaacgaacccttaacgtaacccttcccgtaggaccgtcggtcgccggttccgtacggtcccgtacccccggacggaccgcccggtaccgtaacttacttacgtggtcggtccggttcgtacgtcgtagtttggttggttcggtcttagttcgtcgtccgtaccgtacgtcccgcgtcgtaactacgttacgttggtcgggtacggttcgggagtacgcggaccgtacccgg

SEQ ID NO: 229545 - DNA, 776 bp, Homo sapiens
  misc_feature: GYAE6OF01APFPX.24.37.D04.1.454.CMB.1.raw
  modified_base (745)..(745): a, c, t, g, unknown or other
  misc_feature (745)..(745): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggcctcccagatcgcccgaccggagacattgtgttgacacagtcctccacgcccaccctgttctttcgtctaccggaaggggaaacgacgcccctaccctcctacccgtggaccgacggggaccctaggtacgaactaagttacgggtttaagggtaaggttttcggttacggtccgttaggtactaccgaaaccaacgaaaactcgtccggaccgacgggtcccgtccccccgggcttcccctacctaacgttacctagtcggaagttccgactaaccgtacctaagggtaccgggtaccctacgtaccgggacccaccttaccccgaaggtaccgtaacggttcgtaacgggtgacggttaccggggttggtaccggtacggggacctacgtaccgttccaccgtaccctcccaacctagtccacgacgtagtacgtaggtacgtaccgtagttaacgtttatttggaacgtttagtttacttcgttaacgcgtacgtaccctacgaccgtaaccgtaccgttacccggaacccgtttccggcccgttacccgggttaccgaccgtcggtaaccgccggaacacccgtacgaacgtaccggtggtcggtccncgactacctcgtacttcttaccgtcctcccg

SEQ ID NO: 229546 - DNA, 712 bp, Homo sapiens
  misc_feature: GYAE6OF01BFTAJ.24.37.D04.1.454.CMB.1.raw
  modified_base (159)..(159): a, c, t, g, unknown or other
  misc_feature (159)..(159): n is a, c, g, or t
  modified_base (530)..(530): a, c, t, g, unknown or other
  misc_feature (530)..(530): n is a, c, g, or t
  modified_base (592)..(592): a, c, t, g, unknown or other
  misc_feature (592)..(592): n is a, c, g, or t
tcagactactatgtcacgaccggtgctcgatttagtagcatactggtcgggtttgggggaggaactgctcagttacggacccagagggaaccatggaacgccccagctcagcttctcttcctcctgctactctcggcctccagactcgcccaccggganactagttgtcgttagaccacacgtcctacccgacgtccctacccgttgttcctttcgtaccgtaccggaaggggaaacgcgaccctcccgtctccgtgaccgcggccagtagactagttcgtaggtaagttctacgtccgtaggtaactacgaacctaactaaacgtcgtcggaccgtacggtccctcccggtcctcctacctaccttatacggtacgacgttacgacctaacgttaaccggaagttaccggacccgtacggtccgtaaccgacgtaccccgtagtaccgtaggttcgaaggtcggtacgtcgggtaggtaccgtcgggtaactaccgtacgttacctccgtacctaccgatacgtaccgngaccggttagacgtaacgtcaggttaacaggttccttagtacgttagtttacacgtcggtanacgctaccgagacgtaccgtcgtacctaccggtccggtacgaacggttcaacggttacgagaccgactaacgactggacgttccacgtccaaccgtctacgggtctcttccgtcgtcccg

SEQ ID NO: 229547 - DNA, 652 bp, Homo sapiens
  misc_feature: GYAE6OF01EQ5ZM.24.37.D04.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaancgccaccctcncctgcaggggccagtgactaagttgttaaggagttgtagccttaggtatacaacacaaacngtcggccacggcctcccggctcctacatcctagtgactgaccgactccaaagtcgggacctacgtcgggcaactcccagaccgtaggtcaggtggcggaggttcggggtcgttacgggacacgtaccgttacaaccttacgtaccaacctacgtacacgacgtacggtagtaacggagtccgtaaggtaagttacttttgacgttaagtttacttacgtgtactacgggtcctaaccggtagtaccaacgttccggccccttacggttcccgggaccgtcgggtaccaggtaccgtaaggacctaacgaaccgtaaccggtaacttggtccggtacctagaacccgtacctacgttacttcgtttcccgtattcccg

SEQ ID NO: 229548 - DNA, 679 bp, Homo sapiens
  misc_feature: GYAE6OF01AKYT6.24.37.D04.1.454.CMB.1.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctccgaggggaaangccacctctcctgcagggccagtgacaatgttaggaagttgttagcctggtatcaacaacaaacngtcggccagggccctcccggcttcctnatctatgatgcatccgaagtcgggccacgtggcactcccgagacgtaggttcaggttggacgtagggtcggggttactaggggaacctaggtacctttcaaccgttcctccaaaccgtagtacccgtacggtacgtaggttacggtaacggacggtaccgtaggtaacgttagttttacggactttaagtttttaacttacgttcgtactacggtaccgtaccgtagaacctaaccggttccggtaccccttaccggttttcccgggacccgttaccggggaacccgtacggtaccgtacggaaacctacgtaaccccgaacggttacgttacgggtcgtacgtaccggaccctacgtacttaccgtcgtttcccttcgttacccg

SEQ ID NO: 229549 - DNA, 801 bp, Homo sapiens
  misc_feature: GYAE6OF01CZW5S.24.37.D04.1.454.CMB.1.raw
  modified_base (142)..(142): a, c, t, g, unknown or other
  misc_feature (142)..(142): n is a, c, g, or t
  modified_base (155)..(155): a, c, t, g, unknown or other
  misc_feature (155)..(155): n is a, c, g, or t
  modified_base (393)..(393): a, c, t, g, unknown or other
  misc_feature (393)..(393): n is a, c, g, or t
tcagactactatgtcacgaccggtgctcgatttagtagcatactgttggggtttgggggaggaactgctcagttaggacccagagggaaccatggaacgccccagctcagcttctcttcctcctgctactctggcctccagntcgccaccggganactagttggtgttgaacactacgtcctcccgacgtccctacccttgttctttcgtccgtaccggaagggggaaacaccgtccctaccctcctccgtaggccgtacgggaccctaggtacgaataagtttacgggttaagggtaagttttcggtaacgtccgttaggttaactaccaaacctaaacaaacgtcggtacggaccgtaccggtcccctccccggtctacctctactcctanacgtctcgtacgtactacgtacgtaccggcctagcggaccaccgaccagacgtacgtcgaggtcgaggtggtcggtacgtcggaacgtacgttacctccgtaactccacctacgtacgtaccgtagtccggtaaaggtcgttaacggccgttaaggttaacggttaagttttaccgtttaagtaccggtttttaatttaaccgttttaccgcgttacccggtaacgttacgtaacccggttaacgtaaccgaccccgggtttcccgtaacccccggttccggttaaccccggtccggttaacgggactacggtaccggtacccggaactaaccgtaacccggtaagtcgttcggtccggtccctaaggccccttaacgacgttcccgttacttaccttcccggtaccc

SEQ ID NO: 229550 - DNA, 806 bp, Homo sapiens
  misc_feature: GYAE6OF01AHSTW.24.37.D04.1.454.CMB.1.raw
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
tcagactactatgtcacgaccggtgctcgatttagtagcatactgttgggtttggggaggaaatgctttctgagactcatggacctcctgtgcaagaacatgaagcacctgtggttcttcctcctgctggtggcggctcccagaagggtcctgtccctatttccagttgcgtgagtcgggccaggactggtgaagcctgccggacgccctgtccctntatttgctctgtctcgtggtcgacttccttgacgttaacacgagtatttattagttcgggcttggactccggcacgccccgagggagagcctggtaggtttggttcgngacgtacgtcctaatttactctaacggtcgggtacccggtaacccccctttcttaaccgtaccgtttaccccgtcccttacggaacggtacggtccgtacgttaccctaccgttaacttttaccaccgttgggaccggtcccgttaaccaaacggaacccgtacgtaccctcccgttacggaccggtcgtcggtaccggtcgttaccggtacccggacccccggtaccgggaacccgttacccgggtacccgttaacgtttacgtttaccgtcggggttccgggtaccgggttacgtttacgggttaccttaggttttcggttcgggtttacgggtacccgtaacggtttcgtccggttaccgaaccggttaccccgttccggacccgggtacgttacccgttaaggttttaaccggttacgggttccggggtttcgggtttaccggggacccgttacggggtaacccgggttaacccggg

SEQ ID NO: 229551 - DNA, 819 bp, Homo sapiens
  misc_feature: GYAE6OF01CJKFU.24.37.D04.1.454.CMB.1.raw
  modified_base (149)..(149): a, c, t, g, unknown or other
  misc_feature (149)..(149): n is a, c, g, or t
  modified_base (209)..(209): a, c, t, g, unknown or other
  misc_feature (209)..(209): n is a, c, g, or t
tcagactactatgtcacgaccggtgctcgatttagtagcatactgttgggtttgggggaggaactgctcagttaggacccagagggaaccatggaagccccagctcagcttctcttcctctgctactctgcctccagatcgccacgganactattgtgttgacacagtcctccacgcccaccttgttctttgtcctcggaaggggaacncgccctaccctctccgagcgacgggccaggtgaagtatggtcggactagtacgtaaacgttcgccgttaggtaacccaggtaaccaaacggtaacccgtcggacccggaacggtcccgtacccgaccggtaccttccccgttccctaagttaccgtccggtcttaccgtccccgtaacccgaacccggtccgggtacccgttaggtcccgtccctacgggtaccggttagggtttccgggtgggtccgggggttcggtacgtaggggtaccttaagttaccgtttccaacggttcctaaccgacgtaactccgacgtacccgtctacgtacgtacggttacttacggtttactttcgtactttactttcgtttacgtacttaacctacgttaagttcggttacgtccgtacggtttaccgtacccctttacggttacccgtttacgggtttccggaacccgggttaacggtaacccgtaaggttacgggaactaacgttaaccggtaaacggtacttcgggtacgtacggtaccctaccgttacgtacccgttacgttaccggtttacccttccgtaacccgtttacccccggtgttacccttaacccgg

SEQ ID NO: 229552 - DNA, 768 bp, Homo sapiens
  misc_feature: GYAE6OF01CHLAD.24.37.D04.1.454.CMB.1.raw
  modified_base (218)..(218): a, c, t, g, unknown or other
  misc_feature (218)..(218): n is a, c, g, or t
  modified_base (420)..(420): a, c, t, g, unknown or other
  misc_feature (420)..(420): n is a, c, g, or t
  modified_base (682)..(682): a, c, t, g, unknown or other
  misc_feature (682)..(682): n is a, c, g, or t
tcagactactatgtcacgaccggtgctcgatttagtagcatactgttgggtttggggggaaatgctttctgagactcatggacctcctgtgcaagaacatgaagcacctgtgttcttcctcctgctggtggcgcctccagaaggtcctgtcctatttccagttgcgtagacgtcggcccaggtacgtggtgaagcctggcggacgacccttgtccctntatttcgcctcgtgttctcgtggtcgtacctccttacaagtaaccagtaagttattaactttaggttcggccttaggtacgtccccggaccgacccgaccccggaagggaacgacgtcccgtaggggtacgtttggttcgacggtacttacgtacctagtttactacctacggtccggtacccccgttaaaccccccttttntaaccccgtttaaccgtttccccggttaccccgtagtaaccggtacgtaccggtaacgttaccccgtaacttacgttttacccgacggtacggtacccgtaccccggtaacccgaaaacggaacccttaccgtacccgtccgtacggtacggtcgtcggtccgtacgtccggtacccgtccccgggacgaacgccggtaccgtaattacgttacgttggtacgggtcgtacggttacgttcgtagttgttcggtagccgttnttgtccgcgtacacccgtacggctaacgtactatttaacgggtccggttggtcgggttacggctaacggacggtcccgtacccggg

SEQ ID NO: 229553 - DNA, 691 bp, Homo sapiens
  misc_feature: GYAE6OF01CGHAU.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattggtgttgacacagtctccagccaccctgtctttgtctccgaggggaaangccacctctcctggcacgggaccagtacgactaagtaggttaggaagtttggttacgccgtggtactacaacaacaaacagtcggaccacgggcctccccggtctccctcacttactagtgatggaccacgtaccaaggtacgggcctacgtcgaccactcccgagactaggttccgagtcggacgtaggtcgggtcgtagggtactacgtacttccacgttcctacacccgtatacacgtcgtagggtagtaacggacggtaccgttaaggtagttaagttttcgagtttaatttacgtttaccgtgtacctacgtccgtaaccgtacgtaaccgtaaccgtccggtaacccgtttcccggttaccccggccggttaccggggaacctacggaccggttcgggaaaccttaccgaacccgtaaacgggttactcgggtcggtccgtcgaccccgtatccggttacttcgttactccgttacccgg

SEQ ID NO: 229554 - DNA, 739 bp, Homo sapiens
  misc_feature: GYAE6OF01D9FQV.24.37.D04.1.454.CMB.1.raw
  modified_base (158)..(158): a, c, t, g, unknown or other
  misc_feature (158)..(158): n is a, c, g, or t
  modified_base (212)..(212): a, c, t, g, unknown or other
  misc_feature (212)..(212): n is a, c, g, or t
  modified_base (477)..(477): a, c, t, g, unknown or other
  misc_feature (477)..(477): n is a, c, g, or t
  modified_base (528)..(528): a, c, t, g, unknown or other
  misc_feature (528)..(528): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccacggagacattgtnttgaccatagtcctccacgccctacctgttctttgtctaccggaaggggaaaancgcccacccttctccgtggcgacgggcctagtacgaactaagttcggttaaggtaggtttgtacgtccgttagtactaccaaagaacaacagtccggacccgacgcccgtcccggtcttcctcgacttcttagtcgtacgtcgtacgaacgtaccgaagggtaccgggcccgtaggttacggaccacgtacccgagacgttacggtagacggtggagtaggtgggtacaggactagtacccgttactaccgtccgtactaaccgngttaccgacgtcggttaagtcggtaacgacgttaccgtaggtaaccgtttntttacgtacgtttacgtttattaccgtacaccggtactacgtacgactaccggtagtaccgtcggtaccggtcctacgtaccgttaccgggttaccgggacgggtaaaccggtacgggtaacgggtcgtaaaccggtaccgtaaacggtaaacccggtagtacgggaaccgttaccggaccgtaaccctcccggttagttcccgtttaccg

SEQ ID NO: 229555 - DNA, 874 bp, Homo sapiens
  misc_feature: GYAE6OF01CYG8S.24.37.D04.1.454.CMB.1.raw
  modified_base (237)..(237): a, c, t, g, unknown or other
  misc_feature (237)..(237): n is a, c, g, or t
  modified_base (528)..(528): a, c, t, g, unknown or other
  misc_feature (528)..(528): n is a, c, g, or t
  modified_base (567)..(567): a, c, t, g, unknown or other
  misc_feature (567)..(567): n is a, c, g, or t
tcagactactatgtcacgaccggtgctcgatttagtagcatactgttgggtttgggggaggaactgctcagttaggacccagagggaaccatggaagccccagctcagtcttctcttcctcctgcctactctggcctcccaagatcgccaaccggagactagttggtgttgaaccacgtacgtcctccaacgccctacccgttggttcctttggtacctaccgggaaagggggaaanaccgacccctaccctcgtcccgtggaccgaacggggcctaggttacgaacgtaagttaggttaacggtaagtttacggttacgtccgttaggttaacaaccgtaaaaccgtaaccaaaaacggttacgtccggggtacccaaaccggggtcccccgtcccccgggtattaccccgttaactacttttacccgtagttaccggtaccttacgaccttaacgttaacccggaaggtacccgggttaccaaccggttcgaaccttacccgaccgaacgtaccgtaggttaccgnggtcggacggtggttaccgggtgacggaactacgtttcncctaacgtcaccgtaaacctagtaccgacggtaccgtaggttaacggtaacgtacgtaaccgtaggttaaacgtttacggtttacgttaccgttacgtttaacgttaccgtacgtaccgtacgtacccggttaacgtacgtaaccggttaccgtacccggtacccgtttacccgtaccgggtacccggtacggtaccgtaacggttaccgtacgtaaccgtaaccggtaaccgtaaacggtagttaccggtcgttaaccggtctacgacctttaaccggtctttaccgttccgtacgtttacccccg

SEQ ID NO: 229556 - DNA, 821 bp, Homo sapiens
  misc_feature: GYAE6OF01CNHCE.24.37.D04.1.454.CMB.1.raw
  modified_base (232)..(232): a, c, t, g, unknown or other
  misc_feature (232)..(232): n is a, c, g, or t
  modified_base (703)..(703): a, c, t, g, unknown or other
  misc_feature (703)..(703): n is a, c, g, or t
  modified_base (726)..(726): a, c, t, g, unknown or other
  misc_feature (726)..(726): n is a, c, g, or t
tcagactactatgtcacgaccggtgctcgatttagtagcatactgttgggtttgggggggaaatgctttctgagactcatggacctcctgtgacaagaacatgaagcacctggtgttccttcctctgcgtggtggcgctcccgagaagggtcctgtccctatttccgagttgcgtggagtccgggacccaggacgtggtagaacgtccgtggcggacgtaccctcgtccctntagtttcgcgttctacggttcctgtcggtactaccttccgttacgaagttaaccacgtagttatttatttaggttcgggccttggaccgttaccggccgaacccgaccccggaagggtaacgacgtccggtagggtacggtttgggttcgacggtaggttactacgtacttacgtcgtaacggtccgggtaaccccgtaaccccctttcgtaccgttaaccgtttcccgtaccccgttacggaacggtacgttacccggtacgttaacccgtaacctttacgttacgtaccgggtacgggtacccggtacccggttaacccgtaaaacggaaccctaccgttaacccgtccgtagggacgtaccgttacgggtcccggtttacgtaccggtacccggtacccccgggacgtaccggtacccggtacgtacgtttactttacggtcggtaccggtcgggtttactacggttnttacgggttggtcgttgacgttntccgttgtacgtcgtaccgaccgtcggattacggttagttaacggttcgggacggtttcgggtaccggaccgaagggtcccgggtacgtacccgg

SEQ ID NO: 229557 - DNA, 1036 bp, Homo sapiens
  misc_feature: GYAE6OF01DX4TQ.24.37.D04.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagactactatgtcacgaccggtgctcgatttagtagcatactgttgggtttgggggggaaatgctttctgagactcatggacctcctgtgcaagaacatgaagcacctgtggttcttcctctgctggtggcggctcccagaaggtcctgtcccatttccagttgcgtgagtcgggcccaggactggtgaagccgtgccggacgaccctcgtccctntattgctctcgtctntgtacgtactccttcaagtaacactagtattattagttcgggcctaggtacgtccgaccgaccgaccccgaagggaacgacgtccgtaggttacggtttcgggttacggacggtaacgttaccgttacccgtaagtttaccgtaccgtacggttacccggggaaccccccgttaaaccccccgtttcccgtaacccgttaccggtttcccccgttaccccgttaccggtaacggtaccggttaccgtaaccgttacccctaaccgtttaaccgttttacccgtaaccggtaccggggtaaccgtacccccggttaaaccccgtaaaaccgggtaaaccccgttaccgggttaaccccgttacccccggtacggggaaccgggttccggttaccgggttacccgggtttacccggttaaccggggttacccccgggtaacccccccccggggtacccggggtaaccccggttaacccccgggggtttaccccgttttaaacgttttaacccggtttaccggtttacccggggttaccgggggttcccggggttttaaccgggttttaaccgggttaccggtttacggtttttacggggttacgggttaccggggtacgttaacgggtttccggttacccttaccgggtacccgttaaccggtacccccgggtacccggtacccggttaaaccgtttaaacggttttaaccgggtttacccgggggttacggggtttcccggggtttaacgggggtaacccggtaaacccggggttaaccggggtaacccccggttaccccgggg

SEQ ID NO: 229558 - DNA, 844 bp, Homo sapiens
  misc_feature: GYAE6OF01B9NYZ.24.37.D04.1.454.CMB.1.raw
  modified_base (181)..(181): a, c, t, g, unknown or other
  misc_feature (181)..(181): n is a, c, g, or t
tcagactactatgtcacgaccggtgctcgatttagtagcatactggttggggtttgggggaggaactgctcagttaggacccagagggaaccatggaagccccagctcagcttctcttcctcctgctactctggcctccagatcgccaccggagtaattgtgttagactacagttcctccncggactacccttgtcttttcgccgtaccggtaggggagacgacggtcccaccctctcccgaggccacggggtcccaggaccgggtagttaggtttaaggaaacgtttacgtacgggtcgtttaacgggtaaaccccaacgtaaccggaaacccggtcggacccggacgggtacctaccgaacggtcccgttacccttacgactttacctagttaggtacgttcggttaccacccgtaaacggaccggtacctaaccggtccgggttacccgccccggtaccgtacgggttaccgtagtccggtacgtagggttcggttacggacggtacgacgtaccgtttacgaccttacctcgtacccgttacgacggtccaacggtcctaagggtaccgtacgtacggtaaagtttcggttttacgggttaacggtttacgttaccgtacggtacgaacggtcgtaccggttccggtttaccccgcggttccggtaaccgggtaccgtttaacccgggtttccgggggggaacccggggaggaacggggttaccggggacggtagggaacgggtacccgtaagcgggttcggtcctcggaacccgtccgtattcggtcttacccggttattaccctccgttacccgccttaatctaaacggtaacttacg

SEQ ID NO: 229559 - DNA, 727 bp, Homo sapiens
  misc_feature: GYAE6OF01A51V1.24.37.D04.1.454.CMB.1.raw
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
  modified_base (459)..(459): a, c, t, g, unknown or other
  misc_feature (459)..(459): n is a, c, g, or t
tcagactactatgtcacgaccggtgctcgatttagtagcatactgttgggtttgggggaggaactgctcagttaggacccagagggaacccatggaagcccccagctcagcttctcttcctcctgctactctggctcccagatgcccacggagacattgtgttgacacagtcctccagcccaccctgttctttgtcctccgaggggaaanagcccaccctctacctgccgagggccagtgaactagtgtaggagttgtagcctggatcaacaacaacatcggcaggcctcccggctcctcctctancgtctcgtctcccgaccgccggtcccgtggtcgtacccacgccgtacgggtttcggttcgggcgggtcggttcggtacggtacgtagttacttcctaccgttcctaccaacctgtacccgacgtccggacctccggtacgtctagtaacgttnttttcgtacttacgttttacttcgtacgtaacctaaccgttaactaacgttcggttacgtacgttccggtacccgtttaccccgttaacgttacccgttttacgggacccggtaaaccggggtaacctaaaccgggtggtaaaagtacccgttaaacggaaacctcggttacggtaccggttccgaccgtaaaccgtcccttacgttccgttaccgttccgttagttccccttaccccgttacccccgtactccgttaactaacccgg

SEQ ID NO: 229560 - DNA, 795 bp, Homo sapiens
  misc_feature: GYAE6OF01EVKLD.24.37.D04.1.454.CMB.1.raw
  modified_base (228)..(228): a, c, t, g, unknown or other
  misc_feature (228)..(228): n is a, c, g, or t
tcagactactatgtcacgaccggtgctcgatttagtagcatactgttgggtttggggggggaaatgctttctgagactcatggacctcctgtgcaagaacatgaagcacctgtggttccttcctcctgctggtggcggctccccgaggaagggtcctgtccctatttccagttgcgtgagtccgggcccaggactggtgaagcctggcggacgaccccttgtcccctntatttgcttcttgtcctcgttggtcgtaccttccttacgaagttaaccaactagttatttaagtttagttcggggtccttgggaacctcccgggaccacccggacccccgaaggggtaacgacgtaccgtggtaggtttggtgacggtagttactctattactcgacgtcgggtaccctaaccccgttctaactcgttcccgtccgtagacgtagtaccgtaacgtccaccttacttccgaacgtcgggaccgtaccctaaccgaaaccgtaacccgtacgttaccctcccggtaggtacgggccgttcgggttcccgttaccgtaccgggtaccccgtacccccgggacgggaacccggtaccggtacccgttaatttaaccgttaccggttgggtaccgggtcggtttcgttaacggttctaaggtttcgggttacgtggtacgtagtttcgtcgtaccgtacctaacccgtccggaccggtactacgtttaaagtttaccgggttcgggtacggggtttacgggttacgggaacccttacgacggggttcccgtaaaccccggg

SEQ ID NO: 229561 - DNA, 765 bp, Homo sapiens
  misc_feature: GYAE6OF01CF01B.24.37.D04.1.454.CMB.1.raw
  modified_base (97)..(97): a, c, t, g, unknown or other
  misc_feature (97)..(97): n is a, c, g, or t
  modified_base (127)..(127): a, c, t, g, unknown or other
  misc_feature (127)..(127): n is a, c, g, or t
  modified_base (149)..(149): a, c, t, g, unknown or other
  misc_feature (149)..(149): n is a, c, g, or t
  modified_base (162)..(162): a, c, t, g, unknown or other
  misc_feature (162)..(162): n is a, c, g, or t
tcagactactatgtcacgaccggtgctcgatttagtagcatactgttgggtttgggggaggaactgctcagttaggacccagagggaaccatggaancccagctcagcttctcttcctctgctactntgctccagatcgccaaccgganactagttgtgttnacactagtctaccacgcccaccttggttcctttgtacctaccggaaggggaaaacgctcccacccttcgtcccagacgacgggtaccaaggtacgaactaaggttaggttaagggtaaacgttttacggtacgtaccggttaggtaaacctaacgtaaacaaaccgtaaaacgtacggaccgacccggtaacggtcccgtaccccgtcttaccgtactaacttactaggtagtacggttacgactaaaccgtacgtaaacgggtaccgggtaccaacggtccggtaaaccaccggttacccaagggttacgtaacgggttaaccgagggttaccgggacgttaacggggtcgggtacgttacggggaactaacggttccacctaccgtactaccgaaccagtacgacgtaacgtagtagttacgacgtacgttagtaatttagttacgttacgttacgtttacgtactaggtaccaacgtactacgtactaacgtaaccgtaccgtactaccccggttggtcccggtaacggctaacggcgaccggtaaccagtaccggaactgacggtggcctagacctcgttactcgtctacgtctacccg

SEQ ID NO: 229562 - DNA, 816 bp, Homo sapiens
  misc_feature: GYAE6OF01AOTQC.24.37.D04.1.454.CMB.1.raw
tcagactactatgtcacgaccggtgctcgatttagtagcatactgttgggtttggggggggaaatgtcttttctgagactcatggacctcctgtgcaaagaacatagaagcaccttggtggtttccttccctcctgcgtgggtggccggcctcccgaaggaacgggttcctacgtccctatttcccgtagttcgcgtagacggtccgggcccagggtacgtgggtagaacgtccgtggccggacgtaccccttcgtcccctatagttttcgcttcgttgttccgttacgttggtacctaccttcccgttataacgtaacgatagttattttagttacggttcgggtcctagggtaccgtccggaccgacccggacccggtaagggaacgcgtacggtaggtacggttaggtcggtacgtaacgttctaccgttattacgtacgtaccggtacccggtaaccccttaccccttcgtaaccttacccgtttccccgaccggtacggtacgtacggtaccgcttaacctacgttcgttaccgacggtcggtacccgtaaccgtaacgaaccgtaaccgtacgttaccccgtcgtaggtacggtcgttccgggtacctacggtacccgtacccgggaccccggacgttaccggtaacggttccttaagttccgtgtcgtaccgggtggtttccgtaggtatttcggttggtcggtttgtacgtagttccgtacgtccgtaccgtccgtaccggccgtattacgtttaacgttgggttccgggtagttccgggtacgaacgtcgggttaccgccgttacgg

SEQ ID NO: 229563 - DNA, 672 bp, Homo sapiens
  misc_feature: GYAE6OF01D7VE5.24.37.D04.1.454.CMB.1.raw
  modified_base (161)..(161): a, c, t, g, unknown or other
  misc_feature (161)..(161): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
tcagactactatgtcacgaccggtgctcgatttagtagcatactgttgggtttgggggaggaactgctcagttaggacccagagggaaccatggaagccccagctcagcttctcttcctcctgctacttctggcctcccagatcgccaccggagacattgngttgacacagtctcagccacctgtcttgctccgagggaanacgccaccctntccngtaggccagtgaacatgtagacgttgtanctggtatcaanacaaacatgccagctcccggctcctcatctatgangcgataccaatacgggacactggcactcccagacngtacgagngcgagtggtctgganacgactcgacncgtcacgatcacgcagtgtaagagcccttaagaagtaacgtttcgacgttaagttttacgttaactacggtacgacgtacggtaaccccgtgtaaccgtaaaccggtaccgggtaccccgttaaaccgttttcccggggtaacccctttagggggaaccccaaaggtacccgttaacgggaacccaacggttaaacccccgaacggttaaaacccttggggttaacccgggtaccgtaccggggtaacccgtaaaccccttacggttacccttaacgttttcgttaaaaccccgtcggttttaaacccccgg

SEQ ID NO: 229564 - DNA, 753 bp, Homo sapiens
  misc_feature: GYAE6OF01A36P4.24.37.D04.1.454.CMB.1.raw
  modified_base (245)..(245): a, c, t, g, unknown or other
  misc_feature (245)..(245): n is a, c, g, or t
tcagactactatgtcacgaccggtgctcgatttagtagcatactgttgggtttgggggggaaatgctttctgagactcatggaccctcctgtgcaagaacatgaagcacctgtggttcttcctcctgctggtggcggctcccagaagggtcctgtcccatttccagttgcgtgagtcgggcccaggactggtgaagcctggcggagaccctgtccctcatttgctctgtctctggtgactccttnagtaacacagtattattagttggcctggactccggcacgccccgagggagacgccgtggtagttggtgcgagtactcctaattactcagtcgggacccgtaaccccctttctaacctacgttcccgtacccgtcgaacggtacgtacggaacgtaccaaccctactttaccacgtacgggtacgtaccccgtacccgaaaacgtaacccaacgtaccctcccgtacggtacggtccgttcggacccggttcttacgggtacccgaccccccggcgggaccgacccggtaccgttaagttacgttacgtcgtcgggtacgggttcgtttacgtacgtacgtttaggttcggtttcgggtaccgttagttcggttccgttaccgtccgtaacccggttaccgggtacccggtacgtacgttaacgtttaacgttttaccggggttacggggtttaccgggggttttcgggaaccggtaacgggtaccgggggtacccgttaaaccccggg

SEQ ID NO: 229565 - DNA, 868 bp, Homo sapiens
  misc_feature: GYAE6OF01CO2O8.24.37.D04.1.454.CMB.1.raw
  modified_base (230)..(230): a, c, t, g, unknown or other
  misc_feature (230)..(230): n is a, c, g, or t
tcagactactatgtcacgaccggtgctcgatttagtagcatactggttggggtttgggggaggaactgctcagttaggacccagagggaaccatggaagccccagctcagtccttctcttcctcctgctactctggcctccgagatcgccaccggagactgttgtgtcgaacacgacgtcctccacgtccctaccttgttcctttgtaccgtaccggaaagggggaaacncgacccctacctccgtccgtgccggacgggtacctagttagaactagttagggttaaaggttaggtttacgttacggccgttaggtaactaacaaaccgtaaccaaaagtcggtcgaaccgtaccgggtccccgtacccggtccttaccctactacgttacctaaggttcgaacttcggtacctaaacggtaccctaaacgggtccgggaacctacgtccggacctaaccgtccgtaacgtacggtacggttacggacggttcggacggttacggggttccgggtacggttacggaaacctcggtttacccacgtaccttccggaaacctccgtaaagtccgaagttaccggttaggacgtacctaaccgggtacgttaagttaacgttttacgttcggtaacgtttttaccgttaacgtccgaccgttaaggtcgtacccgtaacgtaacgtaaacccggttccgggtaccccttaacccggttccggggttaaccccgggtccctaaacggggtacctaaacggttacccggtacgaaaccccgtttaacgtaaacccgtacgggtttcaacgggttccggtaccttaccgaaacccgttcttcgttaacccgttcgtttacctaaccccgttccg

SEQ ID NO: 229566 - DNA, 781 bp, Homo sapiens
  misc_feature: GYAE6OF01BMF8O.24.37.D04.1.454.CMB.1.raw
  modified_base (388)..(388): a, c, t, g, unknown or other
  misc_feature (388)..(388): n is a, c, g, or t
tcagactactatgtcacgaccggtgctcgatttagtagcatactggttgggtttgggggaggaactgctcagttaggacccagagggaaccatggaacgccccagctcagcttctcttcctctgctactcgtggcctccagactcggaccaccggagacagtttggtgttacgaacaacgtagttcctaccgagtacccctacccgttcgtttcttttacggtacctaccgggaagggggtaaacaccgtacccctacccttccgtcccgtaggaccggacggggacctaggtacgaacgtaagttaggttaacggtagtttcgtacgtccgtaggtactaccaacgaacaactaggtccgaccgacggtccctaccggcttccctanacttcgtactgacgtcgacctactaccgaaggttccggacctacggtgtaccactaccgagacgtacgttcgagtggacgtgggttcggagtacgggactaacgtacctcgtaccttaccgacgtaacctaggtccgaacgtcggtaacggtcgtaacggacgtaccggttaagtacggtttaactttcggtaacgtttacgttttaacggttaccgtacggtacgtacgtacccgtaccgtaacgtaccggtaacccttaccggtaccgtttcccggttaccgggccgttaaccggacgtaaccgtcgacgttaccaacggttaccgaaacggtcgttacggccgtacgtacgacccctagttacccttattccgtttactccgttaccccg

SEQ ID NO: 229567 - DNA, 545 bp, Homo sapiens
  misc_feature: GYAE6OF02HK8AH.24.37.D04.1.454.CMB.1.raw
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccaggggaaagngccacctctcctgcagggccagtgacaatgttagagttgtagctggtatcaacacaaacatggccaggcctccccggntcctcatctatgatgcatccaagtacggccactggcatcccagacaggttcagtggcagtgggtctgggacagcttcactctcacatcagcagtgtagacgcctagaagtatttgactagtttattactgtcagcaccgtgaccaactcggaccctacgtttccggcccttacgggacctaacgtacgtggacctacgttacccgaaacggtaccgttggtcggtacctcgacccaccgtattccgttcggttccttactaccg

SEQ ID NO: 229568 - DNA, 221 bp, Homo sapiens
  misc_feature: GYAE6OF02G7VYD.24.37.D04.1.454.CMB.1.raw
  modified_base (220)..(221): a, c, t, g, unknown or other
  misc_feature (220)..(221): n is a, c, g, or t
tcagactactatgtcacgaccggtgctcgatttagtagcatactgttgggtttggggcacagggaccacggtcaccgtctcctcagcctccaccaagggcccatcggtcttcccctggcaccctcctccaagagcacctctgggggcacagcggccctgggctgcctggtcaaggactacttccacatagtagtctgagcgggctggcaaggcgcatagnn

SEQ ID NO: 229569 - DNA, 525 bp, Homo sapiens
  misc_feature: GYAE6OF02HBJVF.24.37.D04.1.454.CMB.1.raw
  modified_base (262)..(262): a, c, t, g, unknown or other
  misc_feature (262)..(262): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggctcccaggctcctcatctatgatgtctccaacagggtcactggcgtccccgcaggttcagtggcagtgggtctgggacagacttcactctcaccgtcagcagcctagagcctgaagattttgcggtttactactgtcagcagcgttccgcctcggccgtctacgtttcgggcgggggaccagggtggagaggagacgaagtgtggcgtgcacatctgtcttcatccttcccgcctatctcgacatacg

SEQ ID NO: 229570 - DNA, 498 bp, Homo sapiens
  misc_feature: GYAE6OF02GCETQ.24.37.D04.1.454.CMB.1.raw
  modified_base (494)..(494): a, c, t, g, unknown or other
  misc_feature (494)..(494): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtgcagtgggtctgggacagacttcactctcaccatcagcagtgtagagcctgaagtattttgctagtttattactgtcagcacgtgacactgcccactttcgccctggaccagactggacagtaccaacgtaactgtcgctgcaccatctgtcttntacc

SEQ ID NO: 229571 - DNA, 503 bp, Homo sapiens
  misc_feature: GYAE6OF02G6UON.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagattttgctagtgtattactgtcagtctgttggtccctctcctctatgtactctttcgcctagggttccaggtctggatagtcaagcgaacgtgtggctgcactacg

SEQ ID NO: 229572 - DNA, 502 bp, Homo sapiens
  misc_feature: GYAE6OF02FWEDU.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagtatttgctagtttattacttgtcagtcaccgtgaccactcggccctacgtttccggccctgggacccagactggacatccaacgactgtgctgcacatctgtctctac

SEQ ID NO: 229573 - DNA, 518 bp, Homo sapiens
  misc_feature: GYAE6OF02GMFN4.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggctccccggctcctcatctatgatgcatccaatagggccactggcatcccagacaggttcagtggcaggtgggtctgggacagacttcactctcaccatcagcagtgtagagcctgaagtatttgctagtttattactgtcagcaccgtgacacgtcggccctacgtttcggccctgggaccagacctaggacactaccgaaacgtactggtcgccgtgctaccagttctcgttccttctac

SEQ ID NO: 229574 - DNA, 552 bp, Homo sapiens
  misc_feature: GYAE6OF02HSX37.24.37.D04.1.454.CMB.1.raw
  modified_base (203)..(203): a, c, t, g, unknown or other
  misc_feature (203)..(203): n is a, c, g, or t
  modified_base (325)..(325): a, c, t, g, unknown or other
  misc_feature (325)..(325): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
tcagactactatgtcacgaccggtgctcgatttagtagcatactgttgggtttgggggtagggaacgtgctcagttaggaccagagggaaccatggaagcccagctcagcttctcttcctcctgctactctggctccagatgccaccggagacattgtgttgacacagtctccagccaccctgtctttgtctccaggggaaanagccacctctcctgcagggccagtgacaatgttaaggaagttgttagctggtatcaacacaaacaatggccaggctccccggctcctcatctatgatgcatccaataggcactggcatccanacagttcaagtggcagtgctttgggcagacttcactcgtcatcatcgacagactganccgaagatttgcagngtattactgtcagctgtttggtcccttctcctcccgtattgtacctacgttttcggcctaagggtttcccagggtccttagggaacggtaacttcgaaaacgtacgggtaaccttagggttcgggaccgtttcgggacaacccgtagtttacccg

SEQ ID NO: 229575 - DNA, 547 bp, Homo sapiens
  misc_feature: GYAE6OF02JM5HO.24.37.D04.1.454.CMB.1.raw
  modified_base (412)..(412): a, c, t, g, unknown or other
  misc_feature (412)..(412): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagataccactggagaagtagtcatgacgcagtctccagccaccctgtctgtgtctccggggggaggaaagagccaccctctcctgcagggccagtgagaatgttggcagcaacttagcctggtaccagcagaaacctggccaggctcccaggctcctcctctatgctgtcctccaccacgggcccctgggtcgtcccaggccctaggttcgttggcggttgggtcctggggacaggtagttcactctcaccatcagcagtctgcagtctgaagtntttgctagtttattactgccagcagcacagtgactcggccgctcgtacgtttcgggcggtaacgggaccgtaagggtggaacgacgtacgaaacgtacgtaggtacggcgtcgacgaccgagtcgttcgtcttac

SEQ ID NO: 229576 - DNA, 512 bp, Homo sapiens
  misc_feature: GYAE6OF02IFPYS.24.37.D04.1.454.CMB.1.raw
  modified_base (286)..(286): a, c, t, g, unknown or other
  misc_feature (286)..(286): n is a, c, g, or t
  modified_base (509)..(509): a, c, t, g, unknown or other
  misc_feature (509)..(509): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagcctggtatcaacacaaacatggccaggctccccggntcctcatctatgatgcatccaatagggccactggcatcccagacaggttcagtggcaggtgggtctgggacaggacttcactctcacatcagcagtgtagagctagaagtattttgctagtttattactgtcagcaccgtgacaacgtcggaccctacgtttccggcccttgggaccagactggacactaccgaacgaactgtcgctgccacatctgttcctntac

SEQ ID NO: 229577 - DNA, 500 bp, Homo sapiens
  misc_feature: GYAE6OF02HNXHE.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggctccccggctcctcatctatgatgcatccaatagggccactggcatcccagacaggttcagtgcagtggtctgggacagtacttcactctcaccatcagcagtgtagagcctagaagtattttgctagtttattactgtcagcaccgtgacaactggccctacgtttcgcccgtggaccagactggacataccaacgactgtgctgcaccatctcgtctctac

SEQ ID NO: 229578 - DNA, 710 bp, Homo sapiens
  misc_feature: GYAE6OF02F9TUS.24.37.D04.1.454.CMB.1.raw
  modified_base (216)..(216): a, c, t, g, unknown or other
  misc_feature (216)..(216): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
tcagactactatgtcacgaccggtgctcgatttagtagcatactgttgggtttgggggaggaactgctcagttaggacccagagggaaccatggaagcccagctcagcttctcttacctcctgctactctggctcccgagtagtcgccaaccgggtagtaccatttggtgttgtaacacagtctccagccacctgtctttgtctccgaggggaagnggccacctctcctgcagggccagtgacaatgttaggagttgttagcctggtactcaacgacaaactntaggccacggccgtcccccggntcctcacttcgtactcgaactcgctactaccgaagttacggggcctacgtcggactacgtcccagactaggttcaggtgcgtaggtcggtacgtgggaacagtaccttcgaaccttccgtaccgaaccgtattcacgtacctaggttcggtaacgacggtacctagtaaacggttacttttacggacgtttaagtttacttacgttagtaccgtaacgtaccgtaaccggttgtaaacccgtaaacggttccgggtaccccttaaccggtttaccgggacccgttacgggtaaaccgtaacggtaaccgtacggggtaaccaccgggtaaaccggtaaaccggaaaccgttcgggtacggtactacggaccttaccgtaccgttcgttcgttaccgtactacccg

SEQ ID NO: 229579 - DNA, 524 bp, Homo sapiens
  misc_feature: GYAE6OF02G5YPA.24.37.D04.1.454.CMB.1.raw
  modified_base (201)..(201): a, c, t, g, unknown or other
  misc_feature (201)..(201): n is a, c, g, or t
  modified_base (445)..(445): a, c, t, g, unknown or other
  misc_feature (445)..(445): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaacagaaacctggccaggctcccaggctcctcatctatggtatatccagcagggccactggtcgtcccagccaggttcaggtggcagtgggtctggggacaggtagttcactctcaccatcagcagtctgcagtctagaagtattttgctagtttattactgccagtcagcacagtgacgtggccnctcacgtttcggcggagggaccaaggtggagatacgaaacgaactgtggctgacgacctatctcgtcttacgattcccg

SEQ ID NO: 229580 - DNA, 530 bp, Homo sapiens
  misc_feature: GYAE6OF02G89AP.24.37.D04.1.454.CMB.1.raw
  modified_base (424)..(424): a, c, t, g, unknown or other
  misc_feature (424)..(424): n is a, c, g, or t
tcagactactatgtcacgaccggtgctcgatttagtagcatactgttgggtttggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaaccccttctacattccgtccctcgagagtcgagtcaccatttcactggagccgtccaagaaccagtactccctgagctgcgtctgtgacccccgnggacacgccgtatattactgtgcgggcttagggtcagttcgtgttgcgatgtctgcactaccgcgcgcaattattacgtggcgtttgggcacgagggacctacggg

SEQ ID NO: 229581 - DNA, 551 bp, Homo sapiens
  misc_feature: GYAE6OF02GV2UM.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagcctggtatcaacacaaacatggccaggctccccggctcctcatctatgatgcatccaatacgggccactggcatcccagacaggttcagtggcaggtgggtctgggacagacttcactcctcaccatcagcagtgtagacgcctagaagtattttgacttagtttaattacttgtacagtccaccgtgaaccaaccgtccggccctaccgtttccgggcccgtacgggaccacgacgtcggacacgtacccgaacgtaactcggtcggctcgacctacctacttccgtcgttccttctacc

SEQ ID NO: 229582 - DNA, 534 bp, Homo sapiens
  misc_feature: GYAE6OF02FUCE6.24.37.D04.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtcgtcccagccaggttcgttggcggtgggtctgggacagattcactctcacntcagcgcctcagtctgagtatttgctactttattctgtctaactacttatgtgactggtccttccgtactacgttttcggccgtacggggtaccaaacgtggacgtacgtacaacgaacgtgtggctcgcacctatctcgttcttctacttcctcccgtcc

SEQ ID NO: 229583 - DNA, 501 bp, Homo sapiens
  misc_feature: GYAE6OF02GJ6TU.24.37.D04.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
  modified_base (498)..(498): a, c, t, g, unknown or other
  misc_feature (498)..(498): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggctcccccggctcctcatctatgatgcatccaagtacggccactggcatcccagacaggttcagtgcagtggtctgggacagacttcactctcaccatcagcagtgtagagcctagaagtatttcgnttagtttattactgtcagcacgtgacactcgccctacgttccgcctcggaccagactggacactaccgaacgactgtgctgccactatctgtctntac

SEQ ID NO: 229584 - DNA, 534 bp, Homo sapiens
  misc_feature: GYAE6OF02GG6H6.24.37.D04.1.454.CMB.1.raw
tcagactactatgtcacgaccggtgctcgatttagtagcatactgttgggtttgggggggaaatgctttctgagacctcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccccagggaagagcctggagttggttgcgagtatccattatcatgggcgaacccccttctacattccgtccctcgagagtcgagtcaccatttcactgagccgtcaagaaccagtactccctgaggctgcggtctgtcgacccccgcggaccacggccgtatacttactgtgcgggcttaggtcattgtgttgcgatgtctgcactaccgcgcgcaattattacgtgggcgtttgggcacgagggcctacgg

SEQ ID NO: 229585 - DNA, 534 bp, Homo sapiens
  misc_feature: GYAE6OF02HJOTT.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgagaatgttggcagcaacttagcctggtaccagcagaaacctggccaggctcccaggctcctcctctatgctgtcctccaccacgggcccctggtcgtcccagccaggttcgttggcggtgggtctggggacagatttcactctcaccatcagcggcctccagtctgaagtatttgctactttatttcttgtcaactactatggtgactcggtcctccgttactacttttcggccgtacgggaccaaacgtggagatacaacgactgtggctgcaccatcgtgttcttctactccttcccgcctac

SEQ ID NO: 229586 - DNA, 530 bp, Homo sapiens
  misc_feature: GYAE6OF02IOXAX.24.37.D04.1.454.CMB.1.raw
  modified_base (358)..(358): a, c, t, g, unknown or other
  misc_feature (358)..(358): n is a, c, g, or t
tcagactactatgtcacgaccggtgctcgatttagtagcatactgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagtcaccctctcctgcagggccagtgagaatgttggcagcaacttagcctggtaccagcagaaacctggccaggctcccaggcctcctcctctatgctgtctccaccagggcccctggtcgtcccagccaggttcgtggcggtgggtctgggacngtatttcactctcacatcagcgcctcagtctgaagtatttgctactttatttctgtacaactactatggtgtactcggtcctccgtactacgttttcggccgtacggggtacctaaacgtggaacgatacgaacgactggtggctgcaccatctgtcttcacttcctccctc

SEQ ID NO: 229587 - DNA, 511 bp, Homo sapiens
  misc_feature: GYAE6OF02IAXBQ.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacatggccaggctcccccggctcctcatctatgatgcatccaatagggccactggcatcccagacaggttcagtggcagtgggtctgggacagacttcactctcaccatcagcagtgtagagcctgaagtattttgctagtttattactgtcagtcaccgtgaacaacgtcgccctacgtttcggccctgggaccagacgtgacataccgaacgacctgtcggctgacacctattctgttctctac

SEQ ID NO: 229588 - DNA, 527 bp, Homo sapiens
  misc_feature: GYAE6OF02H2DAU.24.37.D04.1.454.CMB.1.raw
  modified_base (203)..(203): a, c, t, g, unknown or other
  misc_feature (203)..(203): n is a, c, g, or t
  modified_base (392)..(392): a, c, t, g, unknown or other
  misc_feature (392)..(392): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacatgttagagttgttagctggtatcaacacaaacatggccaggcctccccggctcctcatctatgatgcatccaatggccatggcatcccagacaggttcaggtggcaggtgggtctgggacagacttcactctcaccatcagcagtgtagagctagaagtnttttgacttagtttattactgtcagcacgtgacacgtcgaccctacgtttccggccgtgggaccacgacgtaggacactaccgaaacggaaccttggtacggctcgaccacctacttcgtcgttccttactaccg

SEQ ID NO: 229589 - DNA, 540 bp, Homo sapiens
  misc_feature: GYAE6OF02F22H7.24.37.D04.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (312)..(312): a, c, t, g, unknown or other
  misc_feature (312)..(312): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggcccagccggagtgttagtaagtacttaggctggtacccaanagaaacctggccaggctcccaggctcctcatctatgatgtctccaacngggtcactggcgtccccgccaggttcagtggcagtgggtctgggacaggacttcactctcaccgtcagcagcctagagcctgaagattttgcggtttactactgtcagcagcgttcgcctgccgctaacgtttcggcgggggtacaggggtggaggaggaggacgaacgtgtgggcgtgcgaccagtctagttcttcagttccttcccgccattctacgactatacgg

SEQ ID NO: 229590 - DNA, 509 bp, Homo sapiens
  misc_feature: GYAE6OF02GX1F0.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggctccccggctcctcatctatgatgcatccaatagggccactggcatcccagacaggttcagtggcaggtgggtctgggacagacttcactctcaccatcagcagtgtagagcctgaagtattttgctagtttattactgtcagcaccgtgacaacgtcggccctacgtttcggccctgggaccagactggacatccaacgtaactgtggctcgcaccatcctcgttctctac

SEQ ID NO: 229591 - DNA, 594 bp, Homo sapiens
  misc_feature: GYAE6OF02GE6FZ.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggctccccggctcctcatctatgatgcatccaatacgggccacgtggcaatcccagacaggttcagtggcaggtgggtctgggacagacttcgactctcaccatcagcagcctagacgcctagaagtattttgcggtttactacgtgtcagctagtccgttccgccgtcggccgtacgttaaccggtttcggggccgggggggtaccctaggggttcgggaagggagggtacggaaccggaacggtgggtacggccgttggacccgtaacccgtagttccgttaggttcccgtttacgtaccgttcccgttacccccgg

SEQ ID NO: 229592 - DNA, 557 bp, Homo sapiens
  misc_feature: GYAE6OF02I77J4.24.37.D04.1.454.CMB.1.raw
  modified_base (205)..(205): a, c, t, g, unknown or other
  misc_feature (205)..(205): n is a, c, g, or t
  modified_base (287)..(287): a, c, t, g, unknown or other
  misc_feature (287)..(287): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagactactatgtcacgaccggtgctcgatttagtagcatactgttgggtttgggggtagggaacgtgctcagttaggacccagagggaaccatggaagcccagctcagcttctcttcctcctgctactctggctcccagatgccaccggagacattgtgttgacacagtctccagccaccctgtctttgtctccaggggaaanagccaccctctcctgcagggccagtgacaatgttaggagttgtagcctggtatcaacacaaacatggccaggcctccccggntcctcatcctatgatgcatccaatacggccatggcatcccagacaggttcagtgcagtggtctgggacngacttcactcncaccntcagcagtgtaagngcctagaacgtattttcgacttaggtttattacgttgttcagtccaccggtgaacctaactcgggtaccctaaccgtttccggcccgttagggtaccacgacgtcgacagtacccaaacggtactcggtacggcttaggaccaccgtactccgttacgttccttactaccg

SEQ ID NO: 229593 - DNA, 658 bp, Homo sapiens
  misc_feature: GYAE6OF02JLI8Q.24.37.D04.1.454.CMB.1.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
  modified_base (297)..(297): a, c, t, g, unknown or other
  misc_feature (297)..(297): n is a, c, g, or t
  modified_base (522)..(522): a, c, t, g, unknown or other
  misc_feature (522)..(522): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccaggggaaanagccaccctctcctgcagggccagtgacaatgttaggaagtcttagtacncgtagtactacaacaacaatgtcgacgacgtcccgcccgtctccncactactagagtatcgactactaccgtaaggtaccggacctacggtcggactaccgtacccgaacggacgttacgttacgagggtcgacgtacggggttcggtcggtacgggaactacgttacctacctacgttccacccaacgtactacgacgtaccgtagttacggtaacgccgtacgtaaggtaagtttcgtttacgacgtttagttttacctagtcgtacncgtaccgtagtacgaactacggtccgtacccgtttacgttcccgcggtaccgtaacgtcgacgttacgaccctacgtaaccggaacgttaggttcggacgtacgacgtaccctataccgtttcggttcttacctac

SEQ ID NO: 229594 - DNA, 517 bp, Homo sapiens
  misc_feature: GYAE6OF02GUHUK.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagcctggtatcaacacaaacatggccaggctccccggctcctcatctatgatgcatccaatacgggccactggcatcccagacaggttcagtggcaggtgggtctgggacagtacttcactctcaccatcagcagtgtagagcctagaagtatttgctagtttattactgtcagtcacgtgacacgtcgccctacgtttccggccctcgggaccagactgactactaccgaacgtaactggtcgcgtgccacctatctcgttcttctac

SEQ ID NO: 229595 - DNA, 517 bp, Homo sapiens
  misc_feature: GYAE6OF02G7HRZ.24.37.D04.1.454.CMB.1.raw
  modified_base (204)..(204): a, c, t, g, unknown or other
  misc_feature (204)..(204): n is a, c, g, or t
  modified_base (385)..(385): a, c, t, g, unknown or other
  misc_feature (385)..(385): n is a, c, g, or t
  modified_base (468)..(468): a, c, t, g, unknown or other
  misc_feature (468)..(468): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagngccaccctctcctgcagggccagtgacaatgttaggaagttgttagcctggtatcaacacaaacatggccaggctccccggctcctcctctatgctgtctccaccacgggcccctggtcgtcccagccaggttcgttggcggtgggtctgggacagattcactctcacatcagcgcctccngtctgaagtattttgctactttattctgtctaacactatggtgactgtcctccgtactctttggacctagggaccaagtgganatcaaacgactgtgctgcaccatctgtctcattcctcccgctatctacg

SEQ ID NO: 229596 - DNA, 521 bp, Homo sapiens
  misc_feature: GYAE6OF02IIYC1.24.37.D04.1.454.CMB.1.raw
  modified_base (200)..(200): a, c, t, g, unknown or other
  misc_feature (200)..(200): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccaccctgtctttgtctccagggganagagccaccctctcctgcagggccagtcagagtgttagcagcagctacttagcctggtaccagcaagaacctggccaggctcccaggcctcctcctctatgctgtctccaccagggccctggtctcccagcctaggttcgtggcggtgggtctgggacagtattcactctcacatcagcgctcagtctgagtatttgctactttatttcttgtactaactacttatcgtgtactcgtcctccgtactacgtttcggaccgtacgggacaaacgtgacgagtacaacgaacgtagtggctgacactactctgtcttctatcc

SEQ ID NO: 229597 - DNA, 566 bp, Homo sapiens
  misc_feature: GYAE6OF02IAS0K.24.37.D04.1.454.CMB.1.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (363)..(363): a, c, t, g, unknown or other
  misc_feature (363)..(363): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccacctctctgcagggccagtgacaatgtagagttgtagctggtatcanacaaanatggccaggctccccggctcctcatctatgatgcatccaagtacggccactggcactcccagacaggttcagtggctaggtggtctgggacaggtcttcactcncaacatcagcagtagtagagctagaagtatttgactagttttattactgtctagctaacgtgaacgtaacgtcgacccttacgttttccggacccgtcgggaccaacgtaccgtcggacctacgtacccgaaacggtaaccgttggtacggtaccttcggaccctaaccctacgttaccgtttcggttacccttcgtaacccg

SEQ ID NO: 229598 - DNA, 606 bp, Homo sapiens
  misc_feature: GYAE6OF02JH10G.24.37.D04.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaangccacctctcctgcagggccagtgacaatgttaggaagttgtagcctggtatcaacacaaacatggaccaggcctccccggntcctcatctatgatgcatccaagtacgggccactggcatcccaagactggttcagtggctaggtggtctgggacagtacttcactctcaccatcagctagtagtagacgtctagaagtattttagacttagtttacttacttcgtcagtctaccgtagaacctaacgtccggaccccttaacgtttcccggacccgttcggggtaacccaacggtaccgttacgggaccgtacttacccggaaaccggtaacgttcgggtacggtaccgttacggtaccgtaacccgtacgtttccggtacgtttacccttaccgtaacccg

SEQ ID NO: 229599 - DNA, 561 bp, Homo sapiens
  misc_feature: GYAE6OF02JV36U.24.37.D04.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttagaagttgttagcctggtatcaacanaaacntaggccaggcctccccggctccgtcatctatgatgccatcccaatacgggccactggacatcccagacaggttcagtgcagtggtctgggacngtactcactctacacatcagcagtgtanagctagatatttnactagtttatactgtcagctaccgtgacctaacgtcggtaccctacgtttccgggacccttcgggaacctacggtaccgtacgggtacctaaccgtaccgaaacggtacgtggtacggtcctagaccctccgaagttcccgtagttacccttacgtacc

SEQ ID NO: 229600 - DNA, 648 bp, Homo sapiens
  misc_feature: GYAE6OF02GBUNS.24.37.D04.1.454.CMB.1.raw
  modified_base (200)..(200): a, c, t, g, unknown or other
  misc_feature (200)..(200): n is a, c, g, or t
  modified_base (324)..(324): a, c, t, g, unknown or other
  misc_feature (324)..(324): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggngagagccacctctcctgcagggccagccggagtgttagtaagtacttaggctggtaccaacagaaacctggccaggcctccaggctcctcatctatgctgtctccaccgacgggcccctggtcnccccagcccaggttcgttgggcgggttgggtctgggacaggtatttcgactctacaccatcagccggcctaggacgtcctaggaaagtagttttcggtacggttttacttacgttcgtcgagcgtaggtccgttcccgtccgtcggcccgtacgttaaccgttttccggggaccggggggtaccgagggggttacgggagggtacgggacggaacggtaacgttggtcgggcgtcggaccgacctacgttcgtcggttcttaccgtacgttcccgtttaccccgtccctacgttccgttacgaactacgttaggttacgttacg

SEQ ID NO: 229601 - DNA, 543 bp, Homo sapiens
  misc_feature: GYAE6OF02H3OJ9.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagctggtatcaacacaaacatggccaggctccccggctcctcctctatgctgtctccaccagggcccctggtcgtcccagccaggttcgttggcggtgggtctgggacagattcactctcacatcagcggcctccagtctgagtattttgctactttatttctgtctaacactattggtgactggctccgtactacttttcggaccgtacggggaccctaaacgtggagtactacgaaacgtaactggtcgacttgcacctatcttgtcttcacttcccttcccgctactctacg

SEQ ID NO: 229602 - DNA, 570 bp, Homo sapiens
  misc_feature: GYAE6OF02GR0L4.24.37.D04.1.454.CMB.1.raw
  modified_base (204)..(204): a, c, t, g, unknown or other
  misc_feature (204)..(204): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaangccaccctctcctgcagggccagtgacaatgttaggaagttgttagcctggtatcaacacaaacatggccaggcctccccggctcctcatctatgatgcatccaagtcggccatggcactcccagacaggttcagtggcaggtggtcgtgggacagtacttcgacttcacacatcagcaggtgtagagctagaagttatttgactaagttttactacgttgtacgacgctaaccggtcgaacgtaacgtcggtaccccgttacgtttcccgggacccgttacgggaaccgtaacggtacgtcgggactaactacccgaaacgtaacgtggtacggactcgaccacgtagtcttcgttacctcgtac

SEQ ID NO: 229603 - DNA, 545 bp, Homo sapiens
  misc_feature: GYAE6OF02H8XUW.24.37.D04.1.454.CMB.1.raw
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaaccccttctacattccgtccctcgagagtcgagtcaccattcactgagccgtcaagaccagtactccctgacgctgcgtctgtcgaccccgngacacggccgtatcttacngtcgcgggtcttacggtcagttgtgttggcgatgtctgctactaccgcgcgactaagttacgttacggtgggtcgttttggggctacgacgggtacctaccggg

SEQ ID NO: 229604 - DNA, 565 bp, Homo sapiens
  misc_feature: GYAE6OF02HGXMY.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcacgcccccagggaagagcctggagttggttgcgagtatccattatcatgggccaaccccttctacattccgtcctcgagagtcgagtcacctatttcactggacgccgtccaagaccagtacctccctgaggctggcggtctcgtcgacccccggcggaccaccgggccgtattacttactgtcggcgggtcttaggtctagttgtgttggcgtatgtctgcacgtccgcgcgactaagttacgttacggtcgggtcggtttggggaccacggacgggacctaccggg

SEQ ID NO: 229605 - DNA, 525 bp, Homo sapiens
  misc_feature: GYAE6OF02GXS12.24.37.D04.1.454.CMB.1.raw
  modified_base (204)..(204): a, c, t, g, unknown or other
  misc_feature (204)..(204): n is a, c, g, or t
  modified_base (372)..(372): a, c, t, g, unknown or other
  misc_feature (372)..(372): n is a, c, g, or t
tcagactactatgtcacgaccggtgctcgatttagtagcatactgttgggtttgggggaggaaatgctcagttaggacccagagggaaccatggaagccccagctcagcttctcttcctcctgctactctggctcccagatgccaccggagacattgtgttgacacagtctccagccaccctgtctttgtctccaggggaaagngccaccctctcctgcagggccagtgacaatgttaggaagttgttagcctggtatcaacacaaacatggccaggctccccggctcctcatcatgatgcatccaagtcgggccactggcatccccagacaggttcagtggctaggtgggtctgggacaggacttcactcncaccatcagcagtgtagagcctagaagtatttgctagtttattacttgtcagcacgtgaccacgtcgccctactttccggcccgtggaccagacgtcggactactacccaacgtaacctggtcggctgaccaccgattcctgttccttctacg

SEQ ID NO: 229606 - DNA, 585 bp, Homo sapiens
  misc_feature: GYAE6OF02IS6P4.24.37.D04.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
tcagactactatgtcacgaccggtgctcgatttagtagcatactgttgggtttgggggaggaactgctcagttaggacccagagggaaccatggaagtccccagcctcagcttctcttcctcctcgctactctggctcccagatgccaccggagacattggtcgttgacacgagtctccagccaccctgtctttgctcgagggaangccaccctntcctgcaggccagtgactatgtaggattgtagctggtatcaanagaacntgccagctacccggctctcatctatgatgactatccaagtacggccactggcatcccagacagttcagtgctagtggtctagggacagtacttcgactcgtacacctatcagtctacggtgtacgacgtccgtagtaagtattttagacttagtttacttacgtagtcacgtcctacgtgacgtaacgttcgtacccgttacgttttccggcccgttacgggaccctaaggtaccgttacggaccgtacgtacccgaaaccggtaacgtacggtacggtcgtcgtacctaccgtacgttccttacgttaccgttcctaccg

SEQ ID NO: 229607 - DNA, 521 bp, Homo sapiens
  misc_feature: GYAE6OF02JDX4H.24.37.D04.1.454.CMB.1.raw
  modified_base (476)..(476): a, c, t, g, unknown or other
  misc_feature (476)..(476): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggcgtccccgcaggttcagtggcagtgggtctgggacagacttcactctcaccgtcagcagcctagcgcctgaagtattttgcggtttactactgtcagcagcgttcgcctggccgtctaacgttcgggcggggacagggtggagaggagacgatggngcgtgcacagtctgtctcacttcctcccgctactctgactatacg

SEQ ID NO: 229608 - DNA, 537 bp, Homo sapiens
  misc_feature: GYAE6OF02HVPEB.24.37.D04.1.454.CMB.1.raw
  modified_base (201)..(201): a, c, t, g, unknown or other
  misc_feature (201)..(201): n is a, c, g, or t
  modified_base (370)..(370): a, c, t, g, unknown or other
  misc_feature (370)..(370): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgtctccaggggaaanagccaccctctcctgcagggccagtgacaatgttaggagttgttagcctggtatcaacacaaacatggccaggctccccggctcctcatctatgatgcatccaataggccactggcatcccagacaggttcagtggcaggtgggtctgggacagacttcactctcaccntcagcagtgtagagcctagaagattttgcttagtttattactgtcagcaccgtgacaacgtcggaccctacgtttccggcccttcgggaccagactagggacctacgtacccaaacggtaacctggtacggctacggccaacctacgttcctcggttccttactacc

SEQ ID NO: 229609 - DNA, 694 bp, Homo sapiens
  misc_feature: GYAE6OF02I2RWV.24.37.D04.1.454.CMB.1.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (368)..(368): a, c, t, g, unknown or other
  misc_feature (368)..(368): n is a, c, g, or t
  modified_base (498)..(498): a, c, t, g, unknown or other
  misc_feature (498)..(498): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccacctgtctttgtcctccgaggggaaagcgcccaccctctcctgcgaggccagtgacaatggtaggagttgtagcctggtancaacacaaangtgccaggctccccggctcctcatctatgatcgcactaccaagtacgggccacgtcggcactcccgaagacgtaggttcaggtcggctaggtggtacgngggacaggtacttcacctctcaccatcgacgactaggtacgtacgacgtccgtagtaacggtttatttagacgtttaaggttttaacttacggttcggttaaccgacgtcccgttaacccggggttaaanaacccgttaaaccgggttcccggttaacccccgtttacgggtttaccccgggccccggttaacgggtaaaccccgtaagggtacccgtacgggtaaacctaacccggttaacccgaaaaccggttcggttacggtaccggtaccgttaccgaccctaacccgttagttcccgtttacgttacctttacccgtaccg

SEQ ID NO: 229610 - DNA, 531 bp, Homo sapiens
  misc_feature: GYAE6OF02IY3SY.24.37.D04.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacatggccaggctccccggctcctcatctatgatgcatccaagtacgggccacgtggcactcccagacaggttcagtggcaggtggtctgggacagtacttcactctacaccatcagcagtgtagacgctagaagtnttttgctagtttattactgtctagtcaccgtgaacaactcggaccctacgtttccggcccgtagggacccagtacctcggactactaccgaacgtacgtggtcggctgccaccactctcgtcttctacg

SEQ ID NO: 229611 - DNA, 573 bp, Homo sapiens
  misc_feature: GYAE6OF02I1Z70.24.37.D04.1.454.CMB.1.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (399)..(399): a, c, t, g, unknown or other
  misc_feature (399)..(399): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacntggccaggctccccggntcctcatctatgatgcatccaatacgggccactggcatcccagacaggttcagtggcaggtggtctgggacagactccactctcaccatcagcagtgtagacgtcctagaagtnttttggccggttttaactacgttgtacagcagtccgttccgccgtcggcccgtacgttaaccggtttcggggaccgggggtaccgaggggtcggaggaggacgacggtaacggtggtacgggtcgtcggccgtaccgtacgttcgtcgttaccttctacgttcccgttaccccg

SEQ ID NO: 229612 - DNA, 553 bp, Homo sapiens
  misc_feature: GYAE6OF02G073R.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcacatttcactgagccgtcaagaaccagtactccctgagctgcgtctgtcgaccccgcgacacggccgtatattactggtcgcgggtcttaggtcctagtttggtgttggcgtatgtctgcacgtccggcgcgactaagttacgttacggtcgggtcggtttggggcctacggacgggacctaccggg

SEQ ID NO: 229613 - DNA, 579 bp, Homo sapiens
  misc_feature: GYAE6OF02JB6GM.24.37.D04.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (393)..(393): a, c, t, g, unknown or other
  misc_feature (393)..(393): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaanagccaccctctcctgcagggccagtgacaatgtagagttnttagcctggtatcaanacaaacatggaccaggcctccccggntcctcatctatgatgacatccaagtacggccactggacatcccagacaggtcagtggctaggtcgggtctgggactagtacttcactctacaccatcacgctagtgtanacgtctagagtagttttagacttaagtttacttacgttgtacgacgtccgtaccgtagaacctaaccgtcggacccttaacgtttccgggacccttaggggaccctacgtacgttacggactaacgtacccgtaacgacgttggtcgactcgacctaccgtcgttaccgtcgttaccttactaccg

SEQ ID NO: 229614 - DNA, 491 bp, Homo sapiens
  misc_feature: GYAE6OF02GKRP4.24.37.D04.1.454.CMB.1.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgttagcctggtatcaacacaaacatggccaggctccccggntcctcatctatgatgcatccaatagggccactggcatcccagacaggttcagtggcagtgggtctgggacngacttcactctcaccatcagcagtgtagagcctgaagattttgctagtttattactgtcagcaccgtgacaactgccacgtttcgcctggacagactgacatccaaacgaactggtgctgcacatctgtcttcac

SEQ ID NO: 229615 - DNA, 530 bp, Homo sapiens
  misc_feature: GYAE6OF02H2BXH.24.37.D04.1.454.CMB.1.raw
  modified_base (204)..(204): a, c, t, g, unknown or other
  misc_feature (204)..(204): n is a, c, g, or t
  modified_base (406)..(406): a, c, t, g, unknown or other
  misc_feature (406)..(406): n is a, c, g, or t
  modified_base (511)..(511): a, c, t, g, unknown or other
  misc_feature (511)..(511): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaangccaccctctcctgcagggccagtgacaatgttaaggaagttgttagcctggtatcaacacaaacatggccaggcctccccggctctcatctatgatgcatccaagtacggccacgtggcatcccagaccaggttcagtcggcaggtgggtctgggacagtacttcactcctacaccatcagcagtgtagacgctagaagtntttgcttagtttattacgtgtcagcaccgtgactacgtcggacctacgttccggccgtgggaccagactgactactaccgaacgtaactggtacgctgacctacncgttcctagtccttctacc

SEQ ID NO: 229616 - DNA, 706 bp, Homo sapiens
  misc_feature: GYAE6OF02FFPS8.24.37.D04.1.454.CMB.1.raw
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
tcagactactatgtcacgaccggtgctcgatttagtagcatactgttcgggtttgggggaggaactgctcagttacggacccagagggaaccactggaagccccagccttcagcttctcttcctcctgctactctcggccttccctaggatcgccaccggagaccattgngttcgacaccagtctccagtccacctgtctttgtcgtccaggggaangccacctctcgtgcagggccagtgacaatgtaggattgttagcctggtactcaacacaaactatcggccaggtcctccccggactccgtccagtcctaagttgatcggctagtccaaatacgggaccctaacgtgggcactccccaagacctagggttttcaggttgggacaaggtttcggggtacgtggggactaggacctttcgaacctcgtaccaccatcagactagtgtagacgtcctaggaatacttttgacttagtttacttacgtgtacagacctaccgtagaacctaacgttcggtaccccttaacggttttccgggaccccgttaggggaaacccgtacggtaaccgtttacgggtaacctaaccgtttacccggtaaaacccgggtaaccgtttaaccggggtaaccggttccgttacccgaccgttaacccctaacggtttaccccttacgggtttaccccttttaccgtaaccccgg

SEQ ID NO: 229617 - DNA, 596 bp, Homo sapiens
  misc_feature: GYAE6OF02IBK6Z.24.37.D04.1.454.CMB.1.raw
  modified_base (199)..(199): a, c, t, g, unknown or other
  misc_feature (199)..(199): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctcaggggaaangccacgtctcctgcagggccagtgacaatgttaggaagttgttagctggtatcaacacaaacagtcggccaggcctccccggctcctcattctatgatgcataccaagtcggccacgtggcacgtccagacgtagttcaggtggctagggtggtctagggacagtcttacncttcncactatacagcgtagtagtagacgtacgttaggtaagttacgttttgacgttaagtttacttacgtgtacgtagcgtaaccgtgtaacacgtccgacccgttacgttaccggaccgtcggaaccgtacgtacgtacgaccgtacgtacccgtaacggtacgttcggtaccggtacgtcgtaccctaccggtactttaccggttcgttaccttccgttaccg

SEQ ID NO: 229618 - DNA, 566 bp, Homo sapiens
  misc_feature: GYAE6OF02GJEXI.24.37.D04.1.454.CMB.1.raw
  modified_base (201)..(201): a, c, t, g, unknown or other
  misc_feature (201)..(201): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagaaattgtgttgacacagtctccaggcaccctgtctttgtctccagggganagagccaccctctcctgcagggccagccggagtgttagtaagtcttaggctggtaccaacagaaacctggccaggctcccaggctcctcctctatgctgtctccaccgacgggcccctggtcgtcccagccaggttcgtggcggtgggtctgggacagtattcactctcaccatcagcgcctccagtctagaagtatttgctactttatttctgtcaactactagtggtgtactcggtcctccgtactacgttttggccgtacggggacctaaacgtggaagtactacaaacgaacgtagtcggtctacgactaccgaattccttagtccttctacttccttcccgcctactcctacgactaacg

SEQ ID NO: 229619 - DNA, 604 bp, Homo sapiens
  misc_feature: GYAE6OF02I36Q7.24.37.D04.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (413)..(413): a, c, t, g, unknown or other
  misc_feature (413)..(413): n is a, c, g, or t
  modified_base (448)..(448): a, c, t, g, unknown or other
  misc_feature (448)..(448): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagaaattgtgttgacacagtctccagccaccctgtctttgtctccaggggaaangccacctctcctgcagggccagtgacaatgtagagttgtanctgtatcaananaacntggcaggcctcccggntcctnatctatcgatgctataccaagtacggccactggacctatcccagactaggtccagtggactaggtcgggttccaggggacagtacctttcaaccgtctacccgacatccgagcagtgtagacgcctagagtntttgactagtttattactgtacgagtcctacggtntaacgagtcgtaccccttagttacccggcccgtacggacctaacggacgttcggaacctacgtacccgtaacggaaaccgttcggtaggtacccttacggacccctaacgtacgttcccgttacgtttacccgtttacccgtagtttaaccccccg

SEQ ID NO: 229620 - DNA, 545 bp, Homo sapiens
  misc_feature: GYAE6OF02HBAF4.24.37.D04.1.454.CMB.1.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
  modified_base (334)..(334): a, c, t, g, unknown or other
  misc_feature (334)..(334): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacntggccaggctccccggctcctcatctagtggtgcgtccaccgagggccacgtggcgtcgcggacnggttcagtggcaggtgctttgggacagacttcactctcatcatcgacagactggacgccgaagtagttttgctagttgtattacgtgttcagtcttgttcgtccctcttcctctattgtactacgttttcggccgtacgggttccgtaggtcgtggtacgtatacgaacggcgtaacgtgtacggtcgtcgcaccgtatcgttcgttcttc

SEQ ID NO: 229621 - DNA, 495 bp, Homo sapiens
  misc_feature: GYAE6OF02IP6RT.24.37.D04.1.454.CMB.1.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggagttgtagcctggtatcaacacaaacntggccaggctcccccggntcctcatctatgatgcatccaatagggccactggcatcccagacaggttcagtggcagtggtctgggacagacttcactctcaccatcagcagtgagngctgaagtatttgctagtttattactgtcagcacgtnacactcgcctacgtttcgccctgggaccagctagacatccgaacgaactggtgctgccactatctgttcctctac

SEQ ID NO: 229622 - DNA, 560 bp, Homo sapiens
  misc_feature: GYAE6OF02HQ42Z.24.37.D04.1.454.CMB.1.raw
  modified_base (213)..(213): a, c, t, g, unknown or other
  misc_feature (213)..(213): n is a, c, g, or t
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccaggggagagagccaccctntcctgcagggccagccggagtgttagtaagtacttaggctggtaccaanagaaacctggccaggctcccaggctcctcatctatgatgtctccaagngggtcacgtggccgtccccgcaggttcagtcggcaggtcgggtctgggacagacttcactcncaccgtnagcagcctagacgcctagaagtatttgcgtttactacgtgtcagcagtccgttccgcgtcggccgtcgttaacgtttcgggcgggggaccgtagggtcggaggagggagacgaacgtggcggcgtgacctaccgagtcgtcgtcgttctacgttccttcccgctactctacgtactatacg

SEQ ID NO: 229623 - DNA, 567 bp, Homo sapiens
  misc_feature: GYAE6OF02GJUCG.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagccaccctctcctgcagggccagtgacaatgttaggaagttgttagcctggtatcaacacaaacatggaccaggcctccccggctcctcatctatgatgcatccaagtacgggccacgtggcactcccagacaggttcaggtggcgtaggttcgggtctggggacaggtacttcacttcacacctatcgagactagtgtacgacgtcgtagaagttatttcgacttagttttacttacgtgtacagtcctaccgtgaacctacgtcggtacccttacgttccggcccgtgggaccagacgtgactacgaccgtaaacgtacgtcggtggctacgcctaccgtacttcgtcgttccttactacc

SEQ ID NO: 229624 - DNA, 544 bp, Homo sapiens
  misc_feature: GYAE6OF02IKTQP.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccccagggagagcctggagttggttgcgagtatccattatcatgggcgaacccccttctacattccgtccctcgagagtcgagtcaccatttcactggagccgtccaagaaccagtacctccctgaggctgcggtctgtcgaccccccgcggacacggccgtatattactgtgcgggcttaggtcagttgtgttggcgatgtctgcaccgtaccgcgcgcaattattacggtgggcggtttgggcacgagggacctaccggg

SEQ ID NO: 229625 - DNA, 524 bp, Homo sapiens
  misc_feature: GYAE6OF02GCSDH.24.37.D04.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (396)..(396): a, c, t, g, unknown or other
  misc_feature (396)..(396): n is a, c, g, or t
  modified_base (504)..(504): a, c, t, g, unknown or other
  misc_feature (504)..(504): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgctccagggganagagccaccctctcctgcagggccagccggagtgttagtaagtacttaggctggtaccaanagaacctggccaggctcccaggctcctcatctatgatgtctccaacagggtcacgtggccgtccccgcaggttcagtcggcagtgggtctgggacagacttcactctcaccgtcagcagcctagcgcctgaagtnttttgcggtttactactgtcagcagtcgttccgccgtggccgcttaacgtttcgggacgggggtacagggtggagaggacgacgtaactggtgctgcacatctgtctnatcttccgcatcngacntag

SEQ ID NO: 229626 - DNA, 490 bp, Homo sapiens
  misc_feature: GYAE6OF02F0JMC.24.37.D04.1.454.CMB.1.raw
  modified_base (203)..(203): a, c, t, g, unknown or other
  misc_feature (203)..(203): n is a, c, g, or t
  modified_base (355)..(355): a, c, t, g, unknown or other
  misc_feature (355)..(355): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggcctccccggctcctcatctatgatgcatccaatagggccactggcatcccagacagttcagtgcagtggtctgggacngacttcactctcaccatcagcagtgtagagctgaagtatttgctagtttatactgtcagcacgtgacactcgcctacgttcggcctgggaccagactggacatccgaacgactgtgctgcacatctcgtctctac

SEQ ID NO: 229627 - DNA, 538 bp, Homo sapiens
  misc_feature: GYAE6OF02FZ00V.24.37.D04.1.454.CMB.1.raw
  modified_base (432)..(432): a, c, t, g, unknown or other
  misc_feature (432)..(432): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcagtgggccgaacccccttctacacttccgtccctcgagagtcgagtcaccatttcactggagccgtccaacgaaccagtacctccctgacgctgcgtctgtcgaccccgngacacggcgtatattactgtgcggcttaggtctagttgtgttggcgtatgtctgcacgtacgcgcgactaattatacggtggtcgttgggcacgaggacctaccgg

SEQ ID NO: 229628 - DNA, 676 bp, Homo sapiens
  misc_feature: GYAE6OF02GST0Q.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagaaattgtgttgacacagtctccaggcaccctgtctttgtctccaggggagagagcccaccctctcctgcagggccagccggagtgttagtaagtacttaggacgtgtacgaaccaagaaacgtacgccgacggacgtcccacggacgtcctccactctacttgatagtctccaacaacgggtcgtacctacggccggtccccgcccgacggtttacgtacggtgggtcgacgtggggttcggtcgggacggagtacgttcctacgtacttccaccgttccgagaccgacgccgtacgaggccctagtaaggtaacttttttgtcgggttaacgttacctgttcaacgcgtagtcggtttcccgccgtcgtaccggcctttaaccggttcgggccgggggggggacctagggtgggggtagacgggtaggaaccggaacgttacgtgggcctgaccgaccctaattcgttcgttacgttcctaacgtttccgttccccggtaccacgttacttaggaacctaacgg

SEQ ID NO: 229629 - DNA, 574 bp, Homo sapiens
  misc_feature: GYAE6OF02G4KQ6.24.37.D04.1.454.CMB.1.raw
tcagactactatgtcacgaccggtgctcgatttagtagcatactgttgggtttgggggggaaatgctttctgagactcatggacctcctgcgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggagagcctggagttggttgcgagtatccattatcatgggccgaacccccttctacacttccgtccctcgagagtcgagtcacctatttcactggacgccgtaccaagaaccagtactccctgaggctggcgtctgtcgacccccgcggacacggccgttatacttacgtgtcgcgggtcttagggtcctagtttggtgttcgggcgtagtgtctgtccactccggcgtcgactaatttacgttacggttcggggtcggtttcgggactacgacggggacctaccggg

SEQ ID NO: 229630 - DNA, 548 bp, Homo sapiens
  misc_feature: GYAE6OF02GV5M6.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcaccatttcactggagccgtccaagaaccagtacctccctgaggctgcggtctgtcgacccccgcggaccacggccgtatacttactgtgcgggcttaggtctattgtgttggcgtatgtctgcactaccggcgcgcaattattacggtgggtcggtttggggctacgacgggacctaccggg

SEQ ID NO: 229631 - DNA, 535 bp, Homo sapiens
  misc_feature: GYAE6OF02F36DI.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaaacacaaacatggccaggctccccggctcctcatctatgatgcataccaagtacgggccacgtggcatcccaagacaggttcaggtggcaggtcgggtctgggacagacttcactctcaccatcagcagtgtagacgctgaagtatttcgacggtttaactactgtcagcgagtccgttccgccgtcggccgtacgttaacgtttcgggccgggggtaccaggggtggagagggagacgacgtggagcgtgcacgatctgtctctactcctcccg

SEQ ID NO: 229632 - DNA, 616 bp, Homo sapiens
  misc_feature: GYAE6OF02G7U44.24.37.D04.1.454.CMB.1.raw
  modified_base (338)..(338): a, c, t, g, unknown or other
  misc_feature (338)..(338): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggtgcgagtatccattatcagtgggcaacccccttntacattccgtcctcgagacgtcgacgtcactatttcacgtgacgccgtaccaacgaaccctacgtaacctccccgtagaacgggtcctacggtcccgggttactcgggtacccgaccccccggcggaaccgaccgggtacccgttaacttacgttaactcggtcggtcgggtcctttacgggtactagttggtcgtttcgggcgtatgtctcgctaccgtccgccgcgactaagttacgtacggtgggtcggtttgggctaacggcggaccgtaccgg

SEQ ID NO: 229633 - DNA, 554 bp, Homo sapiens
  misc_feature: GYAE6OF02GDSCU.24.37.D04.1.454.CMB.1.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgagaatgttggcagcaacttagccttggtaccagcagaaacctggccaggcctcccgaggctcctcctctatgctgtcctccaccgacgggcccctgggtcgtcccagcctaggttcgtggcggtggtcgtgggacngtatttcactctcacntcagccgcctcngtcngtagtntttgctactttattcttgtactaactactattggtgtacgtcggtccgttccgtacgtacgttttcggaccgtacgggacctaagtcggagtacgtacgaacgacgtgtcggtctcgacaccgtatcttcgtcttctactccttcccgctac

SEQ ID NO: 229634 - DNA, 551 bp, Homo sapiens
  misc_feature: GYAE6OF02H1KA9.24.37.D04.1.454.CMB.1.raw
  modified_base (202)..(202): a, c, t, g, unknown or other
  misc_feature (202)..(202): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccaggggaaangccaccctctcctgcagggccagtgacaatgtaggagttgtagctggtatcaacacaaacatggccaggcctccccggctcctcatctatcgatcgacataccaagtacggccactggacatcccaagcaggttcaggtggcaggtgggtctggganagtacttcgatctcacatcagcagtganagctagaagtntttgactagtttagtactgtacagtcaaccgttgaactaaccgtcggtaccctacgtttccggcccgtacgggaccacggtactggacctactacccgaaacgtaacgttggacggtctacgtccacctagttaccgtcgttccttactaccg

SEQ ID NO: 229635 - DNA, 567 bp, Homo sapiens
  misc_feature: GYAE6OF02IYAFX.24.37.D04.1.454.CMB.1.raw
  modified_base (505)..(505): a, c, t, g, unknown or other
  misc_feature (505)..(505): n is a, c, g, or t
tcagactactatgtcacgaccggtgctcgatttagtagcatactgttgggtttgggggggaaatgctttctgagactcatggacctcctgtgcaagaacatgaagcacctgtgttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattggcctggatccggcagcccccgagggaagagcctggagttggttgcgagtatccattatcatgggaccgaaccccctttctacctacttccgtccctcgacgagtcgagtcacctatttcactggacgccgtaccaaagaaccacgtacctccctgacggctgcggtctgtcgaccccgcgacacggcctatacttactgtcgcggtcttagtcagttcgtgttgcgattgcgtgcacgtccgngtccgtactaaattcgttacggttacgggtccggttggggacctacggtacggacctaccgg

SEQ ID NO: 229636 - DNA, 676 bp, Homo sapiens
  misc_feature: GYAE6OF02J0RY0.24.37.D04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
tcagactactatgtcacgaccggtgctcgatttagtagcatactgttgggtttgggggaggaacgtgctcagttaggacccagagggaaccatggaagccccagctcagcttctcttcctcctgctactctggctccagatgccaccggagaccattgtgttgacacagtctccagccacctgtctttgctaccaggggaancgccaccctntcctgcagggccagtgacatgtaggattgtagctggtatcaanacaaacntggcaggctccccggntcctnatctatgatcgctagtacccaagtacgggtccaacgttggacctaccgtccccaaggtacctacgggtttacaaggttcgggacgtaagggttcggggtctaggggaacctaggtacctttcgaacgttcctaccaacctatcgaacgtcgtaacggtagttacgacgcccgttaagaaagttacgttttgacgttagttttactttacgtcggttacacgtacgtaccggttagaacctaaccgttccggacccgttacgtttccggaccccgttggggaacccctaggtacccggtgaacccgttcgtaccccggaaacggtaacttcgggtaacgggttcctacgtacccgaccgttatttcccgttacggtttacccttccgttaaccg

SEQ ID NO: 229637 - DNA, 550 bp, Homo sapiens
  misc_feature: GYAE6OF02I1792.24.37.D04.1.454.CMB.1.raw
  modified_base (204)..(204): a, c, t, g, unknown or other
  misc_feature (204)..(204): n is a, c, g, or t
  modified_base (402)..(402): a, c, t, g, unknown or other
  misc_feature (402)..(402): n is a, c, g, or t
tcagactactatgtcacgaccggtgctcgatttagtagcatactgttgggtttgggggaggaactgctcagttaggacccagagggaaccatggaagccccagctcagcttctcttcctcctgttactctggctcccagatgccaccggagacattgtgttgacacagtctccagccaccctgtctttgtctccaggggaaagngccaccctctcctgcagggccagtgacaatgttaggaattgttagcctggtatcaacacaaacatggccaggctccccggctccctcatctatgatgcatccaatagggccactggcactcccagacaggttcagtggcaggtgggtcagggacagtacttcacgtctcaccatcagcagtgtagagcctaggaagtntttagactagtttaattacttgtacaggctaccgtagaccaactccggacccgtactttcgggcccgtacgggacctaggaccttgggactagtaccaaccgtacgtcgtggactcgcaccgtattcctcgtctttacctgttacccg

SEQ ID NO: 229638 - DNA, 555 bp, Homo sapiens
  misc_feature: GYAE6OF02FWSCA.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattggcctggatccggcagcccccagggaagagcctggagttggttgcgagtatccattatcatgggccgaacccccttctacattccgtccctcgagagtcgagtcaccatttcactggacgccgtaccaagaaccagtactcccgtgagctgcggtctgtcgaccccgcggacgacggccgtatacttactgtcgcggcgttaggtctagttgtgttggcgtagtgtcgtgcactaccggcgcgactaattagttacggtgggtcggtttggggctacgacgggaccgtaccgg

SEQ ID NO: 229639 - DNA, 594 bp, Homo sapiens
  misc_feature: GYAE6OF02F3PVH.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattggcctggatccggcacgcccccgagggaagagccgtggagttggttgcgagtactccattatcagtcgggaccgtaacccccttctactacttcccgtccctcgagagtcgagtttcacctactttcactggacgccgtaccaacgaaccacgtacctccctgacggctggccggtctcggtccgacccccggcggaccgaccggccgttatattacgtggtcggtcgggtcttaggtctagtttcgtgttgggcgtatcgtctgctacgtaccgcgcgtactaattacgttacggtcgggttcggttgggccacggacgggaccgtaccgg

SEQ ID NO: 229640 - DNA, 737 bp, Homo sapiens
  misc_feature: GYAE6OF02IL6SY.24.37.D04.1.454.CMB.1.raw
  modified_base (251)..(251): a, c, t, g, unknown or other
  misc_feature (251)..(251): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacanagtattattattggcctggactccggcacgcccccagggaagagcctgggagttggtgcgtagtatccgatttactcgagtcgggaccgaacccccttcgtactacgttccgtccctacgacgtacgtcgagtccacctagtttccacgtggacgtcccgtaccaaagtaacccgagtaccctcccgttaggaacgggtctggtaccggttccgtcggttacccggaccccccggtacggaacccgacccggtaccgttaacgttacgtttaaccgtggttaccggcggggtccgtttaacgggttccaagttttcggttggtttcgggaccggttagttacggtttcgtaccgggttaccctaaccggttacccggtaccggtccgtaaccgtaacgtttttaacggtttaacccggttgggggttacccgggttttacgggggacccgtaaacccggttacggggtaaccccgttaacccgggg

SEQ ID NO: 229641 - DNA, 590 bp, Homo sapiens
  misc_feature: GYAE6OF02IIZJO.24.37.D04.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggctcccagatgccaccggagacattgtgttgacacagtctccagccacctgtctttgtctccaggggaanagccacctctcctgcagggccagtgacaatgttaaggaagttgttagcctggtatacaacacaaacatggccaggcctccccggctcctcatctatgatgcatccaatcgggccagtgcactcccagactaggtcaggtgcaggtggtcngggacagtactcactctacacctatcagcagtgtagacgtcgtagaacgttatttcgtacttagttttacttacgttcgtacgacgtacctaccggtagtaaccgtaaccgtccggtaccccttaccgtttccgggaccccgttacgggacctaacggtacgtacggacctacgtacccgaacggtaaccgtggtcggtactacggaccaacgtacttccgtcgttccttactacccg

SEQ ID NO: 229642 - DNA, 551 bp, Homo sapiens
  misc_feature: GYAE6OF02GOJQH.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggaagttgttagcctggtatcaacacaaacatggccaggcctccccggctcctcatctatgatgcatccaatacgggccacgtggcatcccagacaggttcagtggcagtgggtctgggacagacttcactctcaccatcagcagtgtagacgcctagaagtattttgacttagtttattacgttgtcagtctaccggtgaactaacgtcggtaccctacgtttccggcccgtgggaccagtaccgtggacactaccgaacgtaacgtggtacggccttacggcctacctagttcctcgttaccttctacccg

SEQ ID NO: 229643 - DNA, 799 bp, Homo sapiens
  misc_feature: GYAE6OF02H7JE6.24.37.D04.1.454.CMB.1.raw
  modified_base (207)..(207): a, c, t, g, unknown or other
  misc_feature (207)..(207): n is a, c, g, or t
  modified_base (305)..(305): a, c, t, g, unknown or other
  misc_feature (305)..(305): n is a, c, g, or t
tcagactactatgtcacgaccggtgctcgatttagtagcatactgttgggtttgggggaggaactgctcagttaggacccagagggaacatggaagccccagctcagcttctcttcctcctgctactctggcctcccagatgccgaccggagacattgttgtttgacactagtctccagcccacctgtctttgctccgaaggggaancgccacctcgtctgcgagggccagtcgacaattgttaggaagtttgttacgccttggtatccaaacaacaaacagtcggaccaggcccttccccggtnttccctacgaattcctaagtcgtaacgttcgacctaagtacccgtaaagttaccggggaccctaacggttcgggacctacgtaccccgaagtaaccgtaaggtttaccaaggttcggacgtagggttcgggtacctaggggaactaaggtcctttacaccgttcctaccgaacctagtaccaagcgtaaggttacgtaaggaccgtaccgttaaggaaacggtttagtttttacggacttttaagtttttaacgttaccgttacgtacctaacggacccgttaacccgggttacgtaaaacccgtaacggttcccgggtaacccccgtttaacggtttaccccgggacccgttaaccggggaacccttaaaccgggttaccgtaacggtaaccctaaccgtttacccggaaaacggttaccgttgggaccggttaccttaaccgggacccttaaccgttaccgtttcccgttacgttttacccgtcttaacccg

SEQ ID NO: 229644 - DNA, 618 bp, Homo sapiens
  misc_feature: GYAE6OF02H9ZCW.24.37.D04.1.454.CMB.1.raw
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggagacattgtgttgacacagtctccagccaccctgtcttttgctccgaggggaaanacgcccaccctctccctgccgagggccaaggtcgaacaatggttaacggaagtttgttagcctggtatcaacaacaaaacatgggaccaggcctccccggtctcctacntactatgatgcanaccaagtacggcacgtcgacactcccagacgacggttcaggtcggctaggttgggctagggactagacttcactctacaacgtactcgaacgcgtagtagtagaacgccttagaaagttagtttcgactaagtttacttacgtntacgacgtctaccgtanaaccgtaacgtccgtaccctacggtttcccgaccgttacgggaacaccgggtactacggtactaccgtaccgaaacgttaacgttcggtaacggtcgtacgaccgtaccaattcgtacttcgtctaaccg

SEQ ID NO: 229645 - DNA, 555 bp, Homo sapiens
  misc_feature: GYAE6OF02IGZVO.24.37.D04.1.454.CMB.1.raw
  modified_base (204)..(204): a, c, t, g, unknown or other
  misc_feature (204)..(204): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanagcccaccctctcctgcagggccagtgacaatgttaggaagttgttagcctggtatcaacacaaacatggccaggcctccccggctcctcatctatgatgcataccaagtagggcccagtggccatcccagactaggttcagtggcaggtgggtctgggacagcttcactctccacatcagcagtgtacgtagcctagaagtattttgcttagttttatacgttgtcacgtcaccgtgacctacgtcgaccctacgtttccggacccgttcgggacctacgcgtacggactactaccgaacgttaacgtggtacgcgtacgcctaccgtcttacgtcgttaccttctaccg

SEQ ID NO: 229646 - DNA, 633 bp, Homo sapiens
  misc_feature: GYAE6OF02F0UDX.24.37.D04.1.454.CMB.1.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggagttgttagcctggtatcaacacaaacntggccaggcctccccggctcctcatctatgatgctataccaagtacgggcctagtcggacactcccgagtaccgtaggttcaggttggcgtaaggttggggtaccgtggggaactagtaccgtttcgaaccttcctaccaacccattaccgacgtacgtaggttacggtaacggacgtccgtaggtaagttagttttcgactttaagttttacttacttgtacacgtcctaccggtagaaccgtaacgtccggtacccttaccggtttcccggcccgttacgggaacctacggtacgtacggactactacccgaacgtacgttggtcggtccgtagacctacgtatacgtcgttacttactaccg

SEQ ID NO: 229647 - DNA, 544 bp, Homo sapiens
  misc_feature: GYAE6OF02HVR4L.24.37.D04.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctccaggggaaanagccaccctctcctgcagggccagtgacaatgttaggagttgttagctggtatcaacacaaacatggccaggcctccccggntcctcatctatgatgcatccaatcggccatggcatccagacaggttcagtggcaggtgggtctgggacagtcttcactctacaccatcagcagtgtagagtctagaagtattttgacttagtttattactgtacagtaccacgtagaacctaacgtcggtaccctacgttccggcccgtgggaccaggacgtacggactacgtacccgaaacgtactggtcgactcgacctaacctagttccgttacgttccttctaccg

SEQ ID NO: 229648 - DNA, 651 bp, Homo sapiens
  misc_feature: GYAE6OF02IT6FB.24.37.D04.1.454.CMB.1.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
tcagactactatgtcacgaccggtgctcgatttagtagcatactgttgggtttgggggagggaactgctcagttaggacccagagggaaccatggaagccccagctcagcttctcttcctcctgctactctggctcccagatgccaccggagacattgtgttgacacagtctccagccaccctgtcttgtctccgaggggaanagccaccctctcctgacagggccagtcgacaatggttaaggagttgtacgctggtatcaacacaaacntggccaggccaccccggntcctcatctatgatcgccataccaagtacgggcctacgtcggacactcccaggaccgagttcaaggtggctagggtcgggtctgggaacaggtaccttcgacttcacgaccctagtccagtacaggttagaggacgaccgtaggtaacttagttttacggacgtttaagttttaacttacgtagttaccgtacgtaccgtacgtcgaaaccgtaccgtaccgtacccgttaacggttttcccggacccggttacggaccctaacggacttacgggaacctacgtacccgtaaacggtaacctggggtaccgaccgtacggaccctaaccgtacgttacctcgtttaccgttaccttaaccgg

SEQ ID NO: 229649 - DNA, 673 bp, Homo sapiens
  misc_feature: GYAE6OF02FMFR6.24.37.D04.1.454.CMB.1.raw
  modified_base (209)..(209): a, c, t, g, unknown or other
  misc_feature (209)..(209): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatcgccaccggagactattgtgttgacacgagtctccagcccacctgttctttgtcctccgaaggggaancgccacctctcctgcgacgggccagtgacaagtggttaaggaagttgtacgccttggtactacaacacacacatgccaggcctcccggctcctcactctactgatgcataccaagtacgggccacgtggcactcccagacgtaggttcaggtcggctaggtcgggtcgtcggggacaggtacttccacgttcctaccaaccacttacgacgcgtagtaggtaacggacgccgtaggtaaagttacgttttcgacgttaagttttaactttaacgttcgtacgaacgtaccgtaaccgttagaacctaaaccgtccggtaccccttaccgttttcccgggaccccgttacggggaacccgaacgtaaccgttacgggaaccgtaacgtaaccccgaaacgtaaccgttcggtaccggtaccgttcggacctaacccgtaattccggttacgttaccctttacccg

SEQ ID NO: 229650 - DNA, 612 bp, Homo sapiens
  misc_feature: GYAE6OF02HSAH4.24.37.D04.1.454.CMB.1.raw
tcagactactatgtcacgaccggtgctcgatttagtagcatactgttgggtttgggggggaaatgctttctgagactcatggacctcctgtgcaaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagtattattattgggcctggactccggcacgcccccagggaagagcctggagttggttgcgagtatccattatcatcgggccaaccccttctactacttccgtccctcgagagtcgacgtcacctatttcacgtggacgccgtaccaagaaccacgtacctccctagacggctggcgtctcgtcgacccccggcggacaccgggcctaattacttacgtggtcggcgggtcgtttaggtctagtttcgttggttcggcgtatgttctggcctaccgtacccggcgaccgtactaagtttacgtttaccgggtcggggttcgggtttgggggacctaacgggtacgggacccgtacccggg

SEQ ID NO: 229651 - DNA, 783 bp, Homo sapiens
  misc_feature: GYAE6OF02G48XI.24.37.D04.1.454.CMB.1.raw
  modified_base (139)..(139): a, c, t, g, unknown or other
  misc_feature (139)..(139): n is a, c, g, or t
  modified_base (150)..(150): a, c, t, g, unknown or other
  misc_feature (150)..(150): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
tcagactactatgtcacgaccggtgctcgatttagtagcatactgttgggtttagggggaggaactgctcagttaggaccagagggaaccatggaagcccagctcagcttctcttcctccgtgctactctggctccagntcgccacgganactattgtgttgacacagtctccagcctacccttgtcctttgtactccgaagggaaancgcctaaccctntcctgcgacgggaccagtcgaactaagtggttaacggaagtttcgttaagccgttaggttaacncgtaacacgaaacgtgtacgccgaaggcctaccccggactacctacgacttctacgtcgatcgactaacttaccgaattacgggcctaacgtttacgacgtaaccgttaccccgagtaaccgtaacgggtttccaagggttcggacgtagggttcggtacggtacgggaacgtacgtacgttttacgaccgttacctaccgtaaccgtactacccgaagtccgtaagggtacgtacggtaaacggtcccttaacggtaagttaacgttttcggtaacgttttacggttttaactttaccgtttacggttacctaacgttaccgtacccgttaacgtaaccttaaccggttaccggttaacccttacggttttaacccgggtccgtttacgggaaacccttaggtacccgtacggtaaccgtaccgtaaccggtaacgacgttacggtacgtaccggtacggtacctaaccggtcgttaccgtcgtttactccctaaccg

SEQ ID NO: 229652 - DNA, 566 bp, Homo sapiens
  misc_feature: GYAE6OF02HIKF4.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgttaggagttgttagcctggtatcaacacaaacatggccaggcctcccccggctcctcatctatgatgcatccaatacgggccactggcactcccaagacaggttcagtggcaggtggtctgggacagacttcactctacacatcagcagtgtagacgctagtaagtatttgacttagtttattactgtacagtctaccggtagaacctacgtcggacccttacgtttccgggcccgttacgggaccacggtaccgtacggactacgtacccgaaacggtaacgttcggtacggtctcggacctacctacttccgtcgttaccttactaccg

SEQ ID NO: 229653 - DNA, 627 bp, Homo sapiens
  misc_feature: GYAE6OF02HZ4XU.24.37.D04.1.454.CMB.1.raw
  modified_base (201)..(201): a, c, t, g, unknown or other
  misc_feature (201)..(201): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagccatcaccggaggaattgtgttgacgcagtctccaggcaccctgtctttgtctccagggganagagcccacctctcctgcagggccagtcagagtgttagcagcagctacttagcctggtaccagcagaaacctggcctggctccaggctcctcatctatggtgcgtaccaagtacgggccacgtggcactcccagactagttcagtgactaggtggtcgtgggacagtacttcgactctaccgactctacagactaggtcggtagacggtcctaggtaagtagtttttacggactttaagttttacgtttaacgtcgtacgtaacgtccgttaaccgtagaccgtaacgtccggtacccgttaaccgtttcccgggacccgttaccggggacctacgggtaccttagggaacctacgtaacccgtaaacgtaaccgttacggtcggtaccgttacggacctacccggtacttccggtagttttaccc

SEQ ID NO: 229654 - DNA, 544 bp, Homo sapiens
  misc_feature: GYAE6OF02FOYN8.24.37.D04.1.454.CMB.1.raw
  modified_base (433)..(433): a, c, t, g, unknown or other
  misc_feature (433)..(433): n is a, c, g, or t
tcagactactatgtcacgaccggtgctcgatttagtagcatactgttgggtttgggggggaaatgctttctgagactcatggacctcctgtgcaagaacatgaagcacctgtggttattcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccccagggaagagcctggagttggttgcgagtatccatatcatgggcgaacccccttctacacttccgtccctcgagagtcgagtcaccatttcactggagccgtccaagaaccagtactcctgaggctgcgtctgtcgacccccgcggacncggccgtatattactgtgcgggcttaggtcagttgtgttgcgtatgtctgcacgtaccgcgcgactaattattacggtcgggtcgtttggggctacgacgggacctaccgg

SEQ ID NO: 229655 - DNA, 537 bp, Homo sapiens
  misc_feature: GYAE6OF02FKDPD.24.37.D04.1.454.CMB.1.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (526)..(526): a, c, t, g, unknown or other
  misc_feature (526)..(526): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccagggggaaanagccaccctctcctgcagggccagtgacaatgttaggaagttgttagcctggtactcaacanaaacatggccaggcctcccccggntccctcactctatgatgcatccaaatagggccacgtggcatcccagacaggttcagtgcaggtgggtctgggacagacttcactctacacatcagcagtgagacgtcctagaaagttatttcgacttagtttacgttacttgtacagtcaccggtagacaacgttcggccttacgttccggaccgtacgggacctaagcgtgacactaccgaagacgtgcggtctagcactattcncgttctctacg

SEQ ID NO: 229656 - DNA, 644 bp, Homo sapiens
  misc_feature: GYAE6OF02JCPKP.24.37.D04.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (447)..(447): a, c, t, g, unknown or other
  misc_feature (447)..(447): n is a, c, g, or t
tcagactactatgtcacgaccggtgctcgatttagtagcatactgttgggtttggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcgganaccctgtccctnatttgcttctgtctctaggtgaccttccttcaagttaaccacgagtatttattattgggcctggacgtccggcacgccccccgagggaagagcctggtggttgtgcgagtaactcctattatcgagtcgggccgtaacccccttacttacctacttcccgtcccttacggacgacgtcggacgtacctacctatttccgacttggacgtcccgtaacgacgaacacgtaccnccctgacggctcggcggtctcgcgtaccccgcggaccgacggccgtagtacttacgtgacggtcggtgtacgttgtacgttgtcgttgacgtacgtcgtcgtcgaccgttacgacccggtcgaccgtataaaccgttgtttaaccgggtcgggttcggtttcggggaccgtaacctacgggggtaccctaacccggg

SEQ ID NO: 229657 - DNA, 929 bp, Homo sapiens
  misc_feature: GYAE6OF02HRJED.24.37.D04.1.454.CMB.1.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacatttgtgttgacacagtctccagccaccctgtctttgctccgaggggaaangccacctntcctgcagggcagtnacaatgttaggattgtagcctaggtatacaacacaaacatcggacctaggcctcccccggcttccctacacttactattgacttcgactactaccaaagttacggggccctaacgtcgggacctaacgtaccccgaaggtacgtaacggtttcgaacggttcgggacgtaacgggttcggggttaccgttaacgggggacctaacgggtaccttttaccgaacccgtttccgttaacccgaaaccctaagttacccgtaaacggtaccgaacgggtttaacgggttaacgggaaacgggttaccccgtttaaagggtaaaaaccggtttaggttttttaacggtaaacccgtttttaaaggggttttttaaaccttttaaccgtttacgggttaacccgtaacgggttaaccccggaaacccgggttacgggtaaaaaccccttaaaacccgggttaccccggggttaaccccctttaaaccccggggtttttaccccggggtacccccggtttaaccggggggtaaaacccccttaaacggggtaaaccccgttagggggtaaaacccttaaccgttaaccccgggtaaaaccggttaaaccgtttaccggggtaaccgggttaaccgttaccggtaaccccggttaaaccttaaccttcccgggtttaaaccgttttcccggtttaacctttaaccccgg

SEQ ID NO: 229658 - DNA, 552 bp, Homo sapiens
  misc_feature: GYAE6OF02IU1AG.24.37.D04.1.454.CMB.1.raw
  modified_base (236)..(236): a, c, t, g, unknown or other
  misc_feature (236)..(236): n is a, c, g, or t
  modified_base (292)..(292): a, c, t, g, unknown or other
  misc_feature (292)..(292): n is a, c, g, or t
  modified_base (421)..(421): a, c, t, g, unknown or other
  misc_feature (421)..(421): n is a, c, g, or t
tcagactactatgtcacgaccggtgctcgatttagtagcatactgttggggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtnactccttcagtaacacagattattattgggcctggatccggcagcccccagggaanagcctggagttggttgcgagtatccgattatcatcgggccgaacccccttctacacttccgtccctcgagagtcgagtcaccatttcactggagccgtccaagaaccagtactccctgagctgcggtcngtgacccccgcggaccacggcctatattactgtgcggcttaggtcagttgtgttggcgattgtctgcactaccggcgcgactaattagttacggtgggtcgtttggggacctacgacgggacctaaccggg

SEQ ID NO: 229659 - DNA, 747 bp, Homo sapiens
  misc_feature: GYAE6OF02IYHIW.24.37.D04.1.454.CMB.1.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (348)..(348): a, c, t, g, unknown or other
  misc_feature (348)..(348): n is a, c, g, or t
tcagactactatgtcacgaccggtgctcgatttagtagcatactgttgggtttgggggaggaacgtgctcagttaggacccagagggaaccatggaagccccagctcagcttctcttcctcctgctactctggctcccagatgcccaccggagacattgtgttgaacacagtcctaccagcccaccctgttctttgtcctccgaggggaaancgcccaccttcnccgtgccgagggccagtgaacaagtggttagaagttgttacgcctggtancaaacanaaactgtcggaccaggtcctcccccggatcctacgtaactctagtggacttgttacccactaaccgngggtccacgtcggacccgtcccccgacgtaggttcacggtcggcctaggtcggggttactcggggaaactacgtaccgttcgactccttacgaacccgtgaacgtcctaacgtccgtaaggtaccgtaccgtaagaacggtttacgttttacggtaccggtttacttaccgtgttaccacggtcgttaccgtccggttacccgtccgtccggtacccggttcgtttaaacgggtttcccggggacccgggggtaaccgacgggggttcggaacgggtacgggaaacggtaccggttaaacggttcgggacggtacgtaccgggccgtaaccgtacgtttaccgtaccggtttactacccgttaacgtttccccgtacccgtccgttaccgtacgttacg

SEQ ID NO: 229660 - DNA, 599 bp, Homo sapiens
  misc_feature: GYAE6OF02HO47S.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcacgcccccagggaagagccgtggagttggtgcgagtatcctattatcagtcgggccgtaaccccttctactacttccgtcctcgagagtcgagtccacctatttcactggacgccgtaccaagaaccacgtacctcccgtgacggctggccggtctcgtccgaccccgcggacaccggccgtattacttacgtgtcggcgggtcttaggtctattggtggttgcgtatcgtcgtgcctacgtaccggcgacgtacgtaatttacgttacggttcggggttcgggtttcggggccgtaaccggacggggtacccgtaaccggg

SEQ ID NO: 229661 - DNA, 628 bp, Homo sapiens
  misc_feature: GYAE6OF02HIX9X.24.37.D04.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgctccgaggggaaancgccaccctctcctgcagggcagtgacaatgtaggattgtagctggtatcaacacaaacngtcggcaggcctccccggntccctanactctagtgatgacataccaagtacgggccagtcggcactcccgaagactacgggttcaggtcgacgagggttcgggtcgtaggggacacggtacttacgacttcgtaccacgtactcagctagtgtaacgagcgtagtaagttagtttagtacgttaagtttactttacgttgtacagtctaccgtcgaacctaaccgttcggaccccttaccggtttcccggcccgttaccggggtacctaacggtaccgtacggtacctaccgtaacccgaaccggtacgtacgggttcggaccgttagacctacctaccgttcttacggttcctttacgtaccg

SEQ ID NO: 229662 - DNA, 520 bp, Homo sapiens
  misc_feature: GYAE6OF02I4TUW.24.37.D04.1.454.CMB.1.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (374)..(374): a, c, t, g, unknown or other
  misc_feature (374)..(374): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangcccaccctctcctgcagggccagtgacaatgtagagttgtagctggtatcaacacaaacntggccaggcctccccggctcctcatctatgatgcatccaagtacgggccagtggcactcccagacaggttcaggtgcaggtggtctgggacagtacttcactctacaccntcagcagtgtagagctagaatagtttgacttagtttattactgtacagtcctacgtcaactacgtcggacctacgttccggcccgtaggaccagactaggacacgtaccgaacgtacgtgcgtctgacactattctcgtctctacg

SEQ ID NO: 229663 - DNA, 584 bp, Homo sapiens
  misc_feature: GYAE6OF02JHNY2.24.37.D04.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctcaggggaangccacctctcctgcagggccagtgacaatgttaggagttgtagcctggtatcaacacaaacntggccaggctctcggctcctcctntatgctgtccnccaccgacgggcccctggtcgtcccaggccctaggttcgtggccggtggtctgggactagntttcactctcacatcagctagtgtagacgtcctagtaagttgttttgacgttagttttacttactgtaccagtaccgtacgtacgacctacgtaccggtccctaacgtttcccggcccgttagggaccctagaccgtcgaactacgtaccgaacgtacgtggtcggcttacggcctacgtattccgttcgtacgttcctacgttcccttccccgaccttgttaccc

SEQ ID NO: 229664 - DNA, 583 bp, Homo sapiens
  misc_feature: GYAE6OF02IJSC5.24.37.D04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (372)..(372): a, c, t, g, unknown or other
  misc_feature (372)..(372): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctcgagggaangccaccctntcctgcaggccagtgacaatgtagagttgtagctgtatcaacacaaacntggccaggcctccccggctcctcatctatgatgcataccaagtacgggccactggccactcccaagtacaggttcaggtcggctaggtgggtctagggacacggtactcactcncacctatcagctagtgtaacgacgtctagtaacgttatttcgattagttttattacgttgtctagtacctacgtacgaacaactcggtccctacgtttccggacccgttacgggaccgtagacgttacggacctacgtaaccgaacggtaaccgttcggtacggtaccgttacggcctaaccgtacgttcgttactttccgttactacccg

SEQ ID NO: 229665 - DNA, 642 bp, Homo sapiens
  misc_feature: GYAE6OF02I20JN.24.37.D04.1.454.CMB.1.raw
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
  modified_base (386)..(386): a, c, t, g, unknown or other
  misc_feature (386)..(386): n is a, c, g, or t
tcagactactatgtcacgaccggtgctcgatttagtagcatactgttgggtttgggggaggaactgctcagttaggacccagacggaaccatggaagccccagccgcagcttctcttcctcctgctactctggctcccagataccactggagaagtagtcatgacgcagtctccagccacctgtctgtgtctccgagggganagagcccaccctctcctgcagggccaggccggtagtgttagtaagtacttaggctggtaccaanagaaacctggccaggcctcccgaggcctcctcatctatgatgtctaccaacgagggtcactggccgtcccccgcgtaggttcaggtggacaggtgggtctagggacaggtacttcactcnccaccgtcagccagtcctaagcgtcctaggaagtacgttttggaccggtttaactacgttcgtactaggctacggtccgttccgccgtcggcccgtacgttaccggtttccggggccggggggtacctaggggttacgggaaggtaacgggacgtaaccggtacgtcgggtacggccttacggccgtaacctacgttccgttacggttcctttaccgtacgttacccggttccccgtacgttacgttccgtaacgg

SEQ ID NO: 229666 - DNA, 608 bp, Homo sapiens
  misc_feature: GYAE6OF02IJOU0.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaagagcccaccctctcctgccagggccagtgacaatggttaggaagttgttagccttggtatcaacacaaacatggccaggctccccggctcctcatctatgatgcatccaagtacggccacgtgctactcccagacgaggttcagtggactaggtcgggtctgggacagtacttcactcacacctatcacgcagtgtaagagtcctagaagttatttttacgtaagttttatttacgtgtacgtaagccgtaccgtagacctaacgtcggtccccttaacgttttccgggacccgttacgggaaccacggtaccgtacgggacctacgtacccgaaaccggtacgtacggttcggaccgttcggaccctaccgtacttccgttaccgtctttccctacgttcccccg

SEQ ID NO: 229667 - DNA, 679 bp, Homo sapiens
  misc_feature: GYAE6OF02GYKV4.24.37.D04.1.454.CMB.1.raw
  modified_base (202)..(202): a, c, t, g, unknown or other
  misc_feature (202)..(202): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctccgagggaaancgccacctctcctgcgagggccagtcgacaagtggttaggaagttgtagcctggtatcaacacaaacagtcggaccgaggcctccccggctcctacacttactagtgatcgacactaccaagtacggccacgtgcactcccgagacgtaggttacgaggtcggacgtagggtcgggtcgtagggactaggtaccttacgtacctctaccgaccaatccacgtctacggttgaacgacgtaccgtaggtaacgttagttttacgacgttagttttaacttacgttacgttaccacgtaccgtaccggttacgaaccgttaccgtaccggtaccccttaacggtttcccgggaccccgttacgggtaacccgtaagaaccggttacggaacctaaccggtaacccgtaaacggtaccgttagggtccgtaccgtacggaccctaccgtacgtttcgttaccgtttccgtaccttacccg

SEQ ID NO: 229668 - DNA, 609 bp, Homo sapiens
  misc_feature: GYAE6OF02GO3MH.24.37.D04.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (368)..(368): a, c, t, g, unknown or other
  misc_feature (368)..(368): n is a, c, g, or t
  modified_base (423)..(423): a, c, t, g, unknown or other
  misc_feature (423)..(423): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgctcgagggaaancgccacctctcctgcaggccagtgacaagtgttaggagttgtagccgtagtatcaacacaaacntggccaggcctccccgnttccncactccagtgatcgcataccaagtacgggccacgtagcactcccgagactaggtcagtcggacagggttggtcgtagggacngtacctcacgttcacacagtcgatcgagtagtaacgcgtaccttaaggaagtttntttagactttagtttaactttacgtgttacgctacgtacctacgaactacgtccgtaccctacggtttccgaccgtacggacccaagtaccgtacggtactaaccggtaaccgaaccggttaacgtcggtaccgtcgtaaccgaccgttacgtacgttaccgttcgtttacccgtaccttacccgg

SEQ ID NO: 229669 - DNA, 691 bp, Homo sapiens
  misc_feature: GYAE6OF02IRGFZ.24.37.D04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (681)..(681): a, c, t, g, unknown or other
  misc_feature (681)..(681): n is a, c, g, or t
tcagactactatgtcacgaccggtgctcgatttagtagcatactgttgggtttgggggaggaactgctcagttaggacccagagggaaccatggaagcccagctcagcttctcttcctcctgctactctggcctcccagatgccaccggagacattgtgttcgacacagtctccacgccaccctgtctttgtctccgagggaaanacgccaccctctcctgcaggccagtcagngtgtagcagcagctatacgcctaggtaccagcgaacgaaaccgtggtaccgtggacctccccgaggtccctcctacgtactctagtcggtcgccgtaccaccgacggcctaggtcggcgtcgacggacgtggtacctaggtcggctaggttcggtcgtttacggggaactacgggtaacctttccgaactttcctaccgagttaaccgacgtaccgtaacgtaacgtacggtacgggtaaccggtaccggttaaacgttagttttcggacgttaacgttacggtttaacttacggttcggtactacggttcggtttcggtttccgttaccgttcccgttaccttaccgttagttaccgttaccctttacggttccggttaccggtacgggttaccgtacggtcgttaacggtagtactacgtaacgacgttagtcggtcgtcgtacncgtaacctcg

SEQ ID NO: 229670 - DNA, 495 bp, Homo sapiens
  misc_feature: GYAE6OF02F57ZT.24.37.D04.1.454.CMB.1.raw
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
  modified_base (378)..(378): a, c, t, g, unknown or other
  misc_feature (378)..(378): n is a, c, g, or t
  modified_base (414)..(414): a, c, t, g, unknown or other
  misc_feature (414)..(414): n is a, c, g, or t
  modified_base (486)..(486): a, c, t, g, unknown or other
  misc_feature (486)..(486): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaanagccaccctctcctgcagggccagtgacaatgtagattgttagcctggtatcaacacaaacatggccaggctccccggntcctcatctatgatgcatccaatagggcactgcactccagacaggttcagtgcagtggtctgggacagactgactctcaccatcagacagtgtagncctgaagtatttgcttagtttatctgtcagcacgtnacacgtcgcctacgttccgccgtggacagcgtggaccagtaccgaagtactggtcgcgtagccactcgtctnttcctctac

SEQ ID NO: 229671 - DNA, 612 bp, Homo sapiens
  misc_feature: GYAE6OF02HZDCR.24.37.D04.1.454.CMB.1.raw
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctcgaggggaaancgccacctctcctgcagggccagtgacaatggttaagaagttgtacnctggtatcaacacaaacatcggccaggcctccccggntcctcatctaatcgatgacatccgaaatacgggccaacgtggacacgtcccaagaccgtaaggttcaagtgggactagggtcgggtctagggacagtaccttgaactcctacaaccgtatccgagtaccagttacggtacgacgtcgtagaacgttaattttgacgttaagttttattactgtacacgtacgaccgttagaactaaccgtcggaccccttaagtttcccgggaccgtcggggaaccagtaccgtggacacgtaccgaaacgtacgtggtaccggctacggacctaaccgtactttacgtcgtttaccgttacgtaacc

SEQ ID NO: 229672 - DNA, 574 bp, Homo sapiens
  misc_feature: GYAE6OF02GHEGJ.24.37.D04.1.454.CMB.1.raw
  modified_base (511)..(511): a, c, t, g, unknown or other
  misc_feature (511)..(511): n is a, c, g, or t
  modified_base (528)..(528): a, c, t, g, unknown or other
  misc_feature (528)..(528): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgagcccaggactggtgaagcctgcggagaccctgtccctcatttgctctgtctctggtgactccttcagtaacacagattattattggcctggatccggcacgcccccagggaacgagcctggagttggttgacgagtactccattatcagtcgggccgtaacccccttctactacttccgtccctcgacgagtcgacgtcacctactttcactcggacgccgtaccaaacgaacctaacgtacctcccgtaggacggactgccggtctcgtccgaccccgcggaccgacggtccgtatacttacgtgtcgcggcttaggtctattcgtgttcgngtatgtctgcacgaccncgcgactaattagtacggtcggtaggttcgggcacggacggtaccg

SEQ ID NO: 229673 - DNA, 553 bp, Homo sapiens
  misc_feature: GYAE6OF02HB8G9.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgtctccgaggggaaangccaccctctcctgcagggccagtgacaatgttaggaagttgtagcctggtatcaacacaaacatcggccaggcctcccccggctcctcatctatgatgcatccaagtcgggccacgtggcactcccagacgaggttcaggtggacaggtgggtctgggacagtacttcacttctcaccatcagtcagttgtagcgtactagaagttagttttgacttagtttattactgtcagcctacgtgactaacgtccgaccctacgttccggcccgttagggaccagtacgtggactacgtaccgaacgtacgtcggtcggcctcgaccaccgtgttccgtgttcctcgtacc

SEQ ID NO: 229674 - DNA, 579 bp, Homo sapiens
  misc_feature: GYAE6OF02GN2PG.24.37.D04.1.454.CMB.1.raw
  modified_base (388)..(388): a, c, t, g, unknown or other
  misc_feature (388)..(388): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagtattattattgggcctggatccggcacgcccccagggagagcctggagttggttgcggagtatccattatcatcgggaccgtaacccccttctacacttccgtccctcgagagtcgatcaccatttcactggacnccgtaccaagaaccagtacctccctgacggctcggcggtctgtccgaccccgcggacacggccgtatacttactgtgcggtcttaggtctagtttgtgttggcgtagttgtctgacacgtaccgcgtcgtacgtaatttacgtttacggtcgggtcggtttacgggctaacggtacgggaccctaaccggg

SEQ ID NO: 229675 - DNA, 653 bp, Homo sapiens
  misc_feature: GYAE6OF02HX8QP.24.37.D04.1.454.CMB.1.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgctccgaggggaaangcccacctctcctgcagggccagtgacaatgttaggaattgtancctggtatacaacaacaaacagtggccaggcctcccccggctcctcatctatgactgacatccaagtacggccacgtggacatcccagactaggtcagtggcaggttggcgtagggacagtaccttacgactactaccaactacgtacagcctaaggtcgtagacgtccttagaagttacttttgaacgttagttttaatttcgtacgttacaacgtacctaacccggtgaaacccgtaacgttcccggtaccccttaaccggtttcccgggacccgtacggggtaaaccacggtaaccgtaccggtaaccgtaccgttaacccgaaaacggtaccgttacgggtacggtccctagacccgtaaacccgtcttacccgttacgtttacccgttacgttaaccccg

SEQ ID NO: 229676 - DNA, 658 bp, Homo sapiens
  misc_feature: GYAE6OF02JE8XJ.24.37.D04.1.454.CMB.1.raw
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (474)..(474): a, c, t, g, unknown or other
  misc_feature (474)..(474): n is a, c, g, or t
  modified_base (620)..(620): a, c, t, g, unknown or other
  misc_feature (620)..(620): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaancgcccaccctctcctgcagggccagtgacaatgtagattgtagcctggtatcaacacaaantgcaggcctcccgntccnactctangtatcgcactccaatacgggccagtggaccagtccccagaccgtaggttccaggtcgcagggtcggtctaggggacaggtacttccacgttccacaccgtatacgacgacgtaggtacgaaggtaccgtaccgtaagtaacggttattttacggacctttaagggttttactttaaaccggttntaccgtagtacccgtaacgggttacgtaacctaaacgtccgggttaaccccttcggtttaacccgggtcccggttaacgggtaacccgaaggtaccgttacgggaccttacgacccgtaaaccggtaacgttcggtacgtccgtanacccgtaacttcgtacgttcgttaccttacgttacccg

SEQ ID NO: 229677 - DNA, 540 bp, Homo sapiens
  misc_feature: GYAE6OF02GGR6F.24.37.D04.1.454.CMB.1.raw
  modified_base (201)..(201): a, c, t, g, unknown or other
  misc_feature (201)..(201): n is a, c, g, or t
  modified_base (454)..(454): a, c, t, g, unknown or other
  misc_feature (454)..(454): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccaggcaccctgtctttgtctccagggganagagccaccctctcctgcagggccagtcagagtgttagcagcagctactagcctggtaccagcagaacctggcctggctcccaggctcctcatctatggtgccgtccaccagggccacgtggcgtcgcggacaggttcaggtggcaggtggcgtttgggacagacttcactctcatcactcgacagactggacgaccgaagtatttgactagtgttattactgtactagtcttgttcggtccctctcctcttntcgtacttacgtttcggccgttacgggttccaggtcgtaggtacgactacgaagtacgtacgttggtacggacgtcgacctaaccg

SEQ ID NO: 229678 - DNA, 624 bp, Homo sapiens
  misc_feature: GYAE6OF02GJ1QS.24.37.D04.1.454.CMB.1.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacatgttggcagcaacttagcctggtaccagcagaaacctggccaggctcccaggctcctcctctatgctgtcctccaccgacggcccctggtcgtcccagcctaggttcgtggcggtggtcgtgggacagtntttcactctcactntcgagcgcctccgagtctagtaagtatttcgacttacttttattctgtacctaactacttagttggtcgtacgtcggtccttccgttacttaccgttttcgggaccgtacggggtaaccctaaacgttacgggaacgtaacgtaaccgtaaaccggtacgttaggtacgggtccgttacggaccgtaacccgtaacgttccgttacgttacctttaccttaccgtttccctttaccccgtaccttaccg

SEQ ID NO: 229679 - DNA, 747 bp, Homo sapiens
  misc_feature: GYAE6OF02FSCO7.24.37.D04.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccaggcaccctgtctttgtctccagggganagagccaccctctcctgcagggccagccggagtgttagtaagtacttaggctggtaccaanagaacctggccaggctccgagcctcctcatctatgatgtcctacaacgngggtccacgtcggcccgtccccgcgtaggttcaggtcggacgtaggttcgggtcgtagggaactacggtaccttcaaccgttccgtaccgtaaccgtcacgtaccgacggtcccgttaaggaccgtccgttaggtaaacgtttacgtttttcggtaccgggtttttaacttaacgttcgtaccgaacggtccgtaacggtcccggtttcccgccggttcggggtaccccgttaccggttttaaccgggtttccggggggacccgggggggtaaccggtaaggggggttacgggaacggggtacggggtaacggtaaccgggtaacggtcgggttacgggcgttacgggaccctaacgtacgttccgtacggtttaccttcgtaaccgtttcccgttaccccggtacttaaccgttacgtacgtaacctagttaacgg

SEQ ID NO: 229680 - DNA, 589 bp, Homo sapiens
  misc_feature: GYAE6OF02GJKC9.24.37.D04.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (446)..(446): a, c, t, g, unknown or other
  misc_feature (446)..(446): n is a, c, g, or t
  modified_base (551)..(551): a, c, t, g, unknown or other
  misc_feature (551)..(551): n is a, c, g, or t
tcagactactatgtcacgaccggtgctcgatttagtagcatactgttgggtttgggggggaaagtgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtnactccttnagtaacacagattattatgggcctggatccggcacgcccccagggaagagcctggagttggttgcgagtatccattatcatcgggacgaaccccttcgtacattccgtcctcgagagtcgacgtcacctactttcactggacgtccgtcgaacgaaccacgtacctccctgtacggctcggcgtacttgtccgaacccccgnggtaccacggccgtaatacgttactagtcggcgggtccttagggtcctagttgttgttgaccgtatcgtctgcgtactaccgcgccggctaacgttagttacggnggggttccggtttgggctacgtacggggacctaccggg

SEQ ID NO: 229681 - DNA, 648 bp, Homo sapiens
  misc_feature: GYAE6OF02G4D2C.24.37.D04.1.454.CMB.1.raw
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgtctccaggggaaangcccaccctctcctgcagggccagtgacaatgttaggaagttgtagcctggtatcaacacaaacntcggaccaggcctccccggctccctcatctatgactcgcactaccgaagtacgggccacgtggacctactccccgagaaccgtaggttacgaggtcggtcgagggttcggggtacgtagggactacgtacttccactcctacaccagtcagtacgtagtagtacgacgtacctagtaacgttagttttgacgttaggttttacttacgttgtacacgtacctaccgttacgaactaaccggttccgtaccccgttaacgtttcccgggacccgttacggggacccaacggtaccgtacggacctacgtacccgtaaacggtaacgttgggtaccgtcgtacggccctactccgttaccgtttacgttccttactacccg

SEQ ID NO: 229682 - DNA, 536 bp, Homo sapiens
  misc_feature: GYAE6OF02GUVOS.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagacccctgtccctcatttgctctgtctctggtgactccttcagtaacacagattattattgggcctggatccggcagccccccagggaagagcctggagttggttgcgagtatccattatcatgggcgaacccccttctacattccgtccctcgagagtcgagtcaccatttcactgagccgtccaagaaccagtactccctgagctgcggtctgtgacccccgcggacacggccgtatattactgtgcgggcttaggtcattgtgttgggcatgtctgcactaccgcgcgcaattattacgtgggtcgtttggggcacgagggaccctacgg

SEQ ID NO: 229683 - DNA, 752 bp, Homo sapiens
  misc_feature: GYAE6OF02I10WF.24.37.D04.1.454.CMB.1.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaangcccaccctctcctgcagggccagtgacaatgttagaagttgtagcctgtatcaacacaaacntgccagcctcccgctcctcactctatgatgactactacccaagtacgggcccaacgtcggaccactaccccgaaggacgtacgggttacaagggtcggacgtagggttcggggtacgtagggggaacaacggtacctttcgaacccttcctaaccgtaacctagtaccgaacggacgtaacggttaggtaaacggacggtacccgttaaggtaaacgtttagttttacggacgtttaagtttttaaacgttaccgttacgttacgtaacggtaccgtaaacccggttacgtaaaccgtaacccgttaccgggtaccccctttaacgggtttaccccggacccggttaaccggggaaacccgtacgggtaacccgtaccgggtaacctaccgtaaccccgtaaaacggtaaccttaacggggtccggtaccgttaccgaccgtaccgttaacgtttcgttaccggtttacccgttaccttaacccg

SEQ ID NO: 229684 - DNA, 539 bp, Homo sapiens
  misc_feature: GYAE6OF02GNRNQ.24.37.D04.1.454.CMB.1.raw
  modified_base (426)..(426): a, c, t, g, unknown or other
  misc_feature (426)..(426): n is a, c, g, or t
  modified_base (530)..(530): a, c, t, g, unknown or other
  misc_feature (530)..(530): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagccccccagggaagagcctggagttggttgcgagtatccattatcatgggcgaaccccccttctacattccgtccctcgagagtcgagtcaccatttcactgagccgtcaagaccagtactccctgagctgcgatctgtgacccccgnggaccacggccgtatattactgtgcgggcttaggtcagttgtgttggcgatgtctgcacgtaccgcgcgcaattacgttacgtcgggtcgtttaggggctacgngggtacccg

SEQ ID NO: 229685 - DNA, 568 bp, Homo sapiens
  misc_feature: GYAE6OF02G7DO3.24.37.D04.1.454.CMB.1.raw
  modified_base (205)..(205): a, c, t, g, unknown or other
  misc_feature (205)..(205): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgtctccgaggggaaangccaccctctcctgcagggccagtgacaatgttaggaagttgtagcctggtatcaacacaaacntggccaggcctcccccggntccctcatctatgatgcatccaagtcgggccacgtcggactactcccaagaccgtaggttcaaggtcggctagggtcgggtctagggacacgtacttcgacgttcctacacctatacagctagtgtacgacgcgtagaagttntttagnttaggtttattactgtcacgtcaccgtgactacgtcggacccttacgttccggccgtaggaccagtacgtcggactacgtaccgaacgtacgtggtcgcttacgcctaccgtagttccgtcttcctctacc

SEQ ID NO: 229686 - DNA, 672 bp, Homo sapiens
  misc_feature: GYAE6OF02F5HUK.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaagagccaccctctcctgcagggccagtgacaatgttaggaagttgttagcctggtatcaacacaaacatggccaggcctccccggctcctcatctatgatcgactacaccaagtacgggaccacgtcggcaactccgaagtacgtaggttcgagtggacgaggttcggggtacgtcgggaactacgtacttcgaccttactaccaacctatcgaacgacgtaggttacgtaggtaccgtaccgttaggtaaacgttagttttacggacgtttaagttttaactttacgttacgtacacggtacccgtaaccggttacgaaaccgttaccgtccggtacccccgttaacgtttccccgggaccggttaacgggacccgtaagtaccgtacgaccgtactaacccggtaaacgtaacgttcgggtacggtcctacgacctacctacgttacgttcgtttccgtacttacccg

SEQ ID NO: 229687 - DNA, 781 bp, Homo sapiens
  misc_feature: GYAE6OF02HUIXA.24.37.D04.1.454.CMB.1.raw
  modified_base (241)..(241): a, c, t, g, unknown or other
  misc_feature (241)..(241): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccaggaacgggtcctgtcccatttccagttgcgtgacgtcgggcccaggactggtgaagcctgcggacgacccctgtccctcatttgcctctgtctctggtntcctccttcacgtaacactagtatttattagttcgggcctaggactccggcaccgcccccaagagaagcgccgtggtagtttggtggcgtagtactcctattactctacggttcggacccgttaaccccttactacctaccttccccgttaccccgacggagtacgtcgtacgtaccaccttattaccacgtacgggaccgtacccggtaaccaaaccggtaacccgtaacgttacccgtccccgtagggtacgggtcccgttcggtcccgggtttaccgtcccgggtacccggtaccccccgggaaccgggtaacccgtacccgggttacccgttaattaaccgtttaccgtcgggtacgggtacccgggtttcgtaacgggtttctaaggtttccgggttgggttacgggacgttcgttacggttccctacgtaccctaacggtcccgtaacggtcccggtaattaaaccgttttggtaccgggtttcgggggtccgggttttaaccggggaccttacggggacccggtaaccccggg

SEQ ID NO: 229688 - DNA, 618 bp, Homo sapiens
  misc_feature: GYAE6OF02H9VF0.24.37.D04.1.454.CMB.1.raw
  modified_base (205)..(205): a, c, t, g, unknown or other
  misc_feature (205)..(205): n is a, c, g, or t
  modified_base (398)..(398): a, c, t, g, unknown or other
  misc_feature (398)..(398): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccaccctgtctttgtctccaggggaaagngcccaccctctcctgcagggccagtcgacaatgttagaagttgttagcctggtactcaacaacaaacatcggaccacggcctcccccggctcctcatctatgatgctactccaagtacggccacgtgcactccaagacgtggttacaggtcggactaggtcgggtgtacgggacagtctcactctcacctacncgagctagtgtacgagcttaggaagttattttcgactttaggtttaacttagttcgtatacggtcctaaccggtacgaacctaacgtccggtacccgttaccgtttacccggtcccggtacgggaccctaacggtacgtcggacgtacctaaccgaaacccggtacgttcgggacggttcaccgtaccgaccttacttacgtcgttccttacgttacccg

SEQ ID NO: 229689 - DNA, 615 bp, Homo sapiens
  misc_feature: GYAE6OF02G41CC.24.37.D04.1.454.CMB.1.raw
  modified_base (204)..(204): a, c, t, g, unknown or other
  misc_feature (204)..(204): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccgaggggaaanagcccaccctctcctgcagggccagtgacaatgttaggaagttgttagcctggtatcaacacaaacntggccaggcctccccggctccctnactctatgatgcatccgaagtcgggcccagtcggactactcccgagtacaggttcaggtgctaggtggtctagggacagtcttacacgtcaccaccatcagctaggtgtagagtacctaggtaacgttattttcgacttagtttaactttacgttagtcacgtacctacggttacaaccgtaccgttcggacccttaccggttccggtcccgtacgggaccaacgtaccgtgtacctacgtacccgtaacggtaacgttcgggtacggtccgtcggtaccctaccgtaacgttcccgttacggttcccttaccgtacccg

SEQ ID NO: 229690 - DNA, 622 bp, Homo sapiens
  misc_feature: GYAE6OF02HTPDY.24.37.D04.1.454.CMB.1.raw
  modified_base (237)..(237): a, c, t, g, unknown or other
  misc_feature (237)..(237): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctggcggagaccctgtccctcatttgctctgtctctggtnactccttcagtaacacagtattattagttggcctggactccggcacgcccccgaggaagcgcctggagttggtgcgtagtatcctattactcagtcgggacccgtaaccccctttctaactacttcccgtccctacgacgtacgtcgacgtaccactatttcacgtggacgtccgtaccaaagaaccacgtacctcccgtagacggtctcggcgtctcggtccgacccccggacggaccgacggtaccgtacttacttacgtgtcggcgggtcgtttacggtactagtttgtcggttggtcgtattcgtctcgctacgtacccggcgtacgtactaagtttacgttacggtgggttcggtttggcgacggtacgggacctaccgg

SEQ ID NO: 229691 - DNA, 564 bp, Homo sapiens
  misc_feature: GYAE6OF02JCTSO.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagccgtggagttggttgcgagtatccattatcagtgggccgaacccccttctaccacttccgtccctcgagagtcgagtcacctatttcactgacgccgtccaacgaccagtacctccctgagctgcggtctgtcgacccccgcggaccaccggtcgtatacttacgtgtggcggtcttaggtctagttgtgttggcgtagtgtcttgcacgtccggcgcgactaattagttacggtgggtcggtttcgggctacggacgggtcctaaccggg

SEQ ID NO: 229692 - DNA, 613 bp, Homo sapiens
  misc_feature: GYAE6OF02FVY47.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagtattattattgggcctggatccggcagcccccagggaagagcctggagttggttgcggagtatccattatcatgggcctaacccccttctactacttccgtccctcgagcgtcgagtcaccatttccactggacgcccgtaccaacgaacccagtacctccctgacggctacggcggttctggtccgacccccggcggacgaccggcccgttatacgttactggtcggcgggtcttagggtctagttggttgttcgggcgtagttgtcttgccgtaccgtaccggcggtccgacgtaactttacgttacggttggggttccgggtttggggccgtaacggtacggggaccctaaccgggg

SEQ ID NO: 229693 - DNA, 696 bp, Homo sapiens
  misc_feature: GYAE6OF02IXKG3.24.37.D04.1.454.CMB.1.raw
  modified_base (113)..(113): a, c, t, g, unknown or other
  misc_feature (113)..(113): n is a, c, g, or t
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
tcagactactatgtcacgaccggtgctcgatttagtagcatactgttgggtttgggggaggaactgctcagttaggacccagacggaaccatggaagccccagcgcagcttcncttcctcctgctactctggctcccagataccactggagaagtagtcatgacgcagtctcagccacctgtctgtgtctccgagggaaangccacctctctgcacgggccagtgagatgtggcagcaacttgcctggtaccagtcagaaacctggccaggcctccgaaggcctcctcagtctatcgatggtcaccgaacgngggtcacgtcggccgtcccgcctaggtccaggtcgacgtaggtcgggtctaggggacctagtacgttacgaccttctaccgtacccggtttacaacgggtaccctaaccggtacccgtaaaggtaccggtacccgttaggtaaaacggttacgtttttacggaccgtttaggttttaaactttacgttacggtactacgtaccgtaccgtttaggaaacccttacgttaccggtaccccgttaaccgtttccgggtacccgttacgggtaaccctacggtaaccggtcgggaacctaccgtaccgtaaaccggtacgttacggtacgggtactaccggacaacccgtacgttaccgtcggtttaccttaccgatttacccccgg

SEQ ID NO: 229694 - DNA, 686 bp, Homo sapiens
  misc_feature: GYAE6OF02G4M67.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctcgtggtcgactccttcagtaacacagtattattattggcctggactccggcacgcccccgagggaagagaccgtggagttgggtgacgtaggtactccgtaatttatcgtagttgggaccctaacccccttacgtactacgttcccgtcccctacgagacgttacgacgttaccaaccctacttttaccgacgtaggtacgtacccgtaccgaaaacggaacccacggttaacctccccgttagggaacggtctacggtccggttacgtcggtcccggaacccccggcgggtacccgaccggtaccgttattacttaacgtcggtaggtccgggtacgttagggtcctaggtttcggttgttacggtcgtattcgttcgcgtacgaccgtccggcgccgtactaagttcgttaggtcgggttcggttcgggacgtacggacggtacccgtaaccggg

SEQ ID NO: 229695 - DNA, 623 bp, Homo sapiens
  misc_feature: GYAE6OF02GA4DW.24.37.D04.1.454.CMB.1.raw
  modified_base (202)..(202): a, c, t, g, unknown or other
  misc_feature (202)..(202): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgctccgaggggaaangccacctcgtcctgcagggccaggtcgacaatgttaggaagttgttagcctggtatcaacacaaaacatcggccaggcctccccggctcctcatctatgctgtctccgaccgacgggcccctggtcgtcccagccaggttcgttgggcgggttgggtctgggacaggtactttcacttcgtcacctatccaggtccggcctaccgagtctagtaagtattttcgacttactttatttctgtaccaactacttatggtcgtacgtcgtcccttccggtacttacgtttcggaccgtaacggggtaacccaaacgttgggaacgtaacgttaaccgtaaaacgtaccgttggtacggacgttacggacctaccgtactttcgtacgttcctactaaccgttcccgttacccgctacgttaccg

SEQ ID NO: 229696 - DNA, 651 bp, Homo sapiens
  misc_feature: GYAE6OF02H6LZA.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcacgcccccagggaagagcctggagttggttgcgagtatccattatcatgggaccgaaccccttctacacttccgtcctcgagagtcgagtcactatttcacgtaggacgcccgtaccaacgaaccctacgtacctccccgtaggacggtctaggtccggttcgtcggtccggacccccggcgggaccaccgggtacccgttattactttacgtcggtacggccggggtcgtttacggtccgtagtttcggttggtttcgggcgtagttcgttcgtgaccgtaccgtaccggcggtaccgtactaaacgttttacgttaccgggttcggggttccggtttagggggaccctaacggacggggtacctaacccggg

SEQ ID NO: 229697 - DNA, 564 bp, Homo sapiens
  misc_feature: GYAE6OF02HUDP8.24.37.D04.1.454.CMB.1.raw
  modified_base (225)..(225): a, c, t, g, unknown or other
  misc_feature (225)..(225): n is a, c, g, or t
  modified_base (324)..(324): a, c, t, g, unknown or other
  misc_feature (324)..(324): n is a, c, g, or t
  modified_base (509)..(509): a, c, t, g, unknown or other
  misc_feature (509)..(509): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagacccctgtccctcatttgctntgtctctggtgactccttcagtaacacagattattattgggcctggatccggcacgcccccgagggaagagcctggagttggttgcgagtatccattancatgggccgaacccccttctactattccgtccctcgagacgtcgagttcacctatttcacttggacgccgtccaagaaccctagtactcccgtgacggctgcgtctgtcgaccccgcgacgaccggcgtatattacgtgtcgcgggcttaggtctagttgtgtgcgtatgtctgctacgtaccgngccgataactttacgtacggtgggtcggtttgggcctacgacggggacctacggg

SEQ ID NO: 229698 - DNA, 1062 bp, Homo sapiens
  misc_feature: GYAE6OF02HUOZR.24.37.D04.1.454.CMB.1.raw
  modified_base (216)..(216): a, c, t, g, unknown or other
  misc_feature (216)..(216): n is a, c, g, or t
tcagactactatgtcacgaccggtgctcgatttagtagcatactgttgggtttggggggaaatgctttctgagactcatggacctcctgtgcaagaacatgaagcacctgtggttcttcctcctgctggtgcggctcccagaagggtcctgtcccatttccagttgcgtgagtcggcccaggactggtgaagcctggcggagacccctgtcccctntatttcgctctgttcctacgtggtcgtaccttccgttacgaagtaaccacgtaagttattttaacgtttacggttccgggtccgtaacggtaccgttaccccgggaccgaacccggtacccccccggaaagggggtaaacgccggtccggttagggttaacggttttcggggttacggaacggttaaacggttaccttacccgttaagttttacgtaccgtaacgggttacccggggtaacccccgttaaacccccccttttacgttaaacccgtttaccgttttccccccggttaccccgttaacggaaacggttacccggggtttaaccgtaaccggttacccctaaacccgtttaaacgttttacccgtaaccgggttaacgggtaaccccggtacccccggtttaaacccggtaaaaaccggtaaacccccgtttaacccgggttaaccccttacccccgggttacggggttaacccgggttaaccggtccggggttaacccgggtttcccggttacccgggttaccccccgggaaccccccggggtacggtaaaccccgggttaacccgggtttaacccgttaaacgtttaaacccgttttaaccgggtccgggtaccgggggttacccggggtttaaccgttttaaccggggtacccgtttaaacgggtttcgggttaccggtttacggggaaccgttagttccggggtttaactccgggtaccttaacccggttccggtaccggtacccgtagttaaaaccgttttggttaacccggggtcgggtttcggggttacccgggtaacggaaccggttaccgggggaacccttaccccgggg

SEQ ID NO: 229699 - DNA, 869 bp, Homo sapiens
  misc_feature: GYAE6OF02F8HO4.24.37.D04.1.454.CMB.1.raw
tcagactactatgtcacgaccggtgctcgatttagtagcatactgttgggtttggggaggaacctgctcagtttaggacccagtagggaaccatggaagccccagctcagcttctcttcctcctgctacgtctggctcccagatgccaccggtagacattgtgtttagacacagtctccagccaccctgtctttgtctaccaggggaagagccacccgtctcctgccaggggcccagtgacaatcgttaggaagttgtagcctggtatcaacactaaacatggccagggtcctcccccggcttccgtaccagttcctaattcggacttcgacgaagtacccaaagttaacgggggccctaaccgttcgggaccttaacgttccccctaaggggtaaccttagggggttttaccaacggtttacggggaccgtaaaggggtttcgggggtaccgttaggggggaaccaaacggggtaacccttttaccgggaacccttttccgttaacccgaaaccccgttaacttaccgaacggtaccgtaaacggttacggttaaacggaaccggtacccgttaacggtaaacggtttacggttttttacggtaccgggttttttaaaccttaaacgttcggttaccgtaacggtacctacggttcccgggtttacccgcccgttaccggggcccgtaaccgtttaaacccggttttcccgggggacgggggggttaaccctagggggttacgggtacgggaacggggtacggaaccgggtaaaccgttcgggtacgggtaaccgtttggaccccgaaccgttactttaccgttccggttttaccgtttaccgtaccgtttacccggtttccccccgg

SEQ ID NO: 229700 - DNA, 869 bp, Homo sapiens
  misc_feature: GYAE6OF02IF5C1.24.37.D04.1.454.CMB.1.raw
  modified_base (216)..(216): a, c, t, g, unknown or other
  misc_feature (216)..(216): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgagcctggcggagaccctgtccctnatttcgcttctgttctcgtggtcgaccttccttacgaagtaaccacgtagtattttatttagttcgggccttgggactcccggtcaacccggccccccgaaggggaaagacgcccgttaggggtacggttttcgggttacgcggtaaggttactaccctaagtttacgtcaaggttccggggaccctaaaccccccttttctaaccgttacgtttccccggttaccccgtacggtacggtaacgttccgggtaacgttcccgtaaacccgttaacgtttttacccgaacggtttaccgggaaaccggtacccccggtttaacccgaaaacggtaacccccgtaacggttttaaccccgtttccccggtacggtaaccggggttcccgttacggggaccgttaaccgttccggttaccggtaccccgggtacccccccggtaggggtaaccccgtacccggggttacccggttaacgtttacgtttaccgttacgggtcggtaccggggttactttacgggtcctaaggtttcgttacggttgggtaccgtagtcgttacgtcgaccgtaccgtcccggccgttccggtacttaacgtttaacgttcgggttacggggtccggtttacggggcctacgggtaccgggtacccgg

SEQ ID NO: 229701 - DNA, 797 bp, Homo sapiens
  misc_feature: GYAE6OF02HH4WK.24.37.D04.1.454.CMB.1.raw
  modified_base (300)..(300): a, c, t, g, unknown or other
  misc_feature (300)..(300): n is a, c, g, or t
tcagactactatgtcacgaccggtgctcgatttagtagcatactgttgggtttgggggaggaactgctcagttaggacccagagggaaccatggaagccccagcgcagcttctcttcctcctgctactctggctcccagccatcaccggaggaattgtgttgacgcagtctccaggcaccctgtctttgtctccgagggggagagacgccaccctctcctgcagggcccagtcagagtgttagcagcagctactagcctggtaccagcagtaaacctggcctgcctccgaggcctcctcntctatggtcgcgtccaccgcgggcctacgtcggccgtcggaccggacgtggttcgaggtcggctagggttcggtcgtttcgggaactacggtaccttcaccgttctacctaattccgtacgtaccggtaacgtaacggtaccgttacggggaccggtaaccccgggtaaagtttacggtttttaccggaccggttaaagggttacgttttaaaccgtttacgttcggttaaccgtacgggttttaccggttttcgggtttttaccccgggttccccctttttacccgttccccgttttaaccctttacggttttaaccgttaacccggtttttacccggtttttcggggtaccccggtttaccgggggttttccccgaaggggttttccccgttaaggggtaaccggtttacccggtaaaggaacccgggtacccgtttaaacgggtttggttacccgggttaaccgttacgggtaccccgttaacccgttaaccgg

SEQ ID NO: 229702 - DNA, 642 bp, Homo sapiens
  misc_feature: GYAE6OF02F992Q.24.37.D04.1.454.CMB.1.raw
  modified_base (202)..(202): a, c, t, g, unknown or other
  misc_feature (202)..(202): n is a, c, g, or t
  modified_base (329)..(329): a, c, t, g, unknown or other
  misc_feature (329)..(329): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (432)..(432): a, c, t, g, unknown or other
  misc_feature (432)..(432): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgagggganagacgccacctctcctgcagggccagccggagtgttagtaagtacttaggctggtaaccaacgacgaaacctggacctagggcctcccgaggccttcctcatctaatgacttcgtcctaccgaacgngggtccacgtcggccgtccccgctaggttcaggtggcgtaggtgggtctgggacagtcttcacttcncacgtnaacgcacgccgtagacgtcctagaacgttnttttcgtacgttttactacttgtaccagtccgacgtccgttccgcgtcggaccctacgttaaccggtttcggggacggggtacaggggttgacgtagggacgtacgaacgttcggtcggtacgtcgtaccgtacgtaggttccggttacgttccgttaccgtacgttcccgttacccggacttacgttcctacggtaacctcgttaacgg

SEQ ID NO: 229703 - DNA, 842 bp, Homo sapiens
  misc_feature: GYAE6OF02G3CDJ.24.37.D04.1.454.CMB.1.raw
tcagactactatgtcacgaccggtgctcgatttagtagcatactgttgggtttgggggggaaatgctttctgagactcatggacctcctgtgcaaagaacatgaagcacctgtgttcttcctcctgctggtggcggctccagaaggtcctgtcccatttccagttgcgtgagtccgggcccaggactggtgaagcctggcggacgaccccttgtccctctatttgccttctgtcctcgtggtcgaccttccttacaacgttaacacgtaagtaattttatttagttcgggtacccttggtacgttcccggcaccggcccccccgaaggggaaacgacggcccgttgggtaacggtttggggtttcggaccggtaaggttacgttcccgtaagtttacgtactaagtcgggtacccgtaacccccgtttacccttaccgtaaaccgtttccccgttccccgttaccgtacggtaacggttaccggtacgttacccgtaaccttaacgtttaccgtaacgttacgggtaacggacccgttaacccgtaaaccgtaaacccgtaacggtaacccttacccgtacgtacggtaccgtcggtaccggtcgttacgtcccggtaaccccggtacccggacgtaacccgggtaccgttaacgttaacgttacgtcgttcggacgggttacgttacgggttcgttagttcggttcggttagggttcgtacgttacgttcgtacgtccgtaccgtaccgtaccggaccgtaacttaacgtttacgtttacggtacggggtttaccgggttaggggttacccggacggttacgggtaacccgttacccgggg

SEQ ID NO: 229704 - DNA, 581 bp, Homo sapiens
  misc_feature: GYAE6OF02F9VQC.24.37.D04.1.454.CMB.1.raw
  modified_base (264)..(264): a, c, t, g, unknown or other
  misc_feature (264)..(264): n is a, c, g, or t
  modified_base (327)..(327): a, c, t, g, unknown or other
  misc_feature (327)..(327): n is a, c, g, or t
tcagactactatgtcacgaccggtgctcgatttagtagcatactgttgggtttgggggggaaatgctttctgagactcatggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtgtacttactattgganctggatccggaagcccgcgggaagggactgggagtggattggccatatctacgccaatggganaacaggtacaacccctccctcagagtcgagtcaccatttcactggaccctacaaagaaccaaattgccctagacgtctagaattctgtacgaccgccgcacgacaccggctacttattactgtagcgagagagcgcaaggtcggaccgactaaacgtaagttcgtttactacttaagttagtaggttaatgggtaaccgtccgtaggggacccgtaggggaaccctaaccgggtccaacccgggtcttaccccg

SEQ ID NO: 229705 - DNA, 594 bp, Homo sapiens
  misc_feature: GYAE6OF02GJVJ3.24.37.D04.1.454.CMB.1.raw
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctccagatgccaccggagacattgtgttgacanagtctccagccaccctgtctttgtctccaggggaaangccacctctcctgcagggccagtgacatgtagattgtgctggtancanacaacntagcaggcctcccggctcctcatctatnatncatccaagtcggccacgtggacactccagacgtaggttcaggtgcgagtggtactgggacaggacttacgacctctaccaccactacgacgactagtagtacgtagcgtagtaagttatttagacttaggtttacttagtacgtctagtaccgtacgtcgtaacgtaccgtacggtccctaccggtttccgaccggttaccggacccgtaagtacgtaacggacttaaccgtaacccgtaaacggtaaccgttcggacgtccgtcgaccctacgtaaccgttctttaccgttccttacttaacccg

SEQ ID NO: 229706 - DNA, 650 bp, Homo sapiens
  misc_feature: GYAE6OF02HY8ZY.24.37.D04.1.454.CMB.1.raw
  modified_base (200)..(200): a, c, t, g, unknown or other
  misc_feature (200)..(200): n is a, c, g, or t
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
  modified_base (384)..(384): a, c, t, g, unknown or other
  misc_feature (384)..(384): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagccacctgtctttgctccaggggaaancgccacctctcctgcagggcctagtgacaatgttaagagttgtagctggtancaacaacaaacatggccaggcctccccggctcctcatctatnaagtgcatccaaatacgggcctactggcagtacccagactaggttccagtggcaggtgggtctagggacagtacttcacgtctcgaaccntcagctagtgtacgagtcctagaaatacgttttgacttaaggttttaacttacgttcgttacgaacgtacctaccggtagtaaaccaaaccgttcgggaaccccctttaacggttttccccgggacccggtttaccgggggaaaccccaaacgggttaaacccgtcggggaacctaaccggtacccaaaacccggtaacgttacggtagggtacccttggacccctaaccgtaacttcccgttacgtttacccttaccgttaaccc

SEQ ID NO: 229707 - DNA, 560 bp, Homo sapiens
  misc_feature: GYAE6OF02GODL6.24.37.D04.1.454.CMB.1.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (555)..(555): a, c, t, g, unknown or other
  misc_feature (555)..(555): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctccgaggggaaancgccacctctcctgcagggccagtgacaatgttaggagttgtagctggtatcaacacaaacntgccaggctccgaggcctcctcctctatgctcgtctcccacgacgggccccgtggtcgtccagccgtaggttcgtgggcggtgggtcgtgggacacgtattcgactctcacntcagcgcctcagtctagagtntttcgcttatttcttctgtacaactcgtagtcgtagtacgcgtcctaccgtacttcgtttagtcccgaaggggtacctaagttcgggaatacgtaacgaacgagtcggtacgcgtcgtacaccgtgttccttgttctactcgtcccttaccgacctntaccg

SEQ ID NO: 229708 - DNA, 638 bp, Homo sapiens
  misc_feature: GYAE6OF02GTKGG.24.37.D04.1.454.CMB.1.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (357)..(357): a, c, t, g, unknown or other
  misc_feature (357)..(357): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtgggcggctcccagaagggtcctgtccctatttccagttgcgtgagtcgggcccaggactggtgaagcctggcggacgaccctgtccctcatttgctctgtctcgtggtnacctccttcgagtaaacncagtattnttagtggcctgagtccgcacgcccccgagggaagacgctggagttggttgcgagtatccatatcagtccgggacgtaacccctcctaactnttcccgtaccctcgacgtagtcgacgtactaccgtattcgacgtgaaccgtccgtacgaaacgacaacgtacctaccgtggaacggtcgtcgtcggtctcgtacggaccccggtcggaccgacgaccgttatacgttacgtagtcgcgggtctaggtctagttgtagttcggcgtacgtcgttgcctacgaccgtaccgcggtccgtaactaacggtttacgttaaccggttcggggttcggttttacggggccggtacggtacgggacccgtaacccggg

SEQ ID NO: 229709 - DNA, 662 bp, Homo sapiens
  misc_feature: GYAE6OF02FLGTS.24.37.D04.1.454.CMB.1.raw
tcagactactatgtcacgaccggtgctcgatttagtagcatactgttgggtttggggggggaaatgctttctgagactcatggacctcctgcgcaagaacatgaagcacctgtggttcttcctcctgctggtggcggctcccagaagggtcctgtcccatttccagttgcgtgagtcgggcccaggactggtgaagcctgcggagaccctgtccctcatttgcctctgtctctggtcgactccttcagtaacacagtattattattgggcctggactccggcacgcccccgagggaacgagccgtggagttgggttgcgagtactccattactcagtcgggaccgtaacccccttctaactacttcccgttccctggacgacgtacgagtccacctattttcacgtggacgcccgtaccaaacgtaacccacgtacctaccgtgacggtctcggtcggttctcggtaccggacccccggcggaaccgaccgggtccgttataacttacgtgtcgggtcgggtacgtttaggtcgtacgtttggtcgttcgggactagtgttcgtcgacgtaccgtaccggtccggaccgtactaaagtttacgttaccgggtcggggttcgggtttacggggtaccgacggtaacgggtacccgtaaccggg

SEQ ID NO: 229710 - DNA, 664 bp, Homo sapiens
  misc_feature: GYAE6OF02HSQTR.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagtattattagttggtcctggactccggcacgcccccgagggaagagcctggaggttggtggcgtagtatcctatttatcagtcgggaccgtaacccccttctactacgttcccgtccctcgagacgtcgacgtcctacctatttcgacgtggacgtccgtacccaaacgacctacgtacctcccgtaggacggtcgtcggccggtctcggtcccgaccccggacggaccgaccggtccgtattacgttacgtggtcggcgggtcgtttaggtctagttgttggttcggacgtagttcgttcgtcggtacctacgtaccggcggtaccgtacgtaaacttttacggttaccgggttacgggggttccgggttttcggggaccgtaacgggaccggggtaacccgtaccgggg

SEQ ID NO: 229711 - DNA, 710 bp, Homo sapiens
  misc_feature: GYAE6OF02FZW02.24.37.D04.1.454.CMB.1.raw
  modified_base (205)..(205): a, c, t, g, unknown or other
  misc_feature (205)..(205): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagataccacgtggagaagtagtcatgacgcagtctccagccaccctgtctgtgtctccgaggggaaacngcccacctctcctgcgagggccagtgagatgtgcagcatgctgacagcagaactgcagccncngctcncctntngctcgtctccgacgcggccctggtccnccncggcctaggttcgtcggggtcggtcgggtcgtcgggactacggttactttacgacgtcctaccgacctagtaccgcgcccggtccctccgtacgttacttaggtaacgtttacgttttgaccgtttacttttacgtttccgtcgttaacctaaaccgttacgttacggttcgggttacgtaccgttcgggttacccttcccggttaaaccgtttccgggtttttacccgggacccgggtaacgggtaaacccttaaacgggtacgggtaaacgtaacgtaaccggtaaaaccggttacgttaccgggttacgggtacctaccggtaacccgtaacccttaggttcccgtttaccggttccgtttacccgtacccgttttcccgtacccccgtttaacccgg

SEQ ID NO: 229712 - DNA, 649 bp, Homo sapiens
  misc_feature: GYAE6OF02HL8FC.24.37.D04.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtnacatgttaggagttgtagctggtatcaacacaanatggccaggcctccccggctcctcactctatgatgcactaccaagtacgggccacgtcggacctactccccgagacgtaggttcaggtcggctagggtcgggtctaggggacaggtactcgactctaccactactacacgcgtaggttgtaggacgtaccgtaggtaaagttagttttacgacgttaaggttttaactttaccgttacgttaccgacgtaccgtaacccggttagaacccgttaacggtccggtaccccgttacggtttccccgggacccgtacggggaacccaaggtacgtcggacctaccggtaacccgaacggtaaccgttgggtaccggtcgtacggaccacccgtagttccgtacgtttccttaccgtaccg

SEQ ID NO: 229713 - DNA, 663 bp, Homo sapiens
  misc_feature: GYAE6OF02JNGIU.24.37.D04.1.454.CMB.1.raw
  modified_base (136)..(136): a, c, t, g, unknown or other
  misc_feature (136)..(136): n is a, c, g, or t
  modified_base (144)..(144): a, c, t, g, unknown or other
  misc_feature (144)..(144): n is a, c, g, or t
  modified_base (154)..(154): a, c, t, g, unknown or other
  misc_feature (154)..(154): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (420)..(420): a, c, t, g, unknown or other
  misc_feature (420)..(420): n is a, c, g, or t
  modified_base (458)..(458): a, c, t, g, unknown or other
  misc_feature (458)..(458): n is a, c, g, or t
tcagactactatgtcacgaccggtgctcgatttagtagcatactgttggtttggggaggaactgctcagttaggacccagagggaaccatggaagccccagctcagcttctcttcctcctgctactctgctccagntgccacgngacatgtgtncacagtctccagccacctgtcttgtctccgaggggaacngccctacctcncctgacacgggcctagtgaccaagtgttaggagttctgcctgtacncaacacgaaangtgaccaggcctccccggntacctcagtcctangatcgcagttaccaagttagggcccctaagcggcacgttaccccgaggtaaccctagggttaccacggtgggtaccgtagtcggggtccgtaggacccgaaatcccgttacgactttccgcaaccntttaccagtccgagtagtacgacggtcctagaacgttnttttacggactttagttactttacgtagtacctacgctaccgtagtaaaccgccgtttacgggccccttaaccgtttcgggaccccgttacgggaaccctacgggttaactccgggtaacgttaccgaccccgtaaaccggtaactttaaccgggcggttaccttacgaccgtaaccgtacttcgttacgtcgtttacctacccg

SEQ ID NO: 229714 - DNA, 672 bp, Homo sapiens
  misc_feature: GYAE6OF02GLNAU.24.37.D04.1.454.CMB.1.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtnacttccttcagtaacanagattattattgggcctggatccggcacgcccccgagggaagcgccgtggagttggtgcgagtactcctaattatacagtcgggccgtaacccccttctactacttccgtccctcgagacgtcgagtcactatttcacgtggacgccgtaccaacgaaccacgtaccttcccgtgacggtctcggcgttcgtcggtccgacccccggtcggacccgaccggtacccgttaagttacttacgtggttcggtccggggtctttaacgggtctagtttcgggttaggttcgggtcgtagtgttcctagtcccgtacctacccgggtccggtaaccgtcgtaaacgtttacggtttaaccggttcgggggttacgggttttacgggggacccgtacgggtaccggggtacccgttaacccgggg

SEQ ID NO: 229715 - DNA, 725 bp, Homo sapiens
  misc_feature: GYAE6OF02HA6ES.24.37.D04.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccgaggggaangccacctctcctgcagggccagtgacaatggttagagttgtagctggtatacaacacaaacntcggccaggcctccccggctcctcatctatgatgcatccaagtcgggacctacgtcggactacgttccccgaagtaccgtagggttcgaaggtcgggacgtagggttcggggtcgtacggggactacggttaccttcgtaacttcctaccaacctacgtccgacggaccgtaaggttcggtaacggacggtacccgtaaggtaaacggtttcgttttacgggtaccggtttttaaccttacgttacggttacgacggtacgtaaccggttcccggtttccccggtcggttcccgggacccggtttaaccgtttaacccggggtttccggggggaacccgggggggttaccggtacgggggttacggggaagggtaacgggtacggtaacgtaacggttcgggtacggcgtaccggaccgtacgtagttccgttgttacccttacgtacttccccgtacccg

SEQ ID NO: 229716 - DNA, 635 bp, Homo sapiens
  misc_feature: GYAE6OF02I1AZ8.24.37.D04.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (295)..(295): a, c, t, g, unknown or other
  misc_feature (295)..(295): n is a, c, g, or t
tcagactactatgtcacgaccggtgctcgatttagtagcatactgttggggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggngaccctgtccctnatttgctctgtctctggtgaccttcttcagtaacacagtattattattgggcctggatccggcacgcccccagggaangccgtggtagttggtgcgtagtactacctattagtacagtcgggaccctaaccccttctacctacttcccgtcccgtacgagtacgtacgtacgtccactacgtttcacgtcggaccgtcccgtaccaacgaacccgtacgtaccctcccgtagtacggtcgtcggtcggttcgtcggtccgacccccggacgacccgacggtcctattacttacgtgtggtcggtgttaggtctagttgtggttcgcgtagtgtctcgctaccgtccggcgtcgtacgtaagttacgttaccggtgggttacgggttcgggacctaacgggtaccggaccgtacccggg

SEQ ID NO: 229717 - DNA, 773 bp, Homo sapiens
  misc_feature: GYAE6OF02IS04E.24.37.D04.1.454.CMB.1.raw
tcagactactatgtcacgaccggtgctcgatttagtagcatactgttgggtttgggggaggaactgctcagttaggaccagagggaaccatggaagccccagctcagcttctcttcctcctgctactctggcctcccagatgccaccggagacattgtgttgacacagtctccacgcccaccctgtctttcgtctccgaaggggaaacgacgcccaccctctcctgaccgacgggccagtcgaactaagttgggttaaggaagtttggttaacgtccgtaggttaataccaaacaacaaaacgagtcggaccgtacggtccccgtccccggtcttccccgtcctactacgtcgtccgtacgtccctacccgaccggtacccggtccccttcggtccgtacccgacgtccgggtacggtttcgggtcgggtcggggttcggtcgtagggtacaggtacttccacgtctacaccgtactcgacgtccggtcctacgtagtcgtacgtaattacgtttcgtacttacgtttacttcgtacttaacgtaacctagttacgtcggttacgtacgtccggtccgttacccgtacgtttaccggtttccgggaaccggtaacggaaaccgttaaacggttcggaaactaaccgttaaacggtaaacgtaaccggttcggtacggtaccggttacgtaaccggtaacctaccggtctttaccggttacctttaccgttaaccgttccccggttacccgtaaccttacgttacggtaaaccg

SEQ ID NO: 229718 - DNA, 731 bp, Homo sapiens
  misc_feature: GYAE6OF02H070T.24.37.D04.1.454.CMB.1.raw
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (361)..(361): a, c, t, g, unknown or other
  misc_feature (361)..(361): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcgctcccagaagggtcctgtcccatttccagttgcgtgagtcgggcccaggactggtgaacgcctgcggagaccctgtccctnatttgctctgtctctggtgtacttccttcagtaaccncagtattatttagttgggcctggtactccggtcaccggccccccgtaaggggaacgacggcccgtgggtaggtttgggttcggacgtaagttacgtccctaattttanaccaggttcgggacccgtaacccccgtttacgtacctacgtttccccgtcccgttcggaacgtcgtaccgacgtcctaacctatttcacgttcggacgtcccgtaccgaaacgtaaccctacgtaacctcccgtagacggtcctcggtccggttcgtacgggtcccgacccccggtaggaacccgaccgggttcccgttaagttaccgtttacgtacgggtcggtcggggtaccgtttaggtaccgtagtttggttcgttcgggtcgtagtcgttcgtacgactaccgtaccggcgtccgacttaacgttacgttaccgggttcgggtccggtttagggaccctacgggaccgggtacccgtaacccggg

SEQ ID NO: 229719 - DNA, 683 bp, Homo sapiens
  misc_feature: GYAE6OF02HWTO5.24.37.D04.1.454.CMB.1.raw
  modified_base (160)..(160): a, c, t, g, unknown or other
  misc_feature (160)..(160): n is a, c, g, or t
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
  modified_base (381)..(381): a, c, t, g, unknown or other
  misc_feature (381)..(381): n is a, c, g, or t
  modified_base (501)..(501): a, c, t, g, unknown or other
  misc_feature (501)..(501): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctccagatggccaccgggagacattgngttgacacagtctcagccacctgtctttgctccgaggggaaanacgccaccctctcctgcagggccaggtgacaagtgtaggaatttgtagccttggtatacaacacaaactntcggcctaaggcctaccccggntcccgtacagttctagtccgattcgactaacgtccaattaccgggccaagtcggacacgttcccaagtcgtaggttcaggtcgacngggtggtcgtagggactaggacctttacgaccttctccaacgtctaccgagtaccgaaggtttccgaagtaacggtccttaagggaaacgttacggttttttaccggacggtttttaacncggtttacggtctaacgggtactacgggtcccgttcgtccggtaggtacccctgtttaacccgggttcggggaccggggtttaccgagggtacggtagacgggtacgtacggttaacggcgggtaggtcctaggtacccgacgtttacgcgtttacttacccgtcgtacgttccctacccgg

SEQ ID NO: 229720 - DNA, 746 bp, Homo sapiens
  misc_feature: GYAE6OF02HBPLM.24.37.D04.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccacctgtctttgtctccgaggggaaangcccaccctctcctgcgagggccagtgacaatgttaggaagttgtagcctggtatcaacacaaacatggcaggctcccggctcctcctctntgctgtcctccaccgtacgggccccttggtcgcccgacgcccgacgggtttcggtcggtacggggttcgggtcgttcgggacgtacggtactttccgaactttccgtcctaaccgacttaccgacgggtcccggaccccttacctaccggttctttacggtaaacgtactttttacggtacctttacgtttttaacttttccgttacgttaaccttaaacaaccgtttaacttcgggttacgtaccggttcggtaccccgttaccggtaccctttacggttttaccgggaacccggtacgggggtaaacccctaaaccggttacgggtaacgtaaccgttaaaccgaaaaccggtaacccgttgggtacggtcggttaccggctaaccgactttcgttacgtttaccttacctacgtcccgtttacccggacccttacgttacttaaccgg

SEQ ID NO: 229721 - DNA, 755 bp, Homo sapiens
  misc_feature: GYAE6OF02I8BY4.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctctgctggtggcggctcccagaagggtcctgtcccatttccagttgcgtgagtcgggcccaggactggtgaagcctggcggacgacccctgtccctcatttgctctgtctctggtcacctccttcaagtaacacagtattattagttggcctggactccggcacgcccccgagggaacgagccgtggtagttggttggcgtagtatccgtattatcagtcgggacccgtaaccccccttctaacctacgtttccccgttcccctacggtacgacgtaccgacgtccgtaaccctaacttttcgaacgtcgggaacggtacccgtaccgaaaacggaaccctaacgttaaccctccccgttaggacgggtcctcgggccggttccgtacggtcccggacccccggcgggaacccgaccggggttaccctaacgttacgttaacgtggtccgggtaccgggttcgtttaacgggtcgttacgtttgggtttcggttcgggtacgttagttcgttacgttacggtcccgaacggtacccgggtcggtaccgtaacgttaagttttaacggttacggggttcggggttacgggtttcgggggaccgtaccgggtaccggggacccgttaaccccgggg

SEQ ID NO: 229722 - DNA, 704 bp, Homo sapiens
  misc_feature: GYAE6OF02IKP9T.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaccatggaagccccagctcagcttctcttcctcctgctactctggctcccagatgccaccggagacattgtgttgacacagtctccagcccaccctgttctttgtctccgaggggaaancgccaccctctcctgcgagggccagtcgacaagttggttaaggaagttgtacgtcgtggtatacaacacaaacatcggaccaggcctacccccggcttcctactactccttaatgaactcggactaacgtaccaaaggttacgggccctaacggttcggacctacgtaccccgagtacgtacggttcgaaggtcggacgtagggtggggttcgtagggactaacgttaccttactaccgttcctaccacgtactcgaacgcgtaaggtcgtaacgcgtacgtagtaagttgtttcgtacgtttaagtttacttacgttgtacgtacgtccgtaacggtcgtaaccgtacggttaccgtacccgttaccgttccgggaccccgttacgggaaaccctacggtaacgtcgggaacccttaacgtacccgaaacggtaaccgttcggtacggtccttacggaccctaaccgttgttacctaccggtttccttaccgtacccg

SEQ ID NO: 229723 - DNA, 639 bp, Homo sapiens
  misc_feature: GYAE6OF02IQNTM.24.37.D04.1.454.CMB.1.raw
  modified_base (198)..(198): a, c, t, g, unknown or other
  misc_feature (198)..(198): n is a, c, g, or t
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (382)..(382): a, c, t, g, unknown or other
  misc_feature (382)..(382): n is a, c, g, or t
  modified_base (407)..(407): a, c, t, g, unknown or other
  misc_feature (407)..(407): n is a, c, g, or t
  modified_base (624)..(624): a, c, t, g, unknown or other
  misc_feature (624)..(624): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctcagccacctgtctttgctccgagggaangccacctctcctgacagggccagtgacaatgttaggaagttgttanctggtatcaacgacaaangtggccaggctccccgntcctnatctangatcgactatacccaaagtcggcctacgtggaccagtccccgaaggtaacctaggttacaggttcgggactagggttcgggtctggggaacngttacctcaacgttcaccaacctanaccgagtccgtaaggttgtaacgacggtccgttaagaaggttattttcggaacgttaaggttttaactttaacgtgttaccgaaggtccaacggttggaaactaaccgtcggaccccttaacggtttccgggaccgaccgggataccggtaacgttcggaacctactacccgaaaacggttcctgggtaactccggatacccactttaacctcggtnttacccttctacccg

SEQ ID NO: 229724 - DNA, 836 bp, Homo sapiens
  misc_feature: GYAE6OF02ITSOR.24.37.D04.1.454.CMB.1.raw
  modified_base (590)..(590): a, c, t, g, unknown or other
  misc_feature (590)..(590): n is a, c, g, or t
  modified_base (667)..(667): a, c, t, g, unknown or other
  misc_feature (667)..(667): n is a, c, g, or t
tcagactactatgtcacgaccggtgctcgattttagtagcatactgttggggtttgggggggaggaactgctcagttaggacccagaggggaacccatgggaaacgccccaggacctcgagcttctctttcctccttcgccttacgtctcggtcctcccgacgtactacggaccaaccgggagactatttggttgttgacacacgtcctaccagccacccttgttcctttgtctccgaggggaacacgccctaccctctcctgcgtacgggaccagtacgaactagttacggttacggtagtttacggttacgtccgtaggtactaccgaaacaacgtaaaacctcgtacgggaccgtaaccggtcccgtcccccggtaccttacctactaacttcccgttaaacgtacgttaacttccgtaacgtaccgttaaccgggaaccggtaccggggaccctaccggttaccggaccctaccgttacccggtaagtaacccggttaggtacccggtagggtacggtacggttaacggggtcggttaaccggtacggaacctaccggttactacccgacgttaccacgaaccctntaaccgacgtacgacgttaaggtacgtaccgttacgttagggtaactttagtttacgtcgttttaacgttaacgttnttacgtacgtaacctcggtaacgtaccgtacctaaccgttccgtaccccttccggttacccggaccgttaacggacctaacgggtactaccggtactaaccgtaacggaccgtaaccgttcggacgttaccgcctaacgaccgttacttccgttaccttcctacgtacc

SEQ ID NO: 229725 - DNA, 549 bp, Homo sapiens
  misc_feature: GYAE6OF02H042Z.24.37.D04.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctcagccaccctgtctttgctccaggggaaangccaccctctcctgcagggccagtgacatgttagattgtanctgancaacanaantgcagctccgntccnatctatgatcgcatccgaatcggcacgtggacactccagacnggttcagtggcaggnggtcngggacagtcttcactctacactacgtcagctaggtntaaggacgcttagaattntttggacttagtttattacgtgtacgacgtctacggtcaccgtacgtccgtccgttacgtttccggcccgtagggaccagtaaccgtgaccgaactacccggtaaacacggttggccggtccacggaccctaccgtacgttcctacgtttccgtacttcccg

SEQ ID NO: 229726 - DNA, 900 bp, Homo sapiens
  misc_feature: GYAE6OF02FRLG8.24.37.D04.1.454.CMB.1.raw
  modified_base (141)..(141): a, c, t, g, unknown or other
  misc_feature (141)..(141): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggccctacganagtcacccgacggacactagttgttgtacgacagtacgtcctacgaccgacccctaccgttcgttttcgtttcgttccctacggggaaagggaacgacccgacccctacccttccgttacgtcgacggaccggtacgtaggtacgaactagttagggttaaggttagtttagtaccgtcggttagtacaacaacaaacaacgtggccgacgaccgtcccccgtacccgtccttccactacttctaagtacgtagtacgactaccgtaacgaaggggtcccgaaccgtcgggtacgacctacccctacggaacgtacggtttacggtagtacgggtcgtacgttaggggttcggtcgggtaacggaacttaccgtttacctaacccgtccttacccgtaacccgtaacctacgtaccgacggttacgtagggtttacggtaacgtacccggttacggtaaaggtttaacgtttttacggttaccggtaacgttttttaaccggttttaacgttacggttacgttaaccggtaccgtacccggttaccgttaaccgtaaaccgttcccggggttacccccgtttacccgttttacccgggttaccccgggttacccgggttaacccggtaaccgttaccggtaacgggttaccgtaaccgttacccgaaacccggttaaacgtacgggtttacggtaccggttaccgtaaccgacccgttaccgttaccgtttcgttaccgtttaccgttaccttccccgg

SEQ ID NO: 229727 - DNA, 608 bp, Homo sapiens
  misc_feature: GYAE6OF02GKJYE.24.37.D04.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
  modified_base (371)..(371): a, c, t, g, unknown or other
  misc_feature (371)..(371): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggagacattgtgttgacacagtctccagccaccctgtctttgtctccgaggggaaanacgccaccctctcctgcagggccaggtgacaatgttaggaagttgttancctggtatcaacacaaacatcggcaggcctccccggctcctcatctatgatcgctataccaagtcgggccacgtgcactcccaagacaggttcaggtgcgaggtcggtcgtgggacngacttcacgtctacactatcagcagttggagacggtactagggtaaacttgttttcgacttaattttaagttcttcgtactacgctacggtagaaccgtacttcgggacccttaccggtttccgggacccgttacgggaaccctagaccgtcggacctacggtacccgaaacggtaacgttcgggtacgtaccgtacggtacctaccgtacttccctttcgttaccttcgttaaccc

SEQ ID NO: 229728 - DNA, 723 bp, Homo sapiens
  misc_feature: GYAE6OF02HOZJL.24.37.D04.1.454.CMB.1.raw
  modified_base (203)..(203): a, c, t, g, unknown or other
  misc_feature (203)..(203): n is a, c, g, or t
  modified_base (284)..(284): a, c, t, g, unknown or other
  misc_feature (284)..(284): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatcgccaccggagacattgtgttgacacagtctccagccacctgtctttgtctccgaggggaancgcccacctctcctagcgagggccagtgaacagttaggttaggtaagtttgtacgccgttggtaactacaaacaacaaacngtcggccgacggtccctccccggactccgtctattaccgtatacgagtcgtacctactacccgtaaggtccgggacctacgttacgggcctaaccgtccccgaaggtaaccgtcgggtttaccgaggttcgggacggttaggggtttcggggtaccgttaacggggacttaggttaactttccgacttcctaccgaaccttcggtccgtaccgggtcccgtaccctacgtaccgtacggtaacgttaaggtttacgtttcgtacttttaacgtttactttcgttacgtaaccttaaccgtacgttagtcgggtactcggttccgtaccgttaccgttacgttcgttttccgggacggtaacggaactaacgggtcgtagactaacggtaacgacgttcggacgttcgacgtaccactcgttcttacgtccgttatcccg

SEQ ID NO: 229729 - DNA, 744 bp, Homo sapiens
  misc_feature: GYAE6OF02FZB2G.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggctccagatgccaccggagactattgtgttgacacagtctccagccaccctgtctttgtctccgaggggaaanacgcccaccctctcctgcgagggcctagtcgaactaagttggttaaggtaagtttgttacgccgttaggtataccaaactaaccaaaactagtcgggaccgaacgggacctcccccgggtctaccctacacttcctaagtggaatcgacctaataccctaaaggtaccgggaacctacggtacgacctaacgtaccccgtaagaccggtaaggttaccgaggtacggtacgtagggtccggggtcgttacggggaactacggttaactttcacccgtttcctaacctaacccgtagtaccgtaacgtacgtaaggttaggtaacggtacggttacccttaaggtaaacggtttaagtttacgtaacgttaacgttttaacgttacgttacggtacgtaacgtaccgtaaccggtacgtaacgaaccgtcggtaaccccttacggttacccggccggtacgggacctacgtacgtcgtaccgactaccgaaacggttacgtggtacgcgtacgaccgtactagtactcgttcctactacc

SEQ ID NO: 229730 - DNA, 667 bp, Homo sapiens
  misc_feature: GYAE6OF02G7A49.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtcccatttccagttgcgtgaggtcgggcccaggactggtgaagcctgcggagaccctgtccctcatttgctctgtctctggtgaccttccttcagtaacacagattattattgggcctggatccggcacgcccccgaggagagccgtgaggttggtcgcgagtatccgattatcagtcgggaccgtaaccccttctactacttccgtccctcgagtacgtcgtataccgacctactttcacgttacggacgtcccgtaccaacgaacccgtagtcctacccgtggacgcgtcggtcggtctcggtccgacccccggcggaccgaccggccgttactattacgtcggtggtccgggtacgttacggtctagttcggttagttgggtcgtacgttacgtcgtcgtaccaccggtaaccggtcggaaccgtacgtaagttttaacggtttaccgggttcgggggttccggttttagggggacccgtaacgggtaccggggtacccgtaccccgggg

SEQ ID NO: 229731 - DNA, 770 bp, Homo sapiens
  misc_feature: GYAE6OF02GYQ1V.24.37.D04.1.454.CMB.1.raw
  modified_base (154)..(154): a, c, t, g, unknown or other
  misc_feature (154)..(154): n is a, c, g, or t
  modified_base (298)..(298): a, c, t, g, unknown or other
  misc_feature (298)..(298): n is a, c, g, or t
tcagactactatgtcacgaccggtgctcgatttagtagcatactgttgggtttgggggaggaactgctcagttaggacccagagggaaccagtggaagcccagctcagcttctcttcctcctgctactctggcctcccagatcgccgaccgganactattgtgttgacacagtctccagcccacctgttctttgctccgaagggaagtcgccctacctctcgtgaccgacgggccagtcgaacgtataggttaacggtatttcgtagccgtaggttactacgaaactaactaaaacgngtcgggaccgtacggtcccgttcccccggacttcccgtactacgtcgttaacgtcgtaacgttcgaccgttaactaaccgtaaggtaccggcccgtaagtccggactaacccgtccctaagtacgtacggtcgacggttggacgttacgggtggttaccgacgggtactaacggtccgttaccgacttaccgactacgtacgtacgaccgtatccggaaccttacggacctacggtataaacgttcgttttcgaacggtttactcggtacgtacgtcgtaccgtaggttcccgtacccgggtcctacgggtacccttaccgtttacggggtcccggggtaccggggtacgtaaggggttcccggaggggaaccgttaacgggtacgtacggttcggggtgtcccgtaacgtacccggttaccgtacgtttccgtcggtttaaacccgttccgttaacgttcccccgtacccg

SEQ ID NO: 229732 - DNA, 557 bp, Homo sapiens
  misc_feature: GYAE6OF02F3Z4L.24.37.D04.1.454.CMB.1.raw
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (288)..(289): a, c, t, g, unknown or other
  misc_feature (288)..(289): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (307)..(308): a, c, t, g, unknown or other
  misc_feature (307)..(308): n is a, c, g, or t
  modified_base (312)..(312): a, c, t, g, unknown or other
  misc_feature (312)..(312): n is a, c, g, or t
  modified_base (314)..(316): a, c, t, g, unknown or other
  misc_feature (314)..(316): n is a, c, g, or t
  modified_base (319)..(319): a, c, t, g, unknown or other
  misc_feature (319)..(319): n is a, c, g, or t
  modified_base (324)..(325): a, c, t, g, unknown or other
  misc_feature (324)..(325): n is a, c, g, or t
  modified_base (327)..(328): a, c, t, g, unknown or other
  misc_feature (327)..(328): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
tcagactactatgtcacgaccggtgctcgatttagtagcatactgttggggtttggggcgacaggggaccaccggtccaccggttcctccgtctagcctcctaccgaagggcccatcgggtcttcccccctgggcaccctcctccaagagcacctctggggggactacgagcgaccctggggtccttggtccttgggtcctaaagggttactaacttccaactatagtagtctcgaggcgggctggggactaagggcggactagttacgngngctggacnganctctnncantntagtgatcacgtnntatngnnnctntcgcnngnngagagagtagtatatntngtatatagtatagnanatatatatatanactatatacgtagagagacgtagtactacnctacgtcgtagaacgagtatacgaacacgtactatatactactaacacgtacggactacgactagagacgcgtacgtacgacgagtacgtagtagtacgtagtaggagaggtaggagtagtagtacggtacggtacggtacggtcggcggtcg

SEQ ID NO: 229733 - DNA, 652 bp, Homo sapiens
  misc_feature: GYAE6OF02JVJTL.24.37.D04.1.454.CMB.1.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagactactatgtcacgaccggtgctcgatttagtagcatactgttgggtttgggggggtaaagtgctttctgagactcatggacctcctgtgcaagaacatgaagcacctgtggttcttcctcctgctggtgcggctcccagaagggtcctgtcccatttccagttgcgtgagtcgggcccaggactggtgaacgcctggcgganacccctgtcccctnatttgcttcgngttctctggtanaccttcccttcagtaaccacagatttattattggcctggatccggcaccgcccccgagggagacgccgtggacgttggtgcgtagtactccgtattactcaagtcggggccctaaacccccgttctaaccgacttccgtaccctcggagtacgtcgagtccacgtacttacacgtggacgccgttaccaaacgacctaaccgtacgtccctacggacggtcgtcggtccgttcgtcgtaccgtccccggacggccgaccggtaccgtatacttactggtccgacgggtcttacggtctagttgttggttggtaccgtagtcgttcgtgtacgtccgtacccggcgtcgtacgtattacgttacggtacggtcgggtttacgggcgtaacggaccgggtaccctaccgg

SEQ ID NO: 229734 - DNA, 694 bp, Homo sapiens
  misc_feature: GYAE6OF02GWH9X.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgcccaccggagacattgtgttgacacagtctccagccaccctgtctttgtctccgaggggaaanagcccaccctctcctgcagggccagtgagaatggttggcagctaacttgcctggtaccagcaagaaacctggccaggcctcccgaggcctcctcatctatgctcgtcctccaccgcgggcccctggtccgtcccgagtccgtgggtttcggtcggggtcggttggggtcgtggggacctaggttactttcgacttctaccaccgtatccgacgggtcccgtcccttaccgacgttccgtaaggtaagtttacgttttacgactttaactttttatttccgttacgttaacctaaaccgttacgttacggttgggttacgtaccgttcgggttccccgttacccgttacgtttaccgttttccgggaccggtaacggggtaacctaacggtggaaacgtacgtaaccgaaacgtacggtcggtcggtacgtacggacctaccgttagttccgttcgtttaccttaccgtacctttcccgtaccccgtacc

SEQ ID NO: 229735 - DNA, 758 bp, Homo sapiens
  misc_feature: GYAE6OF02IQ5FP.24.37.D04.1.454.CMB.1.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
tcagactactatgtcacgaccggtgctcgatttagtagcatactgttggggtttggggggaggaactgctcagttaggaccagagggaaccatggaagccccagctcagcttctcttcctcctgctactctggctccagatgccaccggagacattgtgtgacacagtcctcagccaccttgttctttgtctcgaaggggaaanacgccaccctctcctgcgagggccagtgactaagttggttaaggtaagttgtacgctggtancaacacaaacntcggccacgggcctcccccgggactccctcacgttacctagtgacttcgctaactaccgtaaaggtacgggacccctaggtacggcctaacttccccgaaggtaccgtacgggttagtacgggtacggacggtaggggttacggggttcggtaacgggacgtacggttacctttaccgacttccctaccaccgtaactccggtaagaccgtaagggtcgaaggtaccgtacggtaagtaacgtttacggttttacgacgttttaagtttttaacgttactacgtttacggaacgtccgtaacccgggtaataccgttaacggtcccggttacccgttaccgggtttacccgggcccttaacggggacccgaacgttacgttacggacccgttaacgtaacccggtaacttaaccggtaggtcccggtaacgttccggaacccttacgtacgtttcgtaacccggtttcccttaagttcccc

SEQ ID NO: 229736 - DNA, 735 bp, Homo sapiens
  misc_feature: GYAE6OF02GYMVU.24.37.D04.1.454.CMB.1.raw
  modified_base (207)..(207): a, c, t, g, unknown or other
  misc_feature (207)..(207): n is a, c, g, or t
tcagactactatgtcacgaccggtgctcgatttagtagcatactgttgggtttgggggaggaactgctcagttagggacccagagggaaccatggaagccccagctcagcttctcttcctcctgctactctggctccagatgccaccggagacattgtgttgacacagtctccagcccaccctgtcctttgtcctccgaggggaaancgcccaccctctcctgcgagggccagtgacaatgttaggaagttgtagcctggtatcaacacaaacatggtcacggcctccccggctcctcactctatgatcgctatacccaaggtaccgggacctacgtcggaccacgtacccaggtaccgtaggttcgaagggtcgggaccgtaaggggttcggggtaccgtaggggaaccgttacggtaccgtttcccgaccttaccctacccgaacctacgtacgacgtacgtaagggttcgtaacggccgttaccgtagttaaacggtttcgttttaacgggtacgtttaaggtttttaacttacgttacgttaacccgacggtaacccgtaccggttacgaaccctaaccgggtttcccgtacccgttaccggtttaccgggccccgttaaccgggacgaccggtacgtaacggacctaaccggtaacccggaaccgttacggttcggtaaccgtccgtacgacctaccgttagttcctacggtttaccctccgttaacccg

SEQ ID NO: 229737 - DNA, 635 bp, Homo sapiens
  misc_feature: GYAE6OF02GWIDG.24.37.D04.1.454.CMB.1.raw
  modified_base (149)..(149): a, c, t, g, unknown or other
  misc_feature (149)..(149): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggngacattgtgttgacacagtctccagccaccctgtctttgctccaggggaanagccaccctntcctgcagggcccagtgacaatggttaggaagttgtagcctggtatcaacacaacntggaccaggctccccggctcctcatctatgatgcatccaagtacgggccacgtggacactcccgagactaggttcagtcggctaggtcggtacgtgggacaggacctttcgaccttcgctaacccatccgacgtacgtacggttagttaacgacgtcccgtagtaaacgtatttttacggacttaaggttttaactttacgtagttacgtacgtcgtaaccggttcgaaccgtaaaccgtccgggtacccttaccgttttaccgggacccgttacggggaccctaagtaccgtcggacgtacgtacccgtaaacggaccgtaggtaccgcgttacgacgtacccgtagttcccgtagttcctcttaccg

SEQ ID NO: 229738 - DNA, 750 bp, Homo sapiens
  misc_feature: GYAE6OF02I0JLN.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggctcccagatgccaccggagacattgtgttgacacagtctccagccacctgtctttgtctccgaggggaancgccaccctctcctgcgacgggccagtcgaactaagttgttaaggtagttgttacgccgttggtaattccaaactacaaactagtcggaccacggcctcccccggactcctacgatcctaagtcgagtcgctaacgtaccaaggttccgggacctaggtcggaccctactccccgaggtaccgtaggttccgaggttacggcgtagggttcgggtacgtacgggaactaacgtactttccgaaccgtttccgtacccaaccttacgacgtaccggtacgtaacggttcggtaagtaacccggtccggttaaggtaaacgtttacgtttagaccgtttaattttaaacgttccgttagttacccgaacggttaccgtaaccgtagtaaacctaacggttcccggtaccctttaccggtttaacccgggcccgttaacgggaaacccgttaagtaccggttacgtaacctaccgtaaccggaaccggttaacgtcgggtaccggtacttacggacctaccgtacttcgtacgtttcccgtaccttccgg

SEQ ID NO: 229739 - DNA, 672 bp, Homo sapiens
  misc_feature: GYAE6OF02FNGLG.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtctttgtctccgaggggaagagccaccctctcctgcacgggccagtgacaagtgttaggagttgttagcctggtatcaacacaaacatggccaggcctccccggctcctcacttctattgactgcactaccaacgtacgggcctacgtcggcctacctcccgaacgtacgtacggttaccgtaggtacgggctaggggtcgggttacggtacgggactacgtacctttcgacccttcctaccgaacctagtccgaacggtactaggttacggtaagacggtaccgtaggtaagttacgttttgacgtttagtttactacgttgtcacgcctacgtacgactaacgtccggtcccttacggttcccggtaccgtacgggtacgtaacgtcgttacggaccgttaacctaccggaaacgttaaccggtcggtacggtacccgtaggtaccctaaccgtacgtttccgtaccggtttaccttaccgttacccg

SEQ ID NO: 229740 - DNA, 724 bp, Homo sapiens
  misc_feature: GYAE6OF02H0HYG.24.37.D04.1.454.CMB.1.raw
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctccagaagggtcctgtcccatttccagttgcgtgacgtccgggcccaggactggtgaacgcctggcggactaccccgtgtcccctntatttcgctctgtctcgtggtctaccttcttacaagtaaccanagtatttaattgtcgggcctggactccggcaccggcccccgaagggaacgacgtccgtggtacggttggtcgcgtaagtactacctattactcgaacggttcgggaacccctaacccccgtttgtaacctaccgttccccgtacccttaggaacgtacggtccgtacgtccaaccgttattaccgtacgtggacgtcccgtaaccaaacgtaaccctacgttacccgtcccgtaggccgtacgtcggccgttcgtcgtcccgaaccccggtcgaaccgtccggtacgtactaacgttcgtcggacggtccggttacgttaacgtcctaggttcggttagtcggtacggtactttcgggtaccgttgaccccgtaacgtttacccgcggttaccgtacttaaagtttacgtcggggttacggtcggtttaccgggactaccgggagtacccggtaccgg

SEQ ID NO: 229741 - DNA, 953 bp, Homo sapiens
  misc_feature: GYAE6OF02G7ZY6.24.37.D04.1.454.CMB.1.raw
tcagactactatgtcacgaccggtgctcgatttagtagcatactgttggggtttggggggggaaatgctttctgagactcatggacctcctgtgcaagaacatgaagcacctgtggttcttcctctgctggtggcggctcccaggaaggtcctgtccctatttccagttgcgtggtaggtccgggcccagggactgggtgaacgtccgtggaccgggacgaccccttgtccccttctagttttcgccttcttcggttccttcgtacgggttctaaccctttccctttacgaaggttaaacccaacgtaagttaaatttttaaattttacgtttacggggggtcccttaggggtaaccttcccggggaccgtaaacccggacccccccgtaaaggggggaaaacggacggtcccggttggggttaacgggtttcgggttcgggaccggtaaggttaacttacccgttaagtttaactcgtacgttacgggggaccccttaaaccccccttttacgtaaccttaaccgtttccccgtccccgtacggtaacggtacgttacgtaccgtacctaacccttacgttttaccgaacgttcgggaacgtacccggtaaccaaaaccgtaaccgaccgttaaccctcccgtaaggacggtacgtccggcgggttccgttcggtaccccggtaacccccgggcggtaaccgaacccgggttaccgttaacttaacgttaccgttacgggtcgggtacgggttaccgttaacgggttacgtttacggtttacgggttacgggtttacgggtaccgttaaacgttcgttaccgtcggtacccgttaaccgtaccgggaccggttaaccggtaaccgttaaaggttttacgttaccggggtttacggggttcccgggggttttagggacccgttaaccgggtacggggtaacccttaacccggg

SEQ ID NO: 229742 - DNA, 806 bp, Homo sapiens
  misc_feature: GYAE6OF02J1CAE.24.37.D04.1.454.CMB.1.raw
  modified_base (206)..(206): a, c, t, g, unknown or other
  misc_feature (206)..(206): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagataccactggagaagtagtcatgacgctagtctccagccaccctgtctgtcgtctccgaaggggaanacgccaccctctccgtgctagggccaagtgaagaacgttggttcggacaggacctaacgtttacggcccgttaggtaacccgcgtaccgaacggtaaacccgtcggacccgaacgggtccccttacccggacgggtaccttccccgttaccctgttaacgtccgtccgtttccgtccgtaaccccgaacccgggtaccgggtcccccgtttcggggttccgacccccggtaacggtccccggttacgggttcgggtttccgggggtcgggtttaacggggtccggttacggggtaactacggtacctttttccgaaacgtccttaccgacccgtttaactccggaaggcccggtacccttacgtacgtccgttaagttacgtacggtttctaccgtttactttacgtttcgtacgtacctaactccgttagtcggtaacgtcgttaccgtccgttacccgttactttcccggtttagacccggtaacgggtaaacctacgggtacgtacgaacgttaaccgaacgttactgggtacgtacggtcaccgttaccgtcttacgttacgttccttaacgtccgtttacccgtaccccgttacg

SEQ ID NO: 229743 - DNA, 646 bp, Homo sapiens
  misc_feature: GYAE6OF02GFORK.24.37.D04.1.454.CMB.1.raw
  modified_base (206)..(206): a, c, t, g, unknown or other
  misc_feature (206)..(206): n is a, c, g, or t
  modified_base (274)..(274): a, c, t, g, unknown or other
  misc_feature (274)..(274): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccgggagacattgtgttgacacagtctccagccacccctgtctttgtctccgaggggaaancgccaccctctcctgcagggccagtgacaagtgttaggaagttgttagcctggtactcaacacaaacngtcggaccaggcctccccggctccctcactctatcgatgacatccgaagtacgggccacgtggactacctcccgaagaccgtaggttccaggtcggactagggtcgggtcgtagggacagtaccttcactcctaccactatcgagacaggtgtacgacgtccgtaggtaaagttagttttcggactttaagttttaacttacgttgtaccgtaggtaccctacggtacgaaccgtacggtccggtaccccgttacgtttcccgggacccgttacgggaacccgagtaccgtacgacctaccgtaaccgaaacggtacttcgggtacgtccgtacgaccctaaccggtcttcgtacgttccttacgttacccg

SEQ ID NO: 229744 - DNA, 652 bp, Homo sapiens
  misc_feature: GYAE6OF02GS73Q.24.37.D04.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
tcagactactatgtcacgaccggtgctcgatttagtagcatactgttgggtttgggggaggaactgctcagttaggacccagagggaaccatggaacgccccagctcagcttctcttcctcctgctactctggcctcccagatcgccaccgggagacattgtgttgacacagtctccagccaccctgtctttgtctccgaggggaaancgccacccttctcctgcacgggccagtgaactaagtggttaggaacgtttgttagccgtggtaatcaaacacaaacntcggccaggcctccccggntccctnactcctancgatcgacactaccaagtccggccacgtcggccactcccgaagtacctaggttcgaggttcggacgtagggtgggtcgtagggaactcggtacttccacttccgacctaacctanccgtagaccgtaggtntaacggcgtacgtagtagtttaacttcgtacgtttaagtttaacttcgtcggtacacgccgtaacggtactaaccggtaaccgttccggtacccgttaccgtttcccgggacccgtcggaaacctacggtacgtaccggactacgtaacccgagttaaccgtggtacgaccgtgacctacacgttctcggtccttactacccg

SEQ ID NO: 229745 - DNA, 698 bp, Homo sapiens
  misc_feature: GYAE6OF02I1PP4.24.37.D04.1.454.CMB.1.raw
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (551)..(551): a, c, t, g, unknown or other
  misc_feature (551)..(551): n is a, c, g, or t
  modified_base (564)..(564): a, c, t, g, unknown or other
  misc_feature (564)..(564): n is a, c, g, or t
  modified_base (572)..(572): a, c, t, g, unknown or other
  misc_feature (572)..(572): n is a, c, g, or t
  modified_base (595)..(595): a, c, t, g, unknown or other
  misc_feature (595)..(595): n is a, c, g, or t
  modified_base (632)..(632): a, c, t, g, unknown or other
  misc_feature (632)..(632): n is a, c, g, or t
  modified_base (677)..(677): a, c, t, g, unknown or other
  misc_feature (677)..(677): n is a, c, g, or t
  modified_base (692)..(692): a, c, t, g, unknown or other
  misc_feature (692)..(692): n is a, c, g, or t
tcagactactatgtcacgaccggtgctcgatttagtagcatactgttgggtttggggaggaactgctcagttaggacccagagggaaccatggaagccccagctcagcttctcttcctcctgctactctggctcccagagacccaccggagtaaattggtgttagaccacagtctaccaggcctacctgtctttgctccagggganggancccacctctccngccgagggccaggtccggaagtttcgtaagtaacgtacttacgggcttacggtaacccagtaacgaaaccgtcggaccacgggcttaccccnggtcctaccctnacttaccgttagatacgttaccggttcctaccgtaaccgagggttccccaacgttcggaccccgtccccggtcgaacggtttccgaaggtttcgcgtacggttcgggttacgacgggtacacggttaccttcgtaaccgtcttacccgacgtcaacgtactacgcccgtaagacctccggtagaacgttagttttcgtaccggtttactacgtcggtagtaccgntacgtccggtccnccggtacncgtcgtaccgttcggggcgggtnagggggtcgtaggcggtacggaacgttacggtacggnggactgggacctacgtagttccgagttcctctaaccgttcaccgntacgtctacgacgtnttacgg

SEQ ID NO: 229746 - DNA, 746 bp, Homo sapiens
  misc_feature: GYAE6OF02H4RMV.24.37.D04.1.454.CMB.1.raw
tcagactactatgtcacgaccggtgctcgatttagtagcatactgttgggtttggggggaaatgctttctgagactcatggacctcctgtgcaagaacatgaagcacctgtggttcttcctctgctggtggcggctcccagaaggtcctgtcccatttccagttgcgtgagtcggcccaggactggtagaacgccgtgcggactacccttgtccctctatttcgctctgtcctgtaggtcgtaccttccgttcgaagttaaccgactaggtaattttagttacgttcgggtcctggaacgtcccggactaccggacccccggtaaagggtaacgacggtccgttagggtacggtttcggttgaccgtaagttactaccctatttacgtcgtacgtaccggtacccctaacccccttgtaacccttccgttacccgtccctacggtagtaccgtcgacgtactacgtactttcgacgtcgtacgtccgtaacaacgtactacgtaccgtccgtgtacgtcgtcgtccgtacgtcgtacccgtaccccggagtaccgaccggtacgtaattacgttacgtgtaccgggtcggttacgttacggtacttacgttggtcggttacgtacgtaagttccgtccgtagtaccctaccgtccggtacgtaccggtactttaacgttacggttaaccggggttcggttaccggggtttacggaacccgttaggtaccccgggtacgtaccccgg

SEQ ID NO: 229747 - DNA, 863 bp, Homo sapiens
  misc_feature: GYAE6OF02HBJ41.24.37.D04.1.454.CMB.1.raw
  modified_base (267)..(267): a, c, t, g, unknown or other
  misc_feature (267)..(267): n is a, c, g, or t
tcagactactatgtcacgaccggtgctcgatttagtagcatactgttgggtttgggggggaaatgctttctgagactcatggacctcctgtgcaagaacatgaagcacctgtgttcttcctctgctggtgcggctcccagaagggtcctgtcccatttccagttgcgtgaggtcgggcccaggactggtgaagcctggcggacgaccccttggtcccctgaattttcgctcgtgttcctcgtgggtcaccttccttcgagttaaacncgtaagtatttattaattgggcctggtactccggctacgcccccgagggaacgacggtccgtaggtaggtttcggttaggcggtaacgttacgttcccgtaagtttacgtaccgtaagttacggggtacccccgtaaaccccccttttccgtaacgtaaccgttttccccggttacccccgttcggtaacggtacggtttaccgggaacttacccggaacccttaacgttttacccaaccggttaccgggaaccgtaccccgttacccggaaaaccgtaaacccgtacgtttaaccctaccccgtacgggtaaccgggtcctcggggttcccgggttaccgttcgggttacccgtacccccccgggaccgggtaacccggtacccgggtacccctttaacgttaacgttaccgttgggtaccggtccgggttaacgtttccgggttacgtaagtttcggttaggttcggacggttagttcgttacgtcgaccgtaccgttacccggcggtacggtaacctaaagtttacggtttaacgggttacgggttccggggttttacgggccgtaacggaccggggtacccttaacccgggg

SEQ ID NO: 229748 - DNA, 801 bp, Homo sapiens
  misc_feature: GYAE6OF02H9ERP.24.37.D04.1.454.CMB.1.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
tcagactactatgtcacgaccggtgctcgatttagtagcatactgttggggtttgggggaggaactgctcagttaggacccagagggaaccatggaagccccagctcagcttctcttcctcctgctactctggctccagatgccacggagacattgtgttgacacagtctccagccacctgtctttgtctccgaggggaanacgcccacctctcctgcgacgggccagtgacaagttggttaggaagttgttacgcctggtatacaacaacaaactntcggccaggcctccccggtctcctcattctatgatgcaactaccgaagtccgggcctacgtcggacacttcccaagtacgtacggttcgaaggtcggtacgtagggttcggggtacgttaggggaactaacggtacctttcaacccgtccgttaccgaaccctagtaccgtaaggacggttaacggtaggtaccggaacgtcccggttaaggtaagtttaacgttttcggtaatttaaggttttaactttacggtcgtaacgtcggtaaccggtacccgttaaggtaacccggttaacggttcccggttaaccccgtttacgggttttacccccggggtaccgggttaacccggggtaaaccgtaacccgggtaaccgttacccggggttaaacctaccccggttaaacccggtaaaacccggtttaccggttacgggttaaccgggttacccgtaaccggaccccgggttaaacccttccggtttacccgtttaccgttttaccccgtttaccggtaaccccc

SEQ ID NO: 229749 - DNA, 803 bp, Homo sapiens
  misc_feature: GYAE6OF02F2GV9.24.37.D04.1.454.CMB.1.raw
  modified_base (581)..(581): a, c, t, g, unknown or other
  misc_feature (581)..(581): n is a, c, g, or t
tcagactactatgtcacgaccggtgctcgatttagtagcatactgttgggtttgggggaggaactgctcagttaggacccagagggaaccatggaagccccagctcagtcttctcttcctcctgctactctggcctcccagatcgccgaccggagactagttggtgttagaaccactacgtcctccacgccctacccttgttctttcgtcctaccggaagggggaaacaccgaccctacccgttcctcccgtggaccgacgggaccgagtacgaacttaaggttaggttaaggtaagtttggtacgccggttaggtaactacaaaccaacaaacgtgtaccggaccgacggtccctaccgacggtccctcctactagtcttagtacgtactccgtaccgtaccgaacggtcggttaccgacggtccgggtcccccggtcccctaccggttaggttaccagggtcggtacgtaggggttcggggtacggtacggaacttacgtccttacacctcgtaccaccgtacgacgactcgtaccgtagacctcgtaaggttacgtttacgtttcggtacgtttaacncgttcgtacgtacgcgtacggtcccgttacgccgtccggacccgttaccggttaccggggttcgggggacccgggggtacgtacgggggtaggaacggacgggaacgtaccgttacgggtggttaaccggcgttaaaccggtcccgaacgtttaaccggttccgtttgtttaacccctcggtttaaacccccgttcccgttacccgtcctacggttaaccgg

SEQ ID NO: 229750 - DNA, 629 bp, Homo sapiens
  misc_feature: GYAE6OF02ILG33.24.37.D04.1.454.CMB.1.raw
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
  modified_base (436)..(436): a, c, t, g, unknown or other
  misc_feature (436)..(436): n is a, c, g, or t
  modified_base (609)..(609): a, c, t, g, unknown or other
  misc_feature (609)..(609): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgtgacacagtctccagccaccctgtctttgtctccgaggggaaanacgcccaccctctcctgcagggccagtgacaatgttagaacgttgttagccttggtactcaacacaaacntggaccaggcctcccccggntccctcactctatgatgcatccgaatagggcccaagtcggacactaccgaagtacgtaggttcgaggtcggactagggttcgggtacgtagggacacgtacttcgacttaccgacaacctgacctagcctaaggtcgtaacgngtcctaggaacgttgttttacgactttaggtttacttactgtaccgagtcctacgaacgtactaccgttggaccccttacgttccgacccgttgggaacccaggtacctcgggactaccttaaccggaacgttaccgtaggtccggcgtaccgtaacgtaccctgtttaccgngttttacccgagttaccccg

SEQ ID NO: 229751 - DNA, 676 bp, Homo sapiens
  misc_feature: GYAE6OF02GR97O.24.37.D04.1.454.CMB.1.raw
  modified_base (204)..(204): a, c, t, g, unknown or other
  misc_feature (204)..(204): n is a, c, g, or t
  modified_base (280)..(280): a, c, t, g, unknown or other
  misc_feature (280)..(280): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagcccacctgtctttgtctccgaaggggaaancgccaccctctcctgcgagggccagtcgactaatgttaaggaagttgtacgcgtaggtactacaaactacaaaacnttcggaccaagggtccctcccccgggtcttcccctacgtacttccgtaatcgaatcgcaacgtccaaggtacgggccacgtggcacgtcccagacgtaggttcaggtcggatagggtggtactgggacaggtacttacactccncacctatcgancgtaacggtacgtaagtacgtaccgtaggtaacgttagtttacgtcgtttaagttttacgttacgttagtactacgaccgtaccggtagtaaccgtaaccgtccggtacccttaccggttaccgggcccgttaacggaccgtaacggtaccgtacggacgtaccgtaaccgaaacggttaaccgtcggtaacgggtcctaacgaccgtacttacccgttctacgttaccgttacttacccg

SEQ ID NO: 229752 - DNA, 752 bp, Homo sapiens
  misc_feature: GYAE6OF02FI782.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtccgggccaggactggtgaagcctgcggagaccctgtccctcatttgctctgtctcgtggtgacctccttcagtaacacagtattattattgggcctggactccggcacgcccccagggaacgacgcctgggacgttggttgacggtaggttactaccctagttactcgtaagtcggggaccgtaaccccccgtttactaccgtacctttccccgtaccccgttcggaaggacggttcggaacgttacctacccgttaacttttccgaacgtgggaccgtcccggtaccgtaaacgaaccctaggtaccctcccgtaggtacggtcgtacggtccggtcgttcggtaccggtaccccccggcggtaaccgacccgggtaccgttaaacgttacttaccggttggtacgggtccgggtacggttacgttccgtagtttcgggttaggttcggtaccggtagttcgttacgtaggtaccctacgttacccggcgtaccggtacttaacgtttacgttaccgggttacggggttcgggtttacgggggaccgtaccggtacggggtaccccgttaccgggg

SEQ ID NO: 229753 - DNA, 624 bp, Homo sapiens
  misc_feature: GYAE6OF02FWLS2.24.37.D04.1.454.CMB.1.raw
  modified_base (204)..(204): a, c, t, g, unknown or other
  misc_feature (204)..(204): n is a, c, g, or t
  modified_base (271)..(271): a, c, t, g, unknown or other
  misc_feature (271)..(271): n is a, c, g, or t
  modified_base (342)..(342): a, c, t, g, unknown or other
  misc_feature (342)..(342): n is a, c, g, or t
  modified_base (488)..(488): a, c, t, g, unknown or other
  misc_feature (488)..(488): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgttgacacagtctccagcccacctgtctttgtcctccgaggggaaancgccacccgtctcctgcagggccaggtgacatgtaggaagttgttagcctggtatcaactacaaacntcggccaggcctccccggctcctcatctatgatcgactactccaagtcgggccacgtgcactcccagtacnggttcagtggacgtagggtcggtacgtcgggtaacacggtacttaccgacttaccgtaccaccctaatccgagccgtaaggtcggtacgagtccgtaagtaacgttatttcgacgttagtttaatcgttagtcacgtacctacgtnaacctacggttcgacccttacgttccggccgttacggacctacgacgtaccgactccgtaacctaacggtaaccttcgggacgtacccgttacggtacccgtacctaccgttcgttaccgttaccgttcttacccg

SEQ ID NO: 229754 - DNA, 799 bp, Homo sapiens
  misc_feature: GYAE6OF02HXCZL.24.37.D04.1.454.CMB.1.raw
  modified_base (154)..(154): a, c, t, g, unknown or other
  misc_feature (154)..(154): n is a, c, g, or t
  modified_base (165)..(165): a, c, t, g, unknown or other
  misc_feature (165)..(165): n is a, c, g, or t
tcagactactatgtcacgaccggtgctcgatttagtagcatactggttggggtttgggggagaactgctcagttaggacccagagggaaccatggaagccccacgctcagccttctcttcctcctgctactctggctcccagtatgccaccggngacattgtgtnacacagtctccacgccacctgtctttgctaccgagggaacacgccaccctctccgtgcgacgggtccagtgagtaatggttacggcagactaactcgcgtacggtaaccacggtacaacgaacgtcggaccaggtccctaccggaggtcctccctacccgtacgtacgtgaccgttcgccttacccgacccggtaccgggtaccccgttgggtaccgttaccccgaacgtcccggtaacgggtttcggtacggggtccggggtacgggttcccgtaagggggtaacctagtaaccttttacccgaacgttccgtacccgtaaaccgttactaccgggtaacggtcccgggtacccttaccggtaaggttacccgtaaggtaacggtttacgtttacgtaccgtttaaccttttacgtttacgtacgttaacctaaacttacgttaattcgggtacgtacgtcggtaccttacccggttacgttaccggtttacggacccggtaacggtaaaccgttaaacgtcggttaaacgaccgttaaacgtaaccgtacgtacggtacggaacgtacgactaacccggtattaccggttacttacggttacctaccgtttacccgtccccgtattaaccgg

SEQ ID NO: 229755 - DNA, 684 bp, Homo sapiens
  misc_feature: GYAE6OF02FVLW0.24.37.D04.1.454.CMB.1.raw
  modified_base (260)..(260): a, c, t, g, unknown or other
  misc_feature (260)..(260): n is a, c, g, or t
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccagaagggtcctgtccctatttccagttgcgtgagtccgggcccaggactggtgaagcctggcggacgacccctgtccctctattttcgccttctgttctcgtggtcgacttcccttanacgtaacacagtattatttagttggcctggactccggcaccggcccccgagggaagcgccgtgggtagtttgggtcgcgtagtactccattatcagtcgggtaccctaacccctttctaactccttcccgtccctcggtacgtacgtacgacgtcctacttattccacgtggacgcccgtaacaaacgacctacgttacctcccgtaggacgtccgtcggtaccggtctccggtaccggacccccggcgaccgtacggtccgttattacgttaacgtgtcgggcggttcgttagggtctagtttcggtagttgggcgtgttcgtccgtgtaccgtacgtcccggtcggtactacgttaacgtttacggttcgggttacgggttcgggttacgggaccgtacgggaccgggtacccgtaacccgg

SEQ ID NO: 229756 - DNA, 769 bp, Homo sapiens
  misc_feature: GYAE6OF02FQKJJ.24.37.D04.1.454.CMB.1.raw
  modified_base (151)..(151): a, c, t, g, unknown or other
  misc_feature (151)..(151): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
tcagactactatgtcacgaccggtgctcgatttagtagcatactggtggtttgggggaggaactgctcagttaggacccagagggaaccatggaagccccagctcagcttctcttcctcctgctactctggctcccagtatgccaccgganacgattacgtgttgacacgtagtcctaccgtagcccaaccgttgtcctttggtcctcgaggggtaacncgcgaacctntcctgacngggtccngtcganactgttacgaagttnttagcgtgtatcaaacgtactaaacgtcttacggacccaaggtccttacccccgggattccgtacctacggtccttaaccgtaggacctttacgctaactacccgtagtaacggggtccacgtcgggtactaacgttccccgaagtacctagggtttccaacggttcggaccgtaggttcgggtacgtacgggacctagtaccgttcgtaacggttcaccggttacctactccgtacgtactaacgggtcttaacggacggtaccctaaggaaaccggtttattttacggacgttaggtttttaaacgtaccgttgttaaccgtaggtacccttacgggttacaccgtaaacgttccggtacctaaaccgtttcggaaccctttacggaaccgttaacgtaccttaccgggtacaacgggtttaccccaaacgggtttacccagggttaccgtaccggtaggtaacctaccggttaaatcccggttaagtcccgtttagtaccc

SEQ ID NO: 229757 - DNA, 685 bp, Homo sapiens
  misc_feature: GYAE6OF02F2VGL.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgttctttgtcctccgaggggaaagagccaccctctcctgcacgggccagtgaacgaagttacggttaggtaacgttttaggtttagccttgggtactaccaactaacaaacattacggaccgacgggcctccccccgggtcctcccttccaacgttctacttggattcggcactaccaagtacgggccacttcgggacactcccaagacacgggttcagtggcgaggtgggtcgtgggaccaggtaccttcgaccttcctaccacctacgtcagactagtaggtacgacgccgtaggtaacgttagttttacgacgttaagttttaacttacgttagtactaggtacccgaccggttacgaaccgtaaccgtaccgggttacccgttacccgtttacccgggcccgggttaccggaccacggttccgaccggtaccacgtcccgaaacgtaccgtgtcggtacctcgacccgtacacgttacctcgtttaccgttattacccg

SEQ ID NO: 229758 - DNA, 618 bp, Homo sapiens
  misc_feature: GYAE6OF02ITXPT.24.37.D04.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagactactatgtcacgaccggtgctcgatttagtagcatactgttgggtttggggggggaaatgctttctgagactcatggacctcctgtgcaaagaacatgaagcacctgtggttcttcctcctgctggtggcggctcccagaagggtcctgtcccatttccagttgcgtgagtcgggccaggactggtgaagcctgcgganaccctgtccctnatttgctctgtctcgtggtcacttccttcaagtaacacagtattattagttcgggctggatccggcacgcccccgaagggaacgacgcctaggtacggtttgggttgcgtagttactcctaatttatcagtcgggacctaaccccttctactacttcccgtccctcgagtacgtcgtagtccaactatttcactggacgccgtaccaacgaaccagtacctcctaggacgtctcggacggtctcggtccgaccccggcggaaccgacggccgttatacttcgtagtcggcggtcgttaggtctagttcggtgttggcgtattcgtactcgactaccgtaccgcgtcgaacttacgttacgttacggtcgggtacggttgggactacggacggtactaccgg

SEQ ID NO: 229759 - DNA, 825 bp, Homo sapiens
  misc_feature: GYAE6OF02HHC5H.24.37.D04.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (532)..(532): a, c, t, g, unknown or other
  misc_feature (532)..(532): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatcgcccaccggagacattgtgttgacactagtcctccagcccacctgttcctttgcctccgaaggggaancgcccaccctntcctgcgagggccagtcgaactagttggtaagaagttcgttacgacgtggtaactcaaacgtaacaaactgtacggaccaacgggcccttacccccgaagggtacccttcccgttaacacttttacccgtaagttcgaaaccgtttccggtaccctaacccgtaaaacgggtcggttaaccacccggtttcccggaaccccggttccccccggtaccggttaacgggttttaccgaagggttccggtaaccgtagggggttaccggtccgtaggggactaaacggtcctttcgaccttcgacgacccgtnacggacctacgtaccgtacgaccgttctaacggtacgttacgtttacggtacggtttaaccttacgtacgttaacggtaacgccgtaaccggttcccggttacgacccggtccgggtaccgtaaccgttttaacccggggttcggggacccgggggtaaccggtagggttacggggaacggtacggtaacgggtaaccgtacgggtacggtaggaccgttccggaaccttaccggtaagttccggttacgtacctcgttacccgttccccggttacccggtcaccgttaccgg

SEQ ID NO: 229760 - DNA, 836 bp, Homo sapiens
  misc_feature: GYAE6OF02IZVCX.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctccagatgccaccggagactattgtgttgacacagtctccagtcccacctgttctttgtctcgaggggaancgccccacccttctcctcgaccgtacgggccaggttagaacctaagttagggttaaggtaagttttcggttacggtacccttgggttaactaccctaaaacaactaaaaccaggtccggacccggtacgggtcccccttccccccgggtcctttaccctactaacttccgttaaacgtggtaccttcggtactaaccttaccgtaaaggtaccgggtcccctaagtcgacctacgtacccgagtacgtgtacgtaggtcgggcgtaggttcggcgtacgggtaaccgtcgtactttacccggtcctaccgttacccgacccgttaagttacccgaacggtacccgtaacgggtttacgggtaaaccggtccgttaacccgggtttaagttaaacgggtttaacgtttttacggttaccggtttaacgtttttaacgtttacccgttagtttaccgaccggttaccgtaccggtaaccgtaaaccgttacccgttaccggttacccttaacggtttcccgtaccggttcccgggaaccgtaacggtaacgtcggtaccgtacccgttacgtaaacccgttcgtcgttacggtcccgtataccgacttcctacgtttccttccgtaccttccg

SEQ ID NO: 229761 - DNA, 706 bp, Homo sapiens
  misc_feature: GYAE6OF02G6QS6.24.37.D04.1.454.CMB.1.raw
  modified_base (154)..(154): a, c, t, g, unknown or other
  misc_feature (154)..(154): n is a, c, g, or t
  modified_base (205)..(205): a, c, t, g, unknown or other
  misc_feature (205)..(205): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaccggaganattgtgttgacactagtctccagccacctgtctttgtctcgaggggaaagngccaccctctcctgcagggccaagtgacaatggttaaggaattggtagctaggtatacaacaacaaacagtggaccaggcccttaccccggctccctactattacctatcgtaagtcgactactaccaaagtaccgggacctaacgtggacctaactcccgaagacgtagggtttaccaggtcgggactaagggttcgggtcgtacgggaactaaggtacctttacgaaccttctacgaacctagtaccgaggaccttaggtacggttaagaccggaccttaggtaaacgttagttttacgacttaagttttaagtacgtacgtccaagtaccgtaacccgtagtaaacgtaaccgttcggaaccccgtttacggtttcccggaaccgtccgggaaacccaaggaccgttaacggacttaaccgtaaccggtaaaccgacgttacgggtgtacccgtacggttacaacccgttagtaccgtttccgtaccgttacgttccc

SEQ ID NO: 229762 - DNA, 568 bp, Homo sapiens
  misc_feature: GYAE6OF02H32GP.24.37.D04.1.454.CMB.1.raw
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacatttgtgttgacacagtctccagccaccctgtctttgtcctccgagggaaacagcccaccctctcctgcagggccagtgacaatggttaggaagttgttagcctggtatacaacacaaacatcggccaggcctccccggctcctcattcctatcgtatgcactccgaagtacggccacgtggcactccaagacacggttcaggtggcgtaggtcggcgtgggacacgtacttcacgtctcgactagtacagcgtagttagtaagtacgacgtagtaacgttatttacgacttaagtttattaactgtaccagctacgtgaacctacgtcgcctacgttccgccgtggaccagtacgacgactcgaaccgaacacgtcgacgcgtacgacgacctacgttctcgttccttagtccg

SEQ ID NO: 229763 - DNA, 669 bp, Homo sapiens
  misc_feature: GYAE6OF02HWXQR.24.37.D04.1.454.CMB.1.raw
  modified_base (253)..(253): a, c, t, g, unknown or other
  misc_feature (253)..(253): n is a, c, g, or t
tcagactactatgtcacgaccggtgctcgatttagtagcatactgttgggtttggggggggaaatgctttctgagactcatggacctcctgtgcaagaacatgaagcacctgtggttccttcctcctgctggtggcggctcccagaagggtcctgtcccatttccagttgcgtgagtcgggcccaggactggtgaagcctgcggagaccctgtccctcatttgctctgtctctggtgacttccttcagtaacncagattattattgggcctggatccggcagcccccagggaagagcctggagttggttgcgagtactccattatcatgggccgtaacccctttctacacttccgtccctacgcgacgtcgagtccacctatttccactggacgccgtacccaaagaacccacgttacctccccgtagacggtcctacggccggttctcggtccgaccccccggcggacccgaccggccgttaacgttacttacgtggtcggcgggtaccgttaggttcctagtttggttggttcggtcggtaagttcggttcgtcggtcctacgttacccggccggtaccgacgttaacgtttaacggtttaaccgggttcggggttacgggtttttccggggccgtaaccggtacgggggaccccgttaacccgggg

SEQ ID NO: 229764 - DNA, 682 bp, Homo sapiens
  misc_feature: GYAE6OF02HD9W4.24.37.D04.1.454.CMB.1.raw
  modified_base (217)..(217): a, c, t, g, unknown or other
  misc_feature (217)..(217): n is a, c, g, or t
  modified_base (366)..(366): a, c, t, g, unknown or other
  misc_feature (366)..(366): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggacgaccctgtccctnatttgctctgtctcgtggtcgacttccttcagtaacacagtattattattgggcctggacgtccggcaccgcccccgagggaacgagccgtggtacgtttgggtgcgtagtagtaccaattactctagtcgggaccgtaaccccctttntacctacttcccgtcccgtacgacgtacgtcgacgtaccacctacttcgacgtggacgtccgtacaacgaacctacgtacctcccgtgacggtcgtcggtacggtctcggtacccggacccccggacggaccgtaccggtaccgttagttaacttacgtcggtcggccgggtcgtttacggtcgttacgtttggttcggtttcgggacgtagttcgttcgtacgtaccgtaccgtaccggccgtacgtactaacgtttacggttaccggttcggggtcgggttacggggcctacgggtacgggtaccgtacccggg

SEQ ID NO: 229765 - DNA, 713 bp, Homo sapiens
  misc_feature: GYAE6OF02HFA79.24.37.D04.1.454.CMB.1.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtnactccttnagtacanagtattattattgggcctggatccggcacgcccccgagggaagagccgtggagttggtgcggagtatccgatttatcgtacgtcgggcccgtaaacccccttctactacttccgtccctcgagtacgtcgacgttcaccctagttttaccacgttggacgacccgtaccaaacgaaccctacggtaaccctccccgtaggcggtacgtcgggaccggttctcggttccggaccccccgggcgggtacccgacgggacccgttaattaccgttaccgttcggtcggtccgggtcgtttacggttacgtacgtttcggttggtttcgggacgtgttacgttcgttcgacccgttacgttcccggccggtccgtaaccgtttaagtttacgtttaacccggggtttcgggggttccggtttttggggggccctaaacccgggtacggggaacccggttaccccggg

SEQ ID NO: 229766 - DNA, 633 bp, Homo sapiens
  misc_feature: GYAE6OF02HIJNQ.24.37.D04.1.454.CMB.1.raw
  modified_base (201)..(201): a, c, t, g, unknown or other
  misc_feature (201)..(201): n is a, c, g, or t
tcagactactatgtcacgaccggtgctcgatttagtagcatactgttgggtttggggggaggaactgctcagttaggacccagagggaaccatggaagccccagctcagcttctcttcctcctgctactctggctcccagatgccaccggagacattgtgttgacacagtctccagccaccctgtctttgctcaggggaanagccacctctcctgcacgggccagtcgacaatggttaggacgttgtagcctaggtatcaaacacaaacacgtggccaaggcctccccggctcctcatctatgactgcactaccgaagtacgggccacgtcggactacgtcccaagtacgtaggttccaggtcggctagggttcgggtacgtcggacgaggtaccttcacgttcctaccaacctctacgacgctaggtggtaacgacggtccgtaggtaacgttgtttacgcgtttaagttttacttacgtgttacagtaccgtacgtacgaacctacgtaccgtacccgttaccgtttaccggcccgttacgggaacctcggtaaccgtggactacgtaccgtaacgtacgtcggtacgtcgtacgaccgaccttagtccgtttacggttaccttctacccg

SEQ ID NO: 229767 - DNA, 652 bp, Homo sapiens
  misc_feature: GYAE6OF02JIDVV.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgtctttgctccgaaggggaancgccacctctcctgcaggccagtgacaagtgtagagttgtagctgtatcaacacaacatgccaggcctcccggctcctcatctatgatgacactcgaagtacgggccacgttacggacctacgtcccgaaggaccgtaaggttccaggtcggacgtacggtcgggttacgtacggggactacggtacgttcgacttccgacacctaatccgacgcgaggtacgtaacgcgtacctagtaacgttctttacgacgtttaagtttattacgttaggtaccagtaccgtacgtaacgtacctaacggtcccggtaacccgtttccggttaccggccgttacgggaccctaacggtacgtaccggtacgaaccgtacccgtaaacggtacgtcgggtacgaccgtttacgaccgtaccgtactttaccggttccgttacctttaccttacccg

SEQ ID NO: 229768 - DNA, 955 bp, Homo sapiens
  misc_feature: GYAE6OF02G2S3W.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggactgctcagttaggacccagagggaaccatggaagccccagctcagcttctcttcctcctgctactctggctcccagatgccaccggagacattgtgttgacacagtctccagccaccctgtctttgtctccgaggggaaanacgcccaccctctccctgcagggccagtgacagtgtaggagttgtagcctggtactcaacacaaacagtcggaccaggccctccccggctccctcacttcctatagtacgtacgacctaacgttacccgaaagttaccgggggaccctaacgggttcggacctaaccgttacccccgaaggtaaccgtacggggttttccgaaacgggtttacggggacctaagggggttacgggggtttccgttaacgggggaacctaaaccgggtttaacctttcccgtaaccgtttaccgtacccggtaaccccggtttacccgaaaggttccccggaaaccggtacccgttaaagggtacccggtaacccggtttaacgggttaaaacgtttaccgggttttttaccgggtaacccggttttttaaaccctaggtttaccgtacccgttaagggtaccttaaccggggttccccgttaccccgggttccccgttcggggttaacccccgttacccggttttaaacccggggggtttccgggggggaacccggggggggttaaccggtaccgggggggttaacgggaaaccgggggtaagggtaaccggggaacccgggttacgggttaacggggggttcccgggtaaccgtttcccggggaaacccgttaaccccgttaagggtttaccccgtttcgggtttaacccccgttcgtttaaaccccgggtttttcccccgtacccccggtttaaccccgg

SEQ ID NO: 229769 - DNA, 754 bp, Homo sapiens
  misc_feature: GYAE6OF02HH3K1.24.37.D04.1.454.CMB.1.raw
tcagactactatgtcacgaccggtgctcgatttagtagcatactgttgggtttggggggggaaatgctttctgagactcatggacctcctgtgcaagaacatgaagcacctgtggttcttcctcctgctggtggcggctcccaggagggtcctgtcccatttccagttgcgtgagtcgggcccaggactgggtgaagccgtggacggacgacccctgtccctctatttgccttctgttccttcgttgggtctaccttccttacgaacgtaaccactaggtatttattacggttcgggccgttaggacgtccggaccaccggacccccgaaggggtaaacgacggtccgtgggtacggtttgggtcggacggtaagtactacctattactcgtacgtaccgggtaccctaaccccctttcgtaaccttaccgttccccgtccgtacgacggtacggtcgtacgtcctaaccttactttcgacgtcggaccgtcccgtaacaaccgaaccgtacgtacctccgtaggacggtcgtacggtcgtcgtcggtacccggaccccggcggaccggtaccggtaccgttacgtttacgttacgtcgggtcgggtcgggttacgttacggttacgttcgtttacggtcggttacgtcggtcttacggtctcgaccgtaccgttcccgcgtaccgtaacttagtttacggttcggttacgggttcggttacgggaccgtaaccgggtacgggtaccctccggg

SEQ ID NO: 229770 - DNA, 665 bp, Homo sapiens
  misc_feature: GYAE6OF02JB4PK.24.37.D04.1.454.CMB.1.raw
  modified_base (213)..(213): a, c, t, g, unknown or other
  misc_feature (213)..(213): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (658)..(658): a, c, t, g, unknown or other
  misc_feature (658)..(658): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtcctccacgccctaccctgttcttttgtcctaccgaaggggaaanacgccccacccttctccgtgccacggggcctagtcgaactaagtaggttaagggaagtttgtacgtccgtaggttataccaaacaacaaactagtcgggaccgacggtccccgtacccccggcttcctcacttcctagtcgtatcgaactactaccgaagtcgggcctacgcggacaccacccgtagaccgtaggttccgaaggtcgcgtagggtcgggtcgtacgggactacgtacttcgacctcnccgacngtacgcacgtgtagtcgacgtcgtagtagttcttagatttagtttattacgtcgtagacgtaccgtacgtacgacgtaccgtccgtaccgttaccggttccgaccgttccgggaacctacggtaccggtccgacgtacgtaaccgacgttaaccgtcggtacgcgtacgccaccgtacttcgtcttaccgtnttacccg

SEQ ID NO: 229771 - DNA, 758 bp, Homo sapiens
  misc_feature: GYAE6OF02G6LLS.24.37.D04.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
tcagactactatgtcacgaccggtgctcgatttagtagcatactgttgggtttgggggaggaactgctcagttaggacccagagggaaccatggaagccccagcgtcagcttctcttcctcctgctactctggctaccagatgccacggagacattgtgtgacanagtctcagccacctgtcttgtctccgagggaaanacgccaccgtctcctgctacggcagtgacatgtagattgtanctgtatcaacgactaacngtggccagggcctccccggacttcgtacattctaatgatggctaactacccgaaagtacgggacctagttagggacctactaccccgtaaggtacctaaggttcccgaaggtcggacgtaggttcggggtcgttagggggaaactacggtaccttaacgtaacgtttccgaaccgacccttaagttaccgacggaacgtacgggtttacgtaacggccggttaccgaggtaaacgtttcggttttaacgaccggtttaaagtttttaacggtacccgttaagttaccgaacccgttccggttaaacccgtagtaaacccggtaaccgttccgtaaccctttaccggtttccggaaccccgtttaggaacccggtagtacccgggtttacgaccttacgtaaaccccgggtaacggtaaacgtttccgggtacgtacccttaacggttacccctaacttaaccggtttccgggttaccttttaccgtccccgtttaacgg

SEQ ID NO: 229772 - DNA, 639 bp, Homo sapiens
  misc_feature: GYAE6OF02GR8KH.24.37.D04.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (440)..(440): a, c, t, g, unknown or other
  misc_feature (440)..(440): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccacctgtcttgctcgagggaancgccacctctcctgcagggccagtgacatgtaggagttgtagctggtatcaacacaaacntcggccaggcctccccggctcctcacttctaatgactcgactataccgaagtacggcctagtcggcacgtcccagacctaggttccaggtcggctagggtcggtcgtgggaacctaggtaccttcaacttccgtacaacctatcgacgccgtaggttacgacgacgtccgttagaaacgttntttacgacttaaggttttactcgttcgtacacggtacctaccggtcgtaacctacgtcccggtacccctttcgttacccgggtacccgttacgggaaaccctacgtacgtacggacctacgtacccgaaaccggtacgtccgggtacgtaccgtgtaccccttactaaggtttcccttacggttacctttacccgtccg

SEQ ID NO: 229773 - DNA, 808 bp, Homo sapiens
  misc_feature: GYAE6OF02GACKJ.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtgttcttcctctgctggtggcggctccagaggtcctcgtcctatttccgagttgcgtgagtccgggcccaggacgtggtgaacgccgtggcggagaccctgtccctctagtttcgcctcgttgtccttcgtggtctaccctttcgtacgaagtaaacacgtagttaatttagtttagttcgggtccgttaggtacgtaccggacctaccggacccccggaaggggtaacgtacggtacccggttaggggttacggttttcggggttacggacggttaacgttacgtacccgttaagtttaccgtacgtacggttaccgggaaccccttaacccccgtttctaaccgttaccgttccccggttaccccgtacggacggtacgtacgtacgttaccctaaccgttctttaccgacggtacgggaccgtaccgtaaccgtaacgtaacgtaccgtaccgtcccgtaggacggtccgttcggccgttacgtcggacccggaccccggagacccgtacggtaccttacgttacgtcgtgggtcggtaccgggttacgttagtacctagtttcggtcggttaggacgtgttaccgttcgtaccgtaccgaccgtcccggactcgttaaccgttaaggttccggttaggggttccgggttagggttaccgggtaaccgtaccggcccgggtaccgttaccccgg

SEQ ID NO: 229774 - DNA, 733 bp, Homo sapiens
  misc_feature: GYAE6OF02JN8YL.24.37.D04.1.454.CMB.1.raw
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
tcagactactatgtcacgaccggtgctcgatttagtagcatactgttgggtttgggggaggaactgctcagttaggaccagagggaaccatggaagccccagctcagcttctcgttcctcctgctactctggctccagatgccaccgganacattgtgttgacacagtctccagccacctgtcttgtctcaggggaanagccacctctctgcacgggcagtagacctaagtcgttaggagttgtagccttaggtactacaacaacaacngttcggccaggccttccccgattccnatcttaagtgactcgactacgtaccgtaagtacggccctaagtcggacctactcccgaagtacccgtagggtttaccaaggttcggacgttacggggtcggggtcccgttagggaaaccttagttaccccgtttaccacgtttcccgtaaccaacccggttattacccgaacgtcgtaacggtacgtaacggacgtaccgttaagaacgttactttacggacgtttacgttttaacgttaccttacgtacgtacggtaccgtaccgtagaaccgtacccggttacgtaccccgttaacggttccccggtaccggttaccgggtaaccgtaccgtacggtacggtacccgtaacggtacccggtaaacggtatttacgggcggttaccctacggacccttaccgtaccgttacgtttccggttccttaccggttacccg

SEQ ID NO: 229775 - DNA, 896 bp, Homo sapiens
  misc_feature: GYAE6OF02IM3RA.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttggggtttgggggaggaactgctcagttaggacccagagggaaccatggaagccccagcgcagcttctcttcctcctgctactctggctcccagataccactggagaagtagtcatgacgcagtctcagccacctgtctgtgtctccgaggggaaancgccacctctcctgcagggccagtgagaatgttgcagactaacttagccgtagtaccagcaagaacctggaccaggcctaccgaggtcctccgtcctagtctcgtctcgtcctcccgaaccgtccggggtacccctgggttccgtcccgtaaggtccccgtaggggttttccggtcggggtcggttacgggggtccgttaggggtaaccgtaggttaacttttccgaaccgtttccgtacccgtaacccgtacgttcccgaacggggtccccggttaccccgttaccgtacgggtttaccgtacgggttaaaacgtttacggttttacggttaccgtttaaaccgtttttaccgtttttaccggttttaacgtttaacccgttaaaaccgttaaccgtttaacgggtttacggggtttaacccgggttaacccggtttacccgggttaccccggtttaaccccgttaacccggttttaacccgggttttttacccgggggtaaccccgggttaaaccgggggtaaaccccttaaaacggggttaccggggtaaaccgttaaccggttaaaccgtaaaaccgggttaacgttacggggttccggttaacgtacccgtacccggtaacctttaacggtttccgttaccgtttaccgtttacccttaacccgtttccccggttacccgttaacccg

SEQ ID NO: 229776 - DNA, 722 bp, Homo sapiens
  misc_feature: GYAE6OF02IJ8V5.24.37.D04.1.454.CMB.1.raw
  modified_base (143)..(143): a, c, t, g, unknown or other
  misc_feature (143)..(143): n is a, c, g, or t
  modified_base (259)..(259): a, c, t, g, unknown or other
  misc_feature (259)..(259): n is a, c, g, or t
  modified_base (325)..(325): a, c, t, g, unknown or other
  misc_feature (325)..(325): n is a, c, g, or t
  modified_base (689)..(689): a, c, t, g, unknown or other
  misc_feature (689)..(689): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccctagatnccaccggagaccattgtgttgacactagtctccagccacctgtctttgtctccgtaggggaaagtacgccctaccctctcccgtaggcagggccagtcgactaatgttagaagttnttacgcctgtataccaacacaaactatcggccaggctccccggctaccgtcatctagtgactacgntacacctaagtacgggaccctaacgtcgtacaacgttcccgagtaaccgtacggttaccgaaggttcggacgtaggttcggggctggggtaactacggtacttccgaccgttctaaccgtactagttaccaggtactacggttgtaacggtcgtacccgtagaacggttacttttagacgttacggttttaaacttcgtactaccgtatacccgtaccgttcgaaactttaccggtaccggtacccgtttaaccggttcgggaccccgttagggaacccctagggtaccttacgggacctaacgtttccccgaaacggttacccgacgggtttcggacccgttaacggtacccggttaaacccnccggttttaccttccgttaccgttaccgtaccc

SEQ ID NO: 229777 - DNA, 814 bp, Homo sapiens
  misc_feature: GYAE6OF02JTMJB.24.37.D04.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagactactatgtcacgaccggtgctcgatttagtagcatactgttgggtttgggggggaaatgctttctgagactcatggacctcctgtgcaagaacatgaagcactgtggttcttcctcctgcgtggtggcggctcccgaggaacggtctcgtcctatttcagttgcgtgacggtcgggaccgaggacgtggtagaacnccgtggaccgggaccgaccccgttcgtcccctacgttnttttcgccgtccttgtccgtcgtagggttctaccttcccttagaacgtaacaacgtagtatttagttacggtcggtacgtagggtacgtccggaccaccggcccccggaagggtaaggccgtcggtaggtaggttcggttagaccggtaacttactacctaattcgttacacggttccgggtaccccttaaccccgttccacccgttacgtttccccgtacggttaccggaggtaacggtcctaacggtccctaaaccttacgtttaccactttacggggtacccggtacccgttaaccgaaaccggtaacccgtaccgttaccgtcccggttaaggcggttccggtaaccggtccggttcggtaaccgggtcccggtaaccccgcgggtaaccgttccggtaacgttacgttacgttcgtacggtaccggtacgggttacttacggtttaccgaggtttcggttcgttaggtacgtacgttcgtacggttaccgctaaccggtcccggcgtagttaccgtaattccggtacgggttgggttcccggtagtccggaacgggtccgtacggtccg

SEQ ID NO: 229778 - DNA, 739 bp, Homo sapiens
  misc_feature: GYAE6OF02FGESL.24.37.D04.1.454.CMB.1.raw
  modified_base (158)..(158): a, c, t, g, unknown or other
  misc_feature (158)..(158): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
tcagactactatgtcacgaccggtgctcgatttagtagcatactgttgggtttgggggagaactgctcagttaggacccagagggaaccatggaagccccagctcagcttctcttcctcctgctactctggctcccagatcgccaccggagacattgngttgacacagtctcagccaccctgtctttgtctccagggaanagccacctcnctgcacgggccagtgacaagtgtagagttgttagcctggtactcgaacacaaacngtcggccaaggcctccccgggatccctacacttcctaagtggaattgcctatacccgaagtacgggcctaactcgggtctaacgtccccgaagaccgtagggtttaccaaggttcgggaccgtaacgggttcgggggttacctaacggggggaacctacgggtaaacctttaccgacccttttacgaccctaaaccctacgtactaccggacgtaacggttacgtaacggtaacggtaccgtacggtaagttacgttttagaccgtttaaggttttacttaacgttgtaacctacgtacgtaaaccggtagtaacctaaccggttaccgtacccgttaacgtttcccgggacccgttcgggtaaaccgtcgtaaccggtacgtaccgaacgttacccgaaaaccgtaacgttacgggttacgtacgtacgtaccgtacccgtaacgttccgtcgtttaccgttacgttaacccg

SEQ ID NO: 229779 - DNA, 645 bp, Homo sapiens
  misc_feature: GYAE6OF02HVJYZ.24.37.D04.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (418)..(418): a, c, t, g, unknown or other
  misc_feature (418)..(418): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagcccacctgtctttgctcgaggggaangcccaccctctcctgcgagggccagtgaactaagtgttaaggatttgtagcctggtactcaacaacaacagtggccacggcctccccggctcctntatctaatcgtatgtaccactaccgtaagtaccggcctaacgtggaccacgtcccaagtaccnggttacaaggtcggtcgtaggtcgggtgacggtacagtacctcgtactcctacaacctntacagtctaacgttgaacgtacgacgtaggtaaacgttcgttttaggactttaagtttaacttacgttcgtacgagtacccgacgttacggaacctacgtccgccttaacggtttcccggtcccgtagggtaccgagtacctacgactaacgcctaaaccgggtacgtcgggttaaccgcgtaccgtactaacgtaccctttcgttacgtttccgacctttaacccg

SEQ ID NO: 229780 - DNA, 749 bp, Homo sapiens
  misc_feature: GYAE6OF02JEICT.24.37.D04.1.454.CMB.1.raw
  modified_base (211)..(211): a, c, t, g, unknown or other
  misc_feature (211)..(211): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
tcagactactatgtcacgaccggtgctcgatttagtagcatactggtttggggtttgggggaggaactgctcagttaggacccagacggaaccatggaagccccaggccgcagcttctcttccgtcctgctactctggctccagactgccaccgggagacattgtgttgacacagtcctccagccacctgtctttgtctccgaggggaacngccaccctctcctgcacgggccagtcgactaatgtttaggatttgtagccgtaggtacacaaacnctaaacnctcggcctaggcctccccggatcctacactctatcgaatcgcataccgaagtcgggccagtggacagtccgaggtactaggttcaggtcgctaggttcgggtcgtacgggactaggtacctttccgacgttacctaccggtaacctacgtttacacggttaccgtacggtaggttaacggtaacgttaccgttaacggtaaacggttacggtttttacgacgtttaacggtttttaactttaccgttaggttaaccgacgttaacccggtaccggttacgtaaacccgtaaccgtttaccgggacccctttaaccggtttcccgggacccggttaccgggaaaccccgtaacggttacccgtacggtacccttaacggtacccgtaaaccggttaaccgttcggtacggttacgtacggtaacccaccgttaccgttaccgttcggtttaccttaccgtaacccgg

SEQ ID NO: 229781 - DNA, 942 bp, Homo sapiens
  misc_feature: GYAE6OF02IXUMC.24.37.D04.1.454.CMB.1.raw
  modified_base (228)..(228): a, c, t, g, unknown or other
  misc_feature (228)..(228): n is a, c, g, or t
  modified_base (794)..(794): a, c, t, g, unknown or other
  misc_feature (794)..(794): n is a, c, g, or t
tcagactactatgtcacgaccggtgctcgatttagtagcatactgttgggtttgggggggaaatgctttctgagactcatggaccctcctgtgcaagaacatgaagcacctgtgttcttcctcctgctggtggcgctcccagaggtcctgtcctatttcagttgcgtgaggtccgggacccaggtactggtgaacgtccgtggccgacgtaccccgttcgtacccctnttacgttttcgccttcgttcgttccttcggttaggtaccgtaccctttcccgttaccgtaacttaaacctaccgtaagtttaaattttaagtttaccggttcgggtacccgttgggacccgtacccgggcccgtaaaccccggcccccgggtaaaggggaaacggtccgtaccgggttagggtttaacgggtttcgggtccggtacggtaacgttacccgttacgtaacttaaggtacccgttaggggtacccccgggtaacccccgtttaccccccttttaagtacccgtttacccccgttcccggtacccggttacgaaccgggttcggtttaaaccgtaaccgttacccgtacgtttaacccgtttcggtaaccggtaccggggtaccctaccggtttaaacccgaaaacccggttaaccgtacccggttaaccccgtccggtaccgggacgtacccggtttgggacccggttaccggttaccccgtacccccggggaccccgtaccggtacccgtaacggttacttaccgttagttccgtcgggtcggtacgttcgtacgtnttacggttggttacgcgggttacttgtaccgtcgtaccgtaccgtaccggccggtaacctacggttaaacgtttccggtttaacggggttaccggggttggttaccggggttcgaacccggttaagggtacccggtaccgtccccggg

SEQ ID NO: 229782 - DNA, 978 bp, Homo sapiens
  misc_feature: GYAE6OF02I1EEW.24.37.D04.1.454.CMB.1.raw
  modified_base (203)..(203): a, c, t, g, unknown or other
  misc_feature (203)..(203): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccaccggagacattgtgttgacacagtctccagccaccctgttctttgtctcgaggggaanacgccaccctctcctgcgacggccagtcgaacagtggttaaggaagttggttacgccgttggtaactaccaaactaacaaaactactacggaccaacggcccttccccccgggtaccttcccggttaccactttaccgttaacttggtaactttcggacctaacgttaacccgtaaacgggttaaccggggacccccgttaaacggttccggggtaacccttaaacccgttaccccccgggaaaagggtaaaccccggttaacggggtttttacccggaaccggggtttacggggtacccgggtaacggggttttaccggggggttaccgggttttaacggggggaaccttaaccggggttaaccgttttaacccctaaccccggttttacccgtaccccgttaaaaccccttaggtttacccgtaaaccggtacgtaaacgggtttaccggttaaaccgggtaacggttacccggtttaaagggttaaacgttttaacgtttttacgggtaacgtttttaaaccggtttttaattttaccccgtttaggtttaccgaaaccgttacccggttaaccggttaaccggtaacccgttaaacccggtttccccggtaaccccgtttaccgggtttaccccggttacccgttaccggggaaaccctaccgtaacccggtcggtaaccctaccggtaacccgttaaccggtacggttaccgggtgtacccgtagtaccccttcgtacccgttaccgtacgtttaccctacgttaccccg

SEQ ID NO: 229783 - DNA, 739 bp, Homo sapiens
  misc_feature: GYAE6OF02FNHQR.24.37.D04.1.454.CMB.1.raw
  modified_base (150)..(150): a, c, t, g, unknown or other
  misc_feature (150)..(150): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctcccagatgccacgganacattgtgttgacacagtctccagcccacccttgttcttttcgtccgtaccgaggggaaagacgcccaccctctcctgaccgagggcctagtnaacagttgttaaggtagttgtagccgtagtatacaacaacaaacngtcggccacgcctccccggctcctcgtactctagtagactcgactactaccctaaaggtaccgggaccctacggttcggacctaaccgtaccccaacggtactaacgggttcgaaggttcggacggttgggttaccggtcggtacgggacgtaacgttccttacaccgttcctaaccgtacgtacgtcgatacggtagtcgtaacgacgtaccgttaaggtacgttagtttcgaacttttagtttacgtaccgtttaggaccgtagtaccctaacggtacgtaccgtaaccggtcccggtacccgtttaaccggtttccccgacccggttacgggccctaaacggtacccgtacggtaacctacggtaaccggtaaaccgtacggttaccgggtaccgaccgttccgaccgtaaccgtcgttaccggtttcctttaccgttacgtccccgg

SEQ ID NO: 229784 - DNA, 794 bp, Homo sapiens
  misc_feature: GYAE6OF02FN3CA.24.37.D04.1.454.CMB.1.raw
  modified_base (272)..(272): a, c, t, g, unknown or other
  misc_feature (272)..(272): n is a, c, g, or t
  modified_base (410)..(410): a, c, t, g, unknown or other
  misc_feature (410)..(410): n is a, c, g, or t
tcagactactatgtcacgaccggtgctcgatttagtagcatactgttgggtttgggggggaaatgctttctgagactcatggacctcctgtgcaagaacatgaagcacctgtgttcttcctctgctggtggcgctccagaggtcctgtcctattccagttgcgtgagtccgggccaggactggtagacgcctggccggacaccctgtccctctatttcgcttcttgtctcgtggtctaccttccttacaagtaaccacgtagtatttagttnttcgggcctaggtactccggaccaaccggacccccgaagggaacgtacggtccgttagggtacggtttgggttcggacgtacggttatcccgtaatttacgttacgaacggttccgggtacccgttaaccccccgttntaaccgtttaccgttccccggttaccccgttacggtaacggttaacgttccggtaaccgttacccggtaacccttacttttaccgaccgttaaggggaccgtaccccgtaccgaaaaccgtaacccaacggtttaccctacccggttaggaccggcgttacggccggttcgtaccggtcccggacccccggacggacccgaccggtcttaacttacgttacgtcggtcgtccggtacgttacggttactagtttggtgggttcgtcgtactgttaccgtctaccgtaccgtaccggtcgaccggttaacttaacggtttacgttacgggttacggggtttcggtttaccgggaccgtaacgggtaccgggtacccgttacccgg

SEQ ID NO: 229785 - DNA, 937 bp, Homo sapiens
  misc_feature: GYAE6OF02GUF46.24.37.D04.1.454.CMB.1.raw
  modified_base (232)..(232): a, c, t, g, unknown or other
  misc_feature (232)..(232): n is a, c, g, or t
tcagactactatgtcacgaccggtgctcgatttagtagcatactgttgggtttggggggaaatgctttctgagactcatggacctcctgtgacaagaacatgaagcacctgtcggtttcttcctcctgctggtggccgctcccaagacgggtcctcgtcccattttccagttcgcgtgacggtccgggcccaggactggtgaacgcctggcggacgtccccttcggtccctntatttgccttcgttgtcttgtcgtcgtacctccttacaagtaacactagttatttacgtttaggtcggtaccgtggtaccgtccgaccgaccgaccccggtaggaacggcgtcgtaggtcggtttaggtcgcgtaagtactactatactagcgtcggtaccctaaccccttctaaccgtacgttccccgtaccacgtaacggcgtacgtacgtacctaccttacttacgtacgaaccggtaccgtacccgtaaaccgaaaccgtaacccgttacgtaaccccgttacccggacggtacgtcccggtaaccgttccgggtttcgttacccgggtacccccgaaacccccgggacccgggtaacccgttaacccggggtttacccgtttaaaggttttaaacccgtttaccccggtttaggggtacccggggtttaccgggtaaccccgggttttttaaacggttcgggttttaaccggtttttcggggttaaccgggttccggggttaaacccttacgggtttaccgttttacccggaccggtaccccggtaaaccccgttcccggggtaaccggtaccggttaaccccttttaaaacgggtttttcccgggttaagggtttcccggggggttttaaccgggggtttacccggggaaacccggtaacccgggttaaccccgggggtaaccccttaaacccccgggg

SEQ ID NO: 229786 - DNA, 663 bp, Homo sapiens
  misc_feature: GYAE6OF02GDRR6.24.37.D04.1.454.CMB.1.raw
  modified_base (152)..(152): a, c, t, g, unknown or other
  misc_feature (152)..(152): n is a, c, g, or t
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (461)..(461): a, c, t, g, unknown or other
  misc_feature (461)..(461): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctcccagatgccaacgganactattgtgttgacanagtctccagccacctgtctttgcctaccgaaggggaaacncgccaccctctcctgcgagggccagtcgaacaagttggttaaggaatttcggttaagcccgttaggtaactacaaaccaacgaaaaccnggtcggaccaacgggtcctacccccggtntcctaccatactatcgactgaccataccgaagtcggacctaacgtgactacctccaaggtactacgggttacacggtggacctaggtacgggtctagggaactacgtacttccgaaccttcgtaccaaaccggtntaccgacgtacgtacgttacgaacgtacggtacgttaagtaagttacgtttacgtactttaagtttaactcgtacgactacgtaccgtaacgtactaacgtaccggtcctaccttaccgttccgaccgtacgaccgacgtacgacgtactacgaacgtaactacgtcgtacgcgtacgactacgacttcggttctactcgtc

SEQ ID NO: 229787 - DNA, 739 bp, Homo sapiens
  misc_feature: GYAE6OF02H4XM3.24.37.D04.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
  modified_base (458)..(458): a, c, t, g, unknown or other
  misc_feature (458)..(458): n is a, c, g, or t
tcagactactatgtcacgaccggtgctcgatttagtagcatactgttgggtttgggggaggaactgctcagttaggacccagacgggaaccatggaagccccagctcagcttctcttcctcctgctactctggctccagatcgccaccggagacattgtgttgacacagtctccagccacctgtctttgcctcgaggggaaanacgcccaccctctacctgccgacgggccaggtcaacaatggttaaggaagttgtagcctaggtactacaacacaaacagtcggaccctaggcccgtccccggcttcctctacgttactaataggtactcgactaagttacccgaaggttacggcctacgtggtccaactcccgaagtaacgtagggtaccngggtacggcgtagggtcgggtcgttacgggactacgtaactttccgacttccgaacaccgtaanccgtagacgtaggtagtaacgacgtaccgttaggtaacgttacgttttacggacgtttaacgttttacgtttaccgttacggtacgtacggtaccgtaaccggttacgaaaccgtaaccgtaccgggtaccccgtttaccggttaaccccgggtcccgttaaccgggtaccgtaacgtaaccggtacgtacccgtaaccgtaccggtaaaccggtaccgttacggtacggtccgtacgtacccgtacgttacgtccgtttacggttaccttacttaacccg

SEQ ID NO: 229788 - DNA, 848 bp, Homo sapiens
  misc_feature: GYAE6OF02G35KE.24.37.D04.1.454.CMB.1.raw
  modified_base (507)..(507): a, c, t, g, unknown or other
  misc_feature (507)..(507): n is a, c, g, or t
  modified_base (762)..(762): a, c, t, g, unknown or other
  misc_feature (762)..(762): n is a, c, g, or t
tcagactactatgtcacgaccggtgctcgatttagtagcatactgttggggtttggggggggaaatgctttctgagactcatcggacctcctgtgcaaagaacatgaacgcacctgtggttccttcctcctgcgtggtcggcggctcccgaggtaacgggtcctcgtcccctatttccgtagttgcggtggaggtccgggcccgagggacgtgggtacgaacgtccctggaccggaccgtaccccttcggttcccctactacgtttcgtccgttcgttcggttccttccggttgggtacgtaccctttcccttacgtaaacgttaaacccagttaacggttaattttaagtttaacggttccggggtcccgtaggggttacggtcccccggtaaccaccccgggaacccccggaaggggaacgacgggttcccgtagggttaggttcgggttacggcgtacgttactactattaactcgtacggtccgggtacccctaaccccgttntaacctccgttcccgtccgacgtagtaccgtccgtacgtccgtacttacgtttccacggtacggtcccgacccgtaacgaaaccgtaacccgtcgtaaccgttccccggtaaggtaccggtcgttccgggtccggttcgtcccgggtaacccgggtacccccggtcgggaaccggtcccggtacggttaactaccgtttcggacggtcgggtcgttacgttcgtagtgttggtgttacggctaggtcgccgtaancccgtaccggtcgcggtaccgttaattaacggtttaggtttccgggtggttacccggggtaggccaacggtacgggcctacccggg

SEQ ID NO: 229789 - DNA, 985 bp, Homo sapiens
  misc_feature: GYAE6OF02GUNLE.24.37.D04.1.454.CMB.1.raw
  modified_base (141)..(141): a, c, t, g, unknown or other
  misc_feature (141)..(141): n is a, c, g, or t
tcagactactatgtcacgaccggtgctcgatttagtagcatactgttgggtttgggggaggaactgctcagttaggacccagagggaaccagtggaagccccagctcagcttctcttcctcctgctactctggctccgagntcgccgaccggagactagttgtgttgacacgtacgtctcccacgcccacccttgttcgttttcgtccgtaccggaaggggtaaacgacgcccctaaccccgtcgttcccgtggaccggtaccggggtaccctaaggttaccgaaaccgttaaagttcggggtttaaagggttaaacgggtttttcgggtttaaaccggacccggttttagggtttaaccgtaaaccgtaaaaaccctaaaccgtaaaaaaccggtcggtttaaccggggaaccccggtaacccgggttccccccggttacccccgggtacccctttttaccccggtaactacgggtttaaccccttaggttaaccggtacggttccgtaacccgttaaacccgttaacccggtaaaacgggtaccggggtacccctaacgggtttacggacccgtaacccggtaccccgaaaggttaaccggttacgggttaccgaacgggttccggaacggttgggttaccggggttacgacgggtaacgtacttacccgttaccacggttaccctaacgtacctaagtacccgagttaaccgtcggtttacgaggttaacccgcggtttaaacgacgtttcgtttacgtacggtttaagttttaacgtaccgttcggtacgtaccgtaccggttaaaccgcgtaaaccgtaccgggttccccgtaacggtacccgttccggacccgttaccggtacctaacggtaccgtacccgtacgtaacccgtaccggtaaccggttgttccgggtaaccggtctaccggtaaccgttaccgtacgtttcccggtttaacgttacctacccggttcccg

SEQ ID NO: 229790 - DNA, 686 bp, Homo sapiens
  misc_feature: GYAE6OF02HL8LR.24.37.D04.1.454.CMB.1.raw
  modified_base (97)..(97): a, c, t, g, unknown or other
  misc_feature (97)..(97): n is a, c, g, or t
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (402)..(402): a, c, t, g, unknown or other
  misc_feature (402)..(402): n is a, c, g, or t
  modified_base (658)..(658): a, c, t, g, unknown or other
  misc_feature (658)..(658): n is a, c, g, or t
  modified_base (678)..(678): a, c, t, g, unknown or other
  misc_feature (678)..(678): n is a, c, g, or t
tcagactactatgtcacgaccggtgctcgatttagtagcatactgttgggtttgggggaggaactgctcagttaggacccagagggaaccatggaanccccagctcagcttctcttcctcctgctactctggctcccagatcgccaccggagacattgtgttgacacggtctccagcccaccctgtctttgtctccgaaggggaaacncgacccaccctctcctggcgacgggccagtnactaagtgttaaggagttgtacncgtgtactacaacaacaaacngtcggaccaggcctcccccggctccctnactctatgactcgacctactaccgtaaggacgggtaccacgtggacctactacccaaggtacacggttcgaggtgcgtagggtggttccgngggaacacgtacttacaccgttcaccgaacctagtccaacgcgtacggttcgtaacgtacgtaccgttaagtaaacgtttacgtttacggtacgtttaacggttttactttaacgttgttacctaacgtacctaccggtacgaaccgtaccggtaccgtaccccgtttacgtccggtcccgtacgggaacctacggacgtacggtaccaccgtaacccgtaacgtaaccgtaggtcgtaacgtcgacctacccgtntaccgttcgttcttaccgtnttcccccg

SEQ ID NO: 229791 - DNA, 722 bp, Homo sapiens
  misc_feature: GYAE6OF02GSCSX.24.37.D04.1.454.CMB.1.raw
  modified_base (291)..(291): a, c, t, g, unknown or other
  misc_feature (291)..(291): n is a, c, g, or t
  modified_base (581)..(581): a, c, t, g, unknown or other
  misc_feature (581)..(581): n is a, c, g, or t
  modified_base (603)..(603): a, c, t, g, unknown or other
  misc_feature (603)..(603): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctgcctcccagatcgccaccggagactattgtagttcgacacagtctccagcccacctgttcttcgtctaccgagggaacacgccaccctctcctgcgacggctagtgaactagtggttaaggtaaggttgttacgcgttggtactacgaaacaactaaacgngtacggaccaggtcccgtccccggtcctacctcacttacctagtactactcgtacctaacgtaaccgtaacggtaccgggaccctacgttacggccctaaccgtacccggaacggtacggttacggtaccggttacgggtaggaccgggttagggttcgggttaccggtacgggtaaccgtacgttaccgttaaccgtccttaccgtacccaaccgtacctacggacgtaagtcggttaagtacggacgttaaccgtagttaagttcttacggtactttaggtttacttnttacgacgtactcgaccgttanaacctacggtctccgttacggtccccgagccgtacgactaccgcgtactaccgacggaaaccttgggcccgtggtacctacccgtagtaccttctcggtttaccgtccttacttccccg

SEQ ID NO: 229792 - DNA, 707 bp, Homo sapiens
  misc_feature: GYAE6OF02GK47A.24.37.D04.1.454.CMB.1.raw
  modified_base (140)..(140): a, c, t, g, unknown or other
  misc_feature (140)..(140): n is a, c, g, or t
  modified_base (150)..(150): a, c, t, g, unknown or other
  misc_feature (150)..(150): n is a, c, g, or t
  modified_base (175)..(175): a, c, t, g, unknown or other
  misc_feature (175)..(175): n is a, c, g, or t
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (406)..(406): a, c, t, g, unknown or other
  misc_feature (406)..(406): n is a, c, g, or t
  modified_base (658)..(658): a, c, t, g, unknown or other
  misc_feature (658)..(658): n is a, c, g, or t
  modified_base (667)..(667): a, c, t, g, unknown or other
  misc_feature (667)..(667): n is a, c, g, or t
  modified_base (683)..(683): a, c, t, g, unknown or other
  misc_feature (683)..(683): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggcctccagntgaccacggngactattgtgtgacacacgtcctcncgccaccgtgttctttcggcctacgaggggaacncgccacccgttctccgtagaccgacgggaccaggtcgtaaccgtaagtggttaaggtaacgtttggttacgccgtggtaactacaacaactaaacngtcgacagtcccgtacccgntccgtctactagttaagcgtacgtcactaccgaaccgaaggttaccggccagttccggaactaccgtaaccacggttaacngggtttaaccgacggtacggtacgtagggttcggggttccgggtaacggtaactacggttaccctaagtaccccttttacgacccgtactacggtcaacgtgaacgttacgtagcgttacgacgttacgttagtttaccgtgttaacgttaacggttacttcgactacgaccgtacgacgtaaccacggttaccgccgtccggttaccgtccgggttaccgcgtaacgcgacgtcacgtaccgaacggtacncggtaccgngttacccgataccgtnttaccgtcgttcttacccgttccg

SEQ ID NO: 229793 - DNA, 761 bp, Homo sapiens
  misc_feature: GYAE6OF02FVCNR.24.37.D04.1.454.CMB.1.raw
tcagactactatgtcacgaccggtgctcgatttagtagcatactgttgggtttgggggggaaatgctttctgagactcatggacctcctgtgcaagaacatgaagcacctgtgttcttcctcctgctggtggcggctcccagaagggtcctgtcccatttccagttgcgtgagtcgggcccaggactggtgaagcctgcggagaccctgtccctcatttcgctctgtctcgtaggtcgactccttcgagtaacacagatttattagttgggcctggtactccggcaccggacccccgaagggaacgacgtccgtgggagtttgggttcgacggtaagttacgtaccctaagtttactcgtaacgtcggggtaccccgttaaacccccttcttaaccgtaacgtttccccggtaccccttacggtaaggtacggttaccggacgttaccaaccttacgtttacgaccgtcgggtacgtacccggtaaccgaacgtaaaccgtacgttacccgtacccgtacggacgtccgtggtcccgttacgtcgggtacccgaccccggtccggaaccgtaccgggtcccgttaattactttacgtggtcgggcggttacgttacggccgttagtttggttcgttcggacgtacgttcgtccgtacggtccgtaccgttaccggcgtacggtaccgttaacgtttacgtttaccggtgggggttaccggttttaccggggacctaaccggtacggggtaccctaaccggg

SEQ ID NO: 229794 - DNA, 955 bp, Homo sapiens
  misc_feature: GYAE6OF02H2B23.24.37.D04.1.454.CMB.1.raw
tcagactactatgtcacgaccggtgctcgatttagtagcatactgttggggtttgggggaggaactgctcagttaggacccagagggaaccatggaacgccccagctcagcttctcttcctcctgctactcgtcggcctccagtatcgccgaccggacgaactagtttggttaggtttacgaacctaacgacggttacccttccgaacggtcccctaacccgttcgttacgtttttcgtaccgtacccgggtaaggggggaaaacaccggtacccctaacccgttccgttacccgttcggaccggtaacggggtacccgtaaggttaacggaaccgtaaaggtttagggtttaaacgggttaaaggtttacggttaaccggttaccggttaggggttaaaccttaaaccggaaaaccgtaaacgaaaacgttacggtaccgggaccggttaaccggtcccgttaccccccgggtcctttacccttaaccgtacttaccgtaaagcggttaacgtcctaacgtaccttaacggaacggtaccggaacctacgtaggacctacgacgtacgtacgtacgtacaggtcggagttacggtacggtcgtaacgggactacgttacgttacctacgtacgtaccacgtacgaccgtagtaccgtagtcggtaacacggttacctaaggtattacggtttacgaacgttttaacgtttacttagtaccgttaggtacgtacccgttaaccgtacggtaaccgttaccgggttacccggttacccgggtttaaccggtttccgggaaacccgggttaacgggaccggtaaccgttaacggggaccgttaacccggttaaccggtaacccgggtttaaacggcgggtttaccgggtaaccgggtaccttaacccgggacctttaacgggtcttccgtttaaccggttccctttaaggtaccccg

SEQ ID NO: 229795 - DNA, 880 bp, Homo sapiens
  misc_feature: GYAE6OF02JXB6O.24.37.D04.1.454.CMB.1.raw
tcagactactatgtcacgaccggtgctcgatttagtagcatactgttggggtttgggggaggaactgctcagttaggacccagagggaaccatggaagccccagctcagcttctcttcctcctgctactctggcctcccagatcgaccaccggaagacagttgtgttcgaacactagtcctaccacgccctacccgttgttaccgttttcgtacgtacccggaaaggggggaaaacaccgtcccctaaccccttcgtcccgttcggaccggaacgggtccgtaacggttacggaaacttaaggtttacgggttaaaggttaaccgtttaggttaccggtacgtttgttaaactaacctaaaacctaaaccgtaaaaccgtacggtacggaaccgtaccggtaccccgtacccccgggtccttacccgttacgtaaccttacttaagtacgtacgtaccgtactaacctaccgtaacggttacgggaccctaggtccggtacacctaaccggtaacgtacggtacggttcgacggtacgggtaacgttacgggtacggtacggtacggtaacgtaccggtactttaccgaccgtttcaacccgtactaacgtacgtagaaccggttagttaacggtacggtaccaggttaacgtaacgtttagtttacggttaactttcgttaaacgtttcgttaacgttaccggtacctaaaccgtacgttaccgtaaccgtagttaccccggtaccgtttaccggtaccggttaccgtaaccggaccgtaacgtaccgtaacgtaccgaccgtaacgtacgtacggtacgtaccggtaccgttaggtaccctacgttaacgtcgtttacccggtattacccttccccgg

SEQ ID NO: 229796 - DNA, 792 bp, Homo sapiens
  misc_feature: GYAE6OF02HWRPV.24.37.D04.1.454.CMB.1.raw
  modified_base (205)..(205): a, c, t, g, unknown or other
  misc_feature (205)..(205): n is a, c, g, or t
tcagactactatgtcacgaccggtgctcgatttagtagcatactgttgggtttgggggggaaatgctttctgagactcatggacctcctgtgcaagaacatgaagcacctgtggttcttcctcctgctggtggcggctcccagaagggtcctgtcccatttccagttgcgtgagtcgggcccaggactggtgaagcctggcgganccctgtccctcattgctctgtctctggtcgactccttcagttaacacgaagtactttaattagttcgggcctaggactccggcaccggcccccgaaggggaacgacgtccgtgggtaggtttgggttcgacggtagtactacctatttaactcgtagtccgggtacccgtaaccccctttactaccgtacgttcccggtacccttacggacggtacgtcggtacggttacctacccttacgttttccgaacgttacgggacggtacccgtaaccgaaacggtaacccttacggtaccgttccccgtaggtaacgggtccgttacgggtccggttacgtacgggtcccggaaccccccgggtacggtaaccggtaacccgggtaccgttaacttaacggtttaccgtggttaccgggtcggttacggtttacgggtacttaggtttcggttggttcggtcgttaaacgttcgttacgacggttaccgtaccggtacccggtcgtaccgtaacttaacgtttaacggttccggttacggggttaccggtttacggggacctaacgggtacgggtaccccgtaaccgggg

SEQ ID NO: 229797 - DNA, 712 bp, Homo sapiens
  misc_feature: GYAE6OF02I73K0.24.37.D04.1.454.CMB.1.raw
  modified_base (186)..(186): a, c, t, g, unknown or other
  misc_feature (186)..(186): n is a, c, g, or t
  modified_base (393)..(393): a, c, t, g, unknown or other
  misc_feature (393)..(393): n is a, c, g, or t
  modified_base (610)..(610): a, c, t, g, unknown or other
  misc_feature (610)..(610): n is a, c, g, or t
tcagactactatgtcacgaccggtgctcgatttagtagcatactgttgggtttgggggaggaactgctcagttaggacccagagggaaccatggaagccccagctcagcttctcttcctcctgctactctggctccagatgccaccggagacattgtgtgacacagtctcagcccacctgtctgtntctaccgaggggaaagcgcccaccctctcctgcgacgggccagtcagagtaataagaagccaaaccttattacgccgttaggtactacaaacaacgaacctgaccgagtccctccgagccttcctacgtactctagttaggtaataccgtaccgaggaccgacgggacccttacggtcggtaccgtacccgaggtccgtaaggtttnacggtcgggtaccgttagggttggggttaccggtaggggactaacgggttacttccctaaccggttcctaccgaacctacgttaccgaacgtaccgtagttcgacggtaccgttacgtacggttagtaaacggttttacgttttcgtacgttttaacgttttactttacgaccggttacgaacgtcacgtacgacgtaagtcggtcctcggttaccncgttcgtacggttcgggacggtaaccggtaccggtaagggtaccgtaagtaaccgaacgttaaggtacgttcggtaagtaccgtacgtaccctacgttacgg

SEQ ID NO: 229798 - DNA, 541 bp, Homo sapiens
  misc_feature: GYAE6OF01C018A.16.77.G11.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (384)..(384): a, c, t, g, unknown or other
  misc_feature (384)..(384): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (504)..(505): a, c, t, g, unknown or other
  misc_feature (504)..(505): n is a, c, g, or t
  modified_base (507)..(541): a, c, t, g, unknown or other
  misc_feature (507)..(541): n is a, c, g, or t
tcagtgtactactccacgaccggtgctcgatttagctagtcactcaagggaaagggtcagggcgctgagggtcagatgtcggtgttgggggccaaggccccgagagatctcaggacaggtggtcaggtgtctaaggtaaaacagctccccgtgcagatcaggacatagtggaaaacagcctcgacccctntcgcctggcatacgacctttcacgacacagtacncccctagaacaacgggccaaccccgaaanaccacatccaatactactgacggtcgacgggcctcccgaggtcgaaccacgacggacctctccgaccccctcgcccctcacctcccacccgcacggtccacgcccgtaacgcctccgcccccgttcgtccnccttccgtaccgttcccctacccgttcccgaccgtacgtaacgtctacccgttaggaccgggtccggcttaccgggactaacgggccgtacgtagtagcancgactnagcngaacngctnncnnnnnnnnnnnnnnnnnnnnnnnnnnnnnnnnnnn

SEQ ID NO: 229799 - DNA, 496 bp, Homo sapiens
  misc_feature: GYAE6OF02I18Y2.16.77.G11.1.454.CMB.1.raw
  modified_base (254)..(254): a, c, t, g, unknown or other
  misc_feature (254)..(254): n is a, c, g, or t
  modified_base (467)..(496): a, c, t, g, unknown or other
  misc_feature (467)..(496): n is a, c, g, or t
tcagtgtactactccacgaccggtgctcgatttagctagtcactcaagggaaagggtcagggcgctgagggtcagatgtcggtgttgggggccaaggccccgagagatctcaggacaggtggtcaggtgtctaaggtaaaacagctcccgtgcagatcaggacatagtggaaaacagcctgacccctctgcctggcatagaccttcagacacagacgcccctgaacaagggccaccccaacaccacatcactanactgaggtcacgggctccccgaggtcggacaccgaggactctcgaccccctgccccctcactcccaccccgcacggtccacgccccaacggcctccgccccccgtcggtccaccttcctccggttccccgccccttcccgtccggaacgttaacgtaacctaccgtacggacggcccggggtcgtcgggacggaaacggtccgctaacgtagnnnnnnnnnnnnnnnnnnnnnnnnnnnnnn

SEQ ID NO: 229800 - DNA, 561 bp, Homo sapiens
  misc_feature: GYAE6OF01DWUE1.23.35.D02.1.454.CMB.1.raw
  modified_base (223)..(223): a, c, t, g, unknown or other
  misc_feature (223)..(223): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctcctgcaaggtctcgtaggaaacacattccctgatgatgatatcaagttgggtgcgacaggccacgtggactcggccttgagtggatggctacgagttacgacctaattaggaggtcagtggcgtaactatgacaggaggtacgggttccggggactaggtacgtctaccgagtacggaccgtgggaacacgactcccgaacgaacgtacacgcctaacagtaggtaacgtggacgggcctaggagtagttacgaagtaccgaccggtccgtttacgttcgtcggcggacgggacgggggtcgtaggagttggtaagttaagttagg

SEQ ID NO: 229801 - DNA, 636 bp, Homo sapiens
  misc_feature: GYAE6OF01CSU6D.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactgggcctggaggatcctcttcttggtggcagcagctacaggttcccactcccaggtgcagctggagcagtctgggactgagctgaagaagccgtggggccgcagtgagggtctcctgcaaggtctcgtaggaaaaccacgtacttccctgatgatgatatctaagttgggtgcgacgaggccacgtggactcggccttggaggtggagtgggactacgagttacgccctaaagtttacggaggtacgaggtggaccgggtaacttagtggacgaggaacgggtacggggttcccggggacgaggtagtccgtaccgtagtcggtaccgtagggacctacgactacccgaacgtaccgtaacacgtaccgtaacgagtagggtaacggtacgggacggggtaccgtaggtaacgtacgtttaccgaacggtaccgtaaccgggttcccgtttacgttcgtcgggaccgggcgggacgggggtcgttaggtagttacggtaagtttaagtaggg

SEQ ID NO: 229802 - DNA, 711 bp, Homo sapiens
  misc_feature: GYAE6OF01A849D.23.35.D02.1.454.CMB.1.raw
  modified_base (222)..(222): a, c, t, g, unknown or other
  misc_feature (222)..(222): n is a, c, g, or t
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagctggggccncagtgagggtctccgtgcaaggtctcgtggaaacacattcccngatgatgatatcaagttggngcgacaggccacgtggactcggtacttgagtggagtggctaacgattacgacctaagttacgaggcaggttggacggtactagtgacgaggtaggtacgggttccggggactaaggtacgtccgtacccgtaagttaccgggaacccgttaggggaacctaccgtaacgtaccccgtaacgtaaccgtaaccgaaccggtacccgttaaacgtaacggtacggggtaaacgggttcgggaaacgggggtccctagggtaacggttaacgttttaaccggaaaccggttaacccggtaaaccggggtttaccccgtttttaaccggtttccggttaccggggacccgggtaaaccggggtacggggggggtaccccggtttaggaaacggtttacgggttaaaggggttttaacgtttaaacggggg

SEQ ID NO: 229803 - DNA, 672 bp, Homo sapiens
  misc_feature: GYAE6OF01D1C64.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtcgtgggactgagctgaagagcctggggccgcagtgagggtcctccgtgcaaggtctcgtaggaaacactattccctgactgatgatatacaagttgggtgcgacacggccacgtggactcggtcttagaggtggagtggactacgtatacgaccctaaattagaggcaggtcgacggtactagtgacgaggaaggtacggggttaccggggacgaaggtacgtccgtaccgtaagtacggtacccgtaggggaaccctaaccgtactaccccgaaccgaaccggtaacctaacgtaccccgtaacgtaaggtacggggtaaacggttacgggaacgggggtaccgtaggtagttaacgtttaaccgaaacgggtaaccgtaacccggggttacccgttttaaccgttacggtcggaccgggtaccggggacggggggtcggttacggtaaggttaggttaaaggtttagttaacgggg

SEQ ID NO: 229804 - DNA, 530 bp, Homo sapiens
  misc_feature: GYAE6OF01BPGAM.23.35.D02.1.454.CMB.1.raw
  modified_base (224)..(224): a, c, t, g, unknown or other
  misc_feature (224)..(224): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccncagtgagggtctcctgcaaggtctctggaaacacattcctgatgatgatatcaagttgggtgcgacaggccacgtggactcggccttggagtggagtgggactacattacgccaagttaggaggcaggtgacggtactagtgcaggagacgggttccggggcaggagtctacgagtcgaccgtgggacacatcccacacgtacagcctagagtagggaagtggacgggtctgagtattacgaagaccgtacggtccgtttagtcgtggccggtcgggacggggtcgtagagtggtagttagtacgg

SEQ ID NO: 229805 - DNA, 593 bp, Homo sapiens
  misc_feature: GYAE6OF01CCSI2.23.35.D02.1.454.CMB.1.raw
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (327)..(327): a, c, t, g, unknown or other
  misc_feature (327)..(327): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctgggaggatcctcttcttggtggcagcagctacaggttcccactcccaggtgcagctggagcagtctgggactgagctgaagagcctggggccncagtgagggtctccgtgcaaggtctcgtggaaacncattccctgatgatgatatcaattgggtgcgacaggccacgtggactcggccttgagtggatggctanattagcctaattagagcagtgcggactatgacgagagaggttccggggacaggagtctacgagtcgaccgtggacacatccacgacgtacgacgcctaagacgtagggtaagtcggaacggggtcctaggaacgttacgtttacgaaacggtaaccgtaccgggttacccgtttttaacgttaccggttcgggtaccgggtaccggggtaacgggggggtccgttacgggtaagttacgggttaaaggtttaaaggtttaacgggg

SEQ ID NO: 229806 - DNA, 525 bp, Homo sapiens
  misc_feature: GYAE6OF01EDW3E.23.35.D02.1.454.CMB.1.raw
  modified_base (378)..(378): a, c, t, g, unknown or other
  misc_feature (378)..(378): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccgcagtgagggtctcctgcaaggtctctggaaacacattccctgatgatgatatcaattggggtgcgacaggccactggactcggccttgagtggatgggctactattagccctaagttagaggcagtgcggactatgcagagacgggttccgggnagagtctccagtcgacgtggacacgactccactacgacacgcctacagtaggaaggtggacgggacctaggacgtattacgaacgacgtaccggtccgtttacttcgtcgccggcggagggggtcgtaggatggtagttagttacgg

SEQ ID NO: 229807 - DNA, 783 bp, Homo sapiens
  misc_feature: GYAE6OF01CMEFH.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtcgtgggactgagctgaagaagccgtggggccgcgagtgaggggtctccgtgcaaggtctcgtaggaaacactacttccctgatgatggtaatatactaaagtttggggtgacgacgacggccctacgtgggaccgttcggccttggaggtggtagtcgggactacgtagttacgaccctaaagtttaggaggacgtacgtcggaccgggtaactagtacgacgtaaggaacggtacggggttaccgggggacgtaacgggtacggttaccgtaccgtaacgttaccggtaaccggttacggggaacctaacccgtacgtaccccgtaaccgtaaccggtaaacccgaaccggtaccccgttaacgtaacggttaacggggtaacggttacgggggtaaccggggggtaccccgttaggggtaaccggttaaggttttaacccgaaacgggttaaccccggttaacccggggtttaccccggtttttaaccggtttacccggttaccgggtacccggggtaccggggtaacgggggggttaccggtacgggttaaggttacgggttaagggttttaaaggttaacggggg

SEQ ID NO: 229808 - DNA, 647 bp, Homo sapiens
  misc_feature: GYAE6OF01DXH8T.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttccccactcccaggtgcagctggagcagtctgggactgagctgaagaagccgtgggggccgcgaggtgacgggtctccgtgcaaggtctcgtaggaaacactattcctgatgatgatatcaagttgggtgcgacaggccacgtggacctcggccttgagtggagtggctacattacgacctaattagaggcaggtgacggtactagtgcaaggaggtacgggttccggggacaaggtacgtccgtacgtaagtcgtacccggtcgggaacgaacctacgtacccaaccgtaaccgttaccgaacgtaccctaacgtaaggtacgggtaaacggtagggaacggggtacccttaggaacgttacgtttaacgaaagtaccgtacccgggttacccgttttaacgtttccggtcgggaccgggtacgggtaacggggggtccggttagggtaacgttagggttaaaggtttaagttaacgggg

SEQ ID NO: 229809 - DNA, 554 bp, Homo sapiens
  misc_feature: GYAE6OF01DMMFJ.23.35.D02.1.454.CMB.1.raw
  modified_base (390)..(390): a, c, t, g, unknown or other
  misc_feature (390)..(390): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcctactcccaggtgcagctggagcagtctgggactgagctgaagaagccgtggggccgcaggtgagggtctccgtgcaaggtctcgtaggaaaccacattccctgatgatgatatcaagttgggtgcgacgaggccacgtggactcggtccttggagtggagtgggctacattacgcctaattagaggcaggtgacggatatgcaggagacggggttccgggnaggagtctaccgagtcgaccgtgggaaccacactccacacgtacacgacctagagtagggagtggagggacctggacgtattacgaagtaccgaccggttaccgtttacttcggtcggccggacgggacgggggtccgtaggagttaggtaggtttaagtaggg

SEQ ID NO: 229810 - DNA, 512 bp, Homo sapiens
  misc_feature: GYAE6OF01BKS9Q.23.35.D02.1.454.CMB.1.raw
  modified_base (226)..(226): a, c, t, g, unknown or other
  misc_feature (226)..(226): n is a, c, g, or t
tcagacgcgagtatcacgaccggtgctcgatttagcacacgatagttgggtttggggagcatcactcaacaaccacatctgtcctctagagagaacccctgtgagcacagctcctcaccatggactggacctggaggatcctcttcttggtggcagcagctacaggttcccactcccaggtgcagctggagcagtctgggactgagctgaagaagcctggggccgnagtgagggtctcctgcaaggtctctggaaacacattccctgatgatgatatcaattgggtgcgacaggccactggactcggccttgagtggatgggctacattagcccaattagaggccagtgcggactatgcagagaggttccggggcagagtctccatgacctgggacacactccacacgtacacgcctacagtaggaagtcggaggggtccgtgagatttcaaaggacgaccggtccgtttacttcgtgcggcggagggggtcgtggatggtagttagttagg

SEQ ID NO: 229811 - DNA, 555 bp, Homo sapiens
  misc_feature: GYAE6OF01B8ODH.23.35.D02.1.454.CMB.1.raw
  modified_base (362)..(362): a, c, t, g, unknown or other
  misc_feature (362)..(362): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccgcagtggagggtctcctgcgaaggtctcgtggaaacacattccctgatgatgatatcaagttgggtgcgacaggccactggactcggcttgaggtggatggctacattacgaccctaagttagagcagtcgcgatagngcaggagacgggttcgggcaggagtcgtcagtcgaccgtggaccacactccgacacgtacacgacctaactagtaggaaggtggacgggaccgtaggagtacgttacgaaacgtacgtaccgggtaccgttttacgtcgttcgccggtacgggtacgggggtacgtaggtaagttaggtagttaaagttaggg

SEQ ID NO: 229812 - DNA, 754 bp, Homo sapiens
  misc_feature: GYAE6OF01DU9DO.23.35.D02.1.454.CMB.1.raw
  modified_base (225)..(225): a, c, t, g, unknown or other
  misc_feature (225)..(225): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttccccactcccaggtgcagctggagcagtctgggactgagctgaagagccgtggggccncgagtggagggtctccgtggcaagggttctcgtacgggaaactactacgtttccctaggatggtatggtaattactctaagtttggggtgcgacgaggccaacgtggactcggctttggacgtggagtcgggtactaacgtagttacgaccctaaagttacggacggtacgtaggtaggacgggtaacttaagtcggaaccgtaaggtaacgggtaacgggggtttaccccgggggacgtaacgggtacggttacccgttacccgtaaacggttccggtaacccggttacgggggaaaccctaacccgtaaccgtaaccccgtaaaccgtaacccggtaaaccgtaccggtaaccccgttaacgaacggttaacggggtaacgggttaacgggacgggggtaccctaggtaacggtacgtttaccgaaacggtaccgttaaccgggtacccgtttttacgtcccggttaggcccgggtacggggacgggggtccgttagggtaagtacgggttaagttaaggttacggg

SEQ ID NO: 229813 - DNA, 587 bp, Homo sapiens
  misc_feature: GYAE6OF01AOD9J.23.35.D02.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggancagtctgggactgagctgaagaagcctggggccncagtgagggtctcctgcaaggtctctggaaacncattccctgatgatgatatcaattgggngtcgacaggccaacgtggactcggccttgagtggatggctacagttacgacccaagttagacggcaagtgcggactagtcgacgagagtagggttccgggcaggtagtacgtccgaacgtgacccgtggggaccaacgacgtccaaccgacgtaccgacgtccctaactacgtacgggaaggttcggaacggggtcctaggagtacgttacgaacggtaccaccgggtccgttttaaccttcgttcggaccggtcgggtacgggggtccgttaggtagtttacggaagtttaacggttaggg

SEQ ID NO: 229814 - DNA, 793 bp, Homo sapiens
  misc_feature: GYAE6OF01BXBLO.23.35.D02.1.454.CMB.1.raw
  modified_base (233)..(233): a, c, t, g, unknown or other
  misc_feature (233)..(233): n is a, c, g, or t
tcagacgcgagtatcacgaccggtgctcgatttagcacacgatagttggggtttggggaagcatcactcaacaaccacatctgtcctctagagagaaccctgtgagcacagctcctcacccatggactggacctggaggactccctcttcttggtgcacgccagctacaggttcccactcccaggtgcagctggagcagtctgggactgagctagaagagccgtggggcccgnaggtggacgggttctccgtggacgtaagggtcctcgtacgggaaaaccactaactttccctaggtaatggtaataggtaacttatacgtaaggttttcggggacgaccggaacgacgggaccctaacggttacgggaaccgttcccggggaccctttgggaggttcgggaacgttcgggacctaacgtacggttaaccgaaccccgttaaaggttacgggaacgggtacgtacggtcgggtaaccggaactttaggtcggacgagggtacgggtaacggggtttccggggacgtacggtacgttaccgtcgtacgtcggtaaccggttcgggaaccaccgtaccgtacccgtaacgtaaccgtaacgtacgtaccgtaacgaacggttaacgggtaaagggttcggggaccggggtaccgttaggtaacggttacgtttaaccggaaccggtaaccggtacccgggtttaccggtttaaccttccggtaccgggacccgggtacggggaacggggggttccgttaggtaaggttggttaaacgggtttagttaaacgggg

SEQ ID NO: 229815 - DNA, 595 bp, Homo sapiens
  misc_feature: GYAE6OF01D80FJ.23.35.D02.1.454.CMB.1.raw
  modified_base (223)..(223): a, c, t, g, unknown or other
  misc_feature (223)..(223): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncaggtgagggtctccgtgcaaggtctctggaaacacattccctgatgatgatatcaagttgggtgcgacacggccacgtggtacgtcggtccgttgaggtggagtgggctactacttacgacctaagttagacggctagtgcggtactagtggacaggaggtacggggttaccgggggacgagggtaacgtcgtaccgagtacggtaccgtggggaaccaacgtacgtacccaacgtaaccgtacgacgcccgtaacaggtacgggtaaggtacgggacgggccgtagagtatttacgaagacgtacggttccgtttacgttcgtcggcggtcgggacgggggtcgtaggtagtaggtagttagttaacggg

SEQ ID NO: 229816 - DNA, 710 bp, Homo sapiens
  misc_feature: GYAE6OF01A0UZ2.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccgcagtgagggtctcctgcaaggtctcgtaggaaacacattccctgatgatgactatcaagttgggtgcgacaggccacgtggactcggtccttggagttggattcgggactacagtttacgaccctaaagttaggacggacgaagtgacggtaactagtacggacgaggacgggtaacggggtttccgggggacgtaagggtacggtaccgttacccgaagttaccggaaccccgttgggggaaccctaccgaaccgttaccccgaaacgtaaccgtttaacccgacggtaccccgtaaccgaggttaccggggtaaaggtacggggtaacggggtaccccgtaaggacggttaacgtttaccggaaacggtaacccgttaccggggttacccgtttttaacgttccggttccgggacccggtaccggggtagggggggtacccggttagggtaagtttagggttaacggtttaaaggttaacgggg

SEQ ID NO: 229817 - DNA, 733 bp, Homo sapiens
  misc_feature: GYAE6OF01DRWB3.23.35.D02.1.454.CMB.1.raw
  modified_base (232)..(232): a, c, t, g, unknown or other
  misc_feature (232)..(232): n is a, c, g, or t
tcagacgcgagtatcacgaccggtgctcgatttagcacacgatagttgggttggggagcatcactcaacaaccacatctgtcctctagagagaaccctgtgagcacagctcctcaccatggactggacctggaggatcctcttcgttggtggcagcagctacacggttcccactcccgaggtgcagcctggacgcagtcgtgggactgagctagaacgacgccgtggggccncgaggtggacgggtctccgtgacgaggtctccgtaggaaaccactacttccctgactgactggtatagtaccgtaagttggggtacgccggaacgacggtccgacgtacgggtacccgtcgggtcccgttaggaggttggaacggttcgggacttaacgtaagttacgaccctaaagttacggacggtcaggtcgacggtacttagtcgacgaaggtacggtacggggttaccgggacgtaacggtacgttccgtaaccgtacgttccggaacccggtgggtaacccgtaccgtaccgttacccgtaaccgtaaccgtaaccgaacggtaaccccttaacgtaacggttaacgggtaacggtaggggacgggtacccgttaggtaacggttaacgtttaccgaaggtacccgtaccgggttacccgttttacgttcggtcggtaccgggtacggggtagggggtaccgtaggtaggttacggttaaggttagttaacgggg

SEQ ID NO: 229818 - DNA, 693 bp, Homo sapiens
  misc_feature: GYAE6OF01A9CAE.23.35.D02.1.454.CMB.1.raw
  modified_base (227)..(227): a, c, t, g, unknown or other
  misc_feature (227)..(227): n is a, c, g, or t
tcagacgcgagtatcacgaccggtgctcgatttagcacacgatagttggggtttggggagcatcactcaacaaccacatctgtcctctagagagaaccctgtgagcacagctcctcaccatggactggacctggaggatcctcttcttggtggcagcagctacaggttcccactcccaggtgcagcgtggagcagtcgtgggactgagctgaagagccgtggggccncgagtggaggtctcctgcaggtctgtaggaacactatcctgatgatgatatactaagttgggtcgcgacgaggccacgtggacgtcggccgttggagtggagtggtcgtactagtacgtacctaagttaggaggacgtaggtcggacggtatagtcgacgaaggtacgggtacgggttccggggactacgggtacgttcgtaccgtaggtaccggtaaccggtacgggtaccaaccgtaaccgtacccgtaaccggaaccgtaaccgtaaccgtacccgtaaacgtacggtaacggggtaacgggttacgggtaccggggtacccgtagggtaacggttacgtttaaccgaaacggttaacccggtaacccgggtttcccggtttaacgttaccggtccggaccgggtacggggtacgggggtccggttaaggtacggttaaagggttaaggtttaaggttacggg

SEQ ID NO: 229819 - DNA, 692 bp, Homo sapiens
  misc_feature: GYAE6OF01BYZFN.23.35.D02.1.454.CMB.1.raw
  modified_base (229)..(229): a, c, t, g, unknown or other
  misc_feature (229)..(229): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagcgtggagcagtcgtgggactgagctagaagaacgccgtggggccncgaggtggacgggtctccgtgcaaggtctcgtacggaaacactacttcctagatagtatagataatcgtaaggttgggtacgacgacgacggaccacgtacggtacgtcggtccgtaggaggtgagtcggactaacgtaagttacgaccctaagttacgaggtcgtaggtcgacggtaactagtcgacgaggtaggtaccgggtacgggacgaacggtcgtccgtacgtagtacgaccggtacgggtaaccacgtacctaccgaaccgtaaccgtaccgaacgtaccgtaacgaacggtacggtaacggtacgggtacgggtacgtacggtaacgtaacgtttaacggaaccgttaaacccggtaccggtttaccgtttacccgttcggaccgggtaccgggtaaccggggtaggggttccggttacggaaggtttacggttaacggtttaaggttaacgggg

SEQ ID NO: 229820 - DNA, 778 bp, Homo sapiens
  misc_feature: GYAE6OF01C1JBA.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctgggaggatccctcttcttgggtggcagcagctacaggttcccactcccaggtgcagctggagcagtcgtgggactgacgctaggaaagaacgccggtggggcccgcgtaggtcggagggttcctcccgtggactaggtctccgtaggaaaccactacttccctagactagatgattatacgtaagttcgggtagacgacgacggtacctacggtacgggaccgttccgggtccttagggtacggtagggtacgttcgggtaccttaacgttaagttaaccggtaacccgttaaaggttaacggacggtacgtaacggggttacgaaccgggttacgttaaggtcggaaccggtaacggggtaacggggttaccgggggttaccccggggggaacttaacggggtaccggtttcccgtaaccggttaaccggttaccgggtaacccgttaccggggaaacctaccgtaacctaaccccgtaacgtaacccggtaacgaccggtaacctaacgtaacgggttacgggaaggttacgggacgggtccgtaggtaccgttagttaacgacgtaccggtccggttaccgtttaccgtcgttcggaccgggcggtagggggtccttaggtacgttaaggtagttaaggtaggg

SEQ ID NO: 229821 - DNA, 472 bp, Homo sapiens
  misc_feature: GYAE6OF01CDUK8.23.35.D02.1.454.CMB.1.raw
  modified_base (225)..(225): a, c, t, g, unknown or other
  misc_feature (225)..(225): n is a, c, g, or t
  modified_base (321)..(321): a, c, t, g, unknown or other
  misc_feature (321)..(321): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagcctggagcagtctgggactgagctgaagaagcctggggccncagtggagggtctcctgcaaggtctctggaaaacacattccctgatgatgatatcaattgggtgcgacaggccactgactcggcttgagtgatggntacattagccaaattgagcagtgcggactatgcagagaggttccggggnagagtctccatgacctggcanatccanacgtacagctacatgaagtgagggctgagattcagacaggcctttatactgcgcgaggggcgtgatcgagtatag

SEQ ID NO: 229822 - DNA, 573 bp, Homo sapiens
  misc_feature: GYAE6OF01A0FD8.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactccccaggtgcagctggagcagtctgggactgagctgaagagcctggggccgcagtgagggtctcctgcaggtctctggaaacacattccctgatgatgatatcaattgggtgtgacaggccactggactcggccttgagtggagtgggctacattagaccctaaagttacggaggcagtggcggtactatgcgagaggtacggttcggggacgaggtacgtcctctagtcgaccgtgggacacgactccgaacacgtacgacgtaccttacgagtacgggaagtgggacggggccgttaggaagtatttacgaaacggtaccgtaccgggtaccgtttacgttacgtcgggccggtacgggacggggggtcgtggtaagtggtaaggttaagttaacggg

SEQ ID NO: 229823 - DNA, 716 bp, Homo sapiens
  misc_feature: GYAE6OF01DHYIC.23.35.D02.1.454.CMB.1.raw
  modified_base (225)..(225): a, c, t, g, unknown or other
  misc_feature (225)..(225): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctagaagagccgtggggccncaggtgacgggtctccgtgacaaggtctcgtaggaaacactacttccctagatgatgtattatactaaggttgggtgcgacgacggccacgtggaccgtccggtccttggacggtggacgtcgggtactaacgtaattaccgaccctaaagttaggacggtacgtaggtcggacggtaactttagacggtacgtaagggtaacgggtacggggtttccggggaacgtagggtacgttaccgtaccgtagtacccggaccggttaggggaaccctaccgtaaccgtaccccgaaacgtacccgtaaccgtacgacccttaacgaaggttacggggtaaacgggtcggggtaaccggggtaccgttacgggaagttaaccgtttaccggaaacggtaccgtaacccgggtttccgtttaaccgttcggtacgggtaccgggcggggtaacggggtcgttaacggtagttagggttaacgtttaagtaacgggg

SEQ ID NO: 229824 - DNA, 737 bp, Homo sapiens
  misc_feature: GYAE6OF01CTJHJ.23.35.D02.1.454.CMB.1.raw
  modified_base (429)..(429): a, c, t, g, unknown or other
  misc_feature (429)..(429): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctgggaggatccctcttcttggtggcagcagctacacggttcccactcccgaggtgcagctggagcagtcgtgggactgagctagaaagacgccgtggggccgcgaaggtggacgggtcctccgtagacgaaggtctacgtaggaaaccactacttcctgactgatgatagtactaagttgggtcgacgacgacggacctacgtcggacgtcggtccgttgggaggtgggtacgtcgggtacctaacgtacgttaccgacctaaagttacggacggacgaggttacggacggtacttagnggacgaaggtacgggtcggggttacccggggagtaacgggtacgttacccgaccgtacggttacggtacccggtacgggaaaccctaacgaccctaacccgaaccgtaccgtaacccgacggtaacccgtaacgtaacggttaacggggtaacggtacgggggaaccgggtaccgtaggtaacggttaacgtttaaccggaaacggtaccgtaacccgggtttcccgtttaacggttcggtacgggtaccggggtacggggacggggtccggtttaaggaggtttaaggtaaggtttaaggtaacggg

SEQ ID NO: 229825 - DNA, 833 bp, Homo sapiens
  misc_feature: GYAE6OF01B8IT3.23.35.D02.1.454.CMB.1.raw
  modified_base (224)..(224): a, c, t, g, unknown or other
  misc_feature (224)..(224): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggagactcctcttcttggtggcagcagctacacggttcccactcccaggtgcagctggagcagctgggactgagctgaagagccgtggggccngtagtggagggtctccgtgcgtaaggtcctacgtaggaaaaccactacgtttacccgtagatcggattaggaattagtactaaagtttcggggacgaccgaacgtacgggaccgtaacggttcgggaaccgttccgggtacccgtttgggaaggtacgggttacggtacggggtacctaaacgtaagttaaccggtaacccctaaaggtttacggaacggtccggtaaggtacggtaccgggtaacttaaggtaccggaacgaacgggtacgggttaaccgggggttaccccgggggacgtaaacgggttacgttacccgtacccgtaaggtacgggtaaccccggtacgggtaaacctaacccgtaacgttaaccccgaacggttaaccggtaacccgaacgtacccgttaaaccagggttaacggggtaacgtacggggtaaccgggtaccctaaggtaacggtttagtttaaaccgaacgggtaaaccggtcccggggtttaacctttaacggttccggtacgggtacccgggaaccggggggttcgggggtaacccgtttagggtaaaccggtttacgggttaaaggttttagggttaaccgggg

SEQ ID NO: 229826 - DNA, 744 bp, Homo sapiens
  misc_feature: GYAE6OF01C8FMZ.23.35.D02.1.454.CMB.1.raw
  modified_base (245)..(245): a, c, t, g, unknown or other
  misc_feature (245)..(245): n is a, c, g, or t
  modified_base (505)..(505): a, c, t, g, unknown or other
  misc_feature (505)..(505): n is a, c, g, or t
  modified_base (524)..(524): a, c, t, g, unknown or other
  misc_feature (524)..(524): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggagactcctcttcttggtggcagcagctacacggttccccactcccgaggtcgaccgagccgtgggaacgcctaggtcgtgggaactggaagctaggaagagccggtgggccngagtggacgggttctccgtgcgaacggttctacgtaacggaaactacgtacttcccgtaggatcgagttagtaatactacgtaagtttgggacgaccggacgacggtacccacggtacggtaccgttcggtccgttaggaaggtggtacgtcgggtaccttaacgtacgttaaccgaaccgtaaaggttaacggaacgggtctaaagggttcggaccggtaagtagtacggacggaaggtacgggtacggggtcgggganaacggttacggtccgttanaggttacggaccgtgggaaccttacgacctacgaaccggtaacgacctacgtaccgtaactagggtaccggtaaggacggggtaccggtaccgtaagggttaacgtaacgttaacgaaccggtacgtaccccggtttacgttacgtttccggacggggtccgggtaaaggggtccgggtagtaaggtacctttaaagggggtaacttaagggttaccggg

SEQ ID NO: 229827 - DNA, 986 bp, Homo sapiens
  misc_feature: GYAE6OF01B2J9Y.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcgttggtgcagcagctactacggttcccacctcccgaggtcgacgtagcgtaggagccgtaggtcgtcgggactggagtcgtaggaacggacgcccggtggggccgacgaggttggacggttcctccgtcggacgtaacggttcctacggtaacggaaactaccgtaccgtttcccgaggtacttacggtagtaggtaaacgtttaacgttaccggttaaaggttttcgggggtaccgaccggtaaccgacccggggttaacccgtaaccggttccgggttaaccccggttcccggggttaccttttaggggaaacggttttggggaacggtttaccgggtaaccttaaaccggtttaaacgtttaccccggaaacccgtaaaaggtttaacgggacggtaccgttaaacggggtccggtaacggtaaacgttagtaccggaaaccgggttaaggggtaaccggggtttacccgggggtttacccggggaacggttaaaccggtttaccccggtaacccggtttaaccggtaacggggtaaaccccggttaccgggtaaccccggttaaaccgttaccccggtaaaccccgtaaccccgggtaaacgttaacccggtaacccgttaaacccggttaacccggttaaacggtacgggtaaacggggttccggggaaaccgggttccggttaacggttacggttaaacgtttaccggttaaccggaaacccgggttaaccggttaccccgggtttaccgtttacggcccggtacgggggttaccgggaggggttaccggtaggtttaaggtacgggttaaaggttacgggttaggtaaccgggg

SEQ ID NO: 229828 - DNA, 779 bp, Homo sapiens
  misc_feature: GYAE6OF01DD212.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtcgtgggactgagctagaagaagccgtggggccgcgaggtggagggtctccgtgacgaaggtctcgtaggaaacactacttccctgtatgatgatatacgtaagttgggtgacgacgacggcctacgtacggaccgtcggtccttagaggtggtagtgggactaacgtacgttacgacccgtaaagttaggacggtacgtacggtacgggaccggtaacttaagtaggtacggtaagggtaacggggtacgggggttacccggggggacgtaacgggtacggttcccgtaaccgtaacggttaccggtaacccgttacggggaaccctaaacccgtaacctaccccgaacccgtaaccggttaacccgaaccggttacccgtaaccggtaacggtaaggggtaacgggttacgggggtaaccggggtaccggtaacggtaacggttaacgtttaaccggaaaccggtaccggtaacccgggttttacccgtttaaccggtttccggtcgggtacccggggtacgggggaacggggggttccggttaaggtagggtttaaggtaaagggtttttaaaggtaacgggg

SEQ ID NO: 229829 - DNA, 644 bp, Homo sapiens
  misc_feature: GYAE6OF01CCIMZ.23.35.D02.1.454.CMB.1.raw
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (402)..(402): a, c, t, g, unknown or other
  misc_feature (402)..(402): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctcctgcaaggtctctggaaacacattcctgactgatgatatcaagttgggngcgacgacggccacgtggactcggtcttggagtggagtgggactacagttacgacctaagttaggaggtcagtggacggtactagtcggacgaggacgggtacgggttccggggganaagggacgttccgtaccgagttacggaccgttcgggaactacggaactcccgaacgtaaccgtaaccgacgtaaccctaacgtaaggtagggtaaggttggacgggggtacctagggtaacgttagtttaccgaaaggtacccgtaaccgggttacccgtttactaccggttcggacccgggtacgggtaccgggggtacgggggtaccgtaagggtacgttaagggttaagtttaaacggg

SEQ ID NO: 229830 - DNA, 799 bp, Homo sapiens
  misc_feature: GYAE6OF01DJ3IO.23.35.D02.1.454.CMB.1.raw
  modified_base (182)..(182): a, c, t, g, unknown or other
  misc_feature (182)..(182): n is a, c, g, or t
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
tcagacgcgagtatcacgaccggtgctcgatttagcacacgatagttgggtttggggagcatcactcaacaaccacatctgtcctctagagagaaccctgtgagcacagcctcctcaccatggactggacctggaggatcctcttcttggtggcagcagctacaggttcccactcccaggtncagcgtggagctaggtcgtgggactgagctaggaagaacgtccgtggggcccncgtaggtggtacgggtcctcgtagacgtaacggtctacgtaggaacnctacgttccagacgtagatgtaatcgacgtaaggttgggtgtgacggtacgccgtagtacggtaccgtcggtcttagggaggtcggtaggtacggtactaacgtaacgtaccggaaccttaaagttacgggacggtccgtagggtccgggtacggtaactacggtacgggacgtaaggggtaccgggttacccggggggttaccgggacgaacgggttacccgtccggttaacccggtaagggttacccggtaaccggggtcggtaaaccccacgttacccggtaaccccggaacggttcccgttaaacccgaccgtttaaaccctaacggtaacgggttacgggggtaaccgtacgggggggtaacccggaccttaaggggtaacttaacccggtttaaacggaacccggtaacggttaccccgggttttaccgtttacgttcgggaaaccgggccggggtacggggtacgggttacggacggttaaggttaccgggtttagttaaccggtaaggg

SEQ ID NO: 229831 - DNA, 645 bp, Homo sapiens
  misc_feature: GYAE6OF01BF0DV.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgccagctggagcagtctgggactgagctgaagaagccgtggggccgcgagtggagggtctccgtgcaaggtctcgtggaaacacgtattccctgatgatgatactacgtaagttgggtgacgacgacggccacgtggactccgggtccttggaggttggacgtgggactactaagttaccgaccctaaagttacgaggtcaggtcggacgactatgacgaggaggtacgggttccggggagacggtacgtcgtaccgtacgtacgtaccgtagggacctaacgtacgtacccacgtaccgtaccacgtacctaacgtagtagggtaacggtaggacgggtccgtaggtacggtaacgttacgaaacggtaccgtaccgggttaccggttttaccgttcggtcggaccgggtacgggtaacggggggtccgtagggtaacgttaggttaaaggttacggttaaggg

SEQ ID NO: 229832 - DNA, 948 bp, Homo sapiens
  misc_feature: GYAE6OF01ERVT0.23.35.D02.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (344)..(344): a, c, t, g, unknown or other
  misc_feature (344)..(344): n is a, c, g, or t
tcagacgcgagtatcacgaccggtgctcgatttagcacacgatagttggggtttggggagcatcactcaacaaccacatctgtcctctagagagaaccctgtgagcacagctcctcaccgatcggactggaccctggaggactcctcttcgttggtgcagcagctacctaggttcccactcccaggtgacagctggacgcagtcgngggacctggacgctagaagacggccgtcggggacccgngaggtcggacgggtcctccgtgacgtaacggtcctacgtacggaaaccacgtactttccctaggtattcggatacgtatacgtacgtaacgtttcggggngaccgacgacggaccctacgtaggaccgttcggtctaggacggtggaggtcggtacctacgacttacgacccttaagttacggacggtccgtaacgggtcggaccgtaacgttaacgtcggaaccgaagggtaaccggggttaccgggtttaaccggggacgttaaaccggggtttaacgttccccgtttaaccggttaaacgggtttacccgggtaaacccgggtttaccggggaaaacccgtaccttaaacccggttaccccgaaaaccgttaccccgggttaaaccgtaaccggttacccccgttaaaagggttaaccgggttttaacgggggaaacccgggggtttaaccgggggtaaccgggggttaaccccgttaaagggggttaaccgtttaaccgggttttaaaacccggaaacccggggttaaacccccggggtttaacccggggtttttaccccggttttttaacccgggtttacccgggaacgggggtacccccggggttaacgggggttaaacccgggggggttccggttttaaacggtaccgggtttttaaacgggtttaaaccgggtttttaaaccgggtaacccggggg

SEQ ID NO: 229833 - DNA, 686 bp, Homo sapiens
  misc_feature: GYAE6OF01B1Z4C.23.35.D02.1.454.CMB.1.raw
tcagacgcgagtatcacgaccggtgctcgatttagcacacgatagttgggtttgggggagcatcactcaacaaccacatctgtcctctagagagaaccctgtgagcacagctcctcaccatggactggacctggaggatcctcttcttggtggcagcagctacaggttcccactcccaggtgcagctggagcagtcgtgggactgagcgtagaagaacggccgtagggggccgacgaggtggagggtctaccgtgacgtaacggtctacgtaggaaaccactacgttacccgtagagtacgatagtatacgtactaaggttgggtacgacgacgacggacctacgtcggtaccgtccggtcgttcggaggtggacgtcggtacttacgtacgttaccgacctaaagttacggacggtacgtagggtcggaacggtaccgttacgtacggtacgtaacgggtacgggtaccggggttccggggaacgtaacggtaccggttaccgtaccggtaggtaccggaccggtacgggaacctaccgtacctacccgtaacgtacgtaaccgacgtaccgtaacgtaggtaagggtacgtagggaccggtcgtaggtacgtacgttacgacgtacgtaccggtcgtttacgtcggtcggcggcggtacgggctagtagtacgtagttgtacgg

SEQ ID NO: 229834 - DNA, 688 bp, Homo sapiens
  misc_feature: GYAE6OF01B39CA.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccgaggtgccagctggagcagtcgtgggactggagctgaagaagccgtggggccgcgaggtggagggtctccgtgcaaggttctacgtaggaaaccactacttccctagatgatagtatatacgtaagttgggcgcggaccgaggaccctacgtcggacccgtcggtccgttaggagggttagggagtcgggtaccttaagtacttaaccggacctaaagttaaggacggtcaggtggacgtatagcgacgaggacggtacgggtccgggactaacggtcgtaccgtcgacggtcgacccggtagggtaaccaccgtacaccgaactaccgtaacacccgtacctagtaacggtaggtaacgggtacggacgggtccgttaggaacggttaacgttacgaaaccggtaccgtaccgggttttcccgtttaaccggttcccggtgggcccgggaacgggggttacgggggtaccgttagggtaacgttagggttaaaggtttaaggtaaccgggg

SEQ ID NO: 229835 - DNA, 779 bp, Homo sapiens
  misc_feature: GYAE6OF01BG4CL.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctaggaagagccgtggggccgcgagtggacgggtctccgtgcaaggtctcgtaggaacactacttcctgactgatgattagtacgtaagttgggtacgcgacgacggacctacgtacggaccgttcggtccgtttaggaggtggtagtcggtactacgtacgttaccgacccgtaagttaagggacggtacgtagggtaccggtacggtaacttaggtcggacgtaacgggtacgggtacccggggtttccgggggacctaagggttacccgttaccgtacccgtacggtaccgggtaaccggtagggaaccccgtaacgtacccgttaacccgaaccgtaacccgtaaccgaaccgtacccgttaaacgaacgggttaacggggtaaggttaccggggtaacggggtaccgtaggtaacggttaaccgtttaccgggtaaaacgtacccgggttaacccggtttacccggtttttaaccgttacccgggttcgggtacccggggtacgggggttacgggggttaccggttagggttaaggtttacgggttaaacggttttagggttaaacggg

SEQ ID NO: 229836 - DNA, 558 bp, Homo sapiens
  misc_feature: GYAE6OF01AWNZS.23.35.D02.1.454.CMB.1.raw
  modified_base (223)..(223): a, c, t, g, unknown or other
  misc_feature (223)..(223): n is a, c, g, or t
  modified_base (431)..(431): a, c, t, g, unknown or other
  misc_feature (431)..(431): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgacgggtctcctgcaaggtctctggaaacacattccctgatgatgatatcaattggtgcgacaggccacgtggactcggccttgagtggatggctacattacgccctaagttgaggtcagtgcgactatgcagtagaggttccggggcagagtctcgagtcgaccgtagggacacactccactaccgtaccgagtccctaacgngtagggtacgtaggacggggtccgtagacgtagttaccgaaggtaccgaccgggttcccgttttaagttccgtaggccgggtacgggtacgggggtcggttaggaagtcggtagtttaaagttcggg

SEQ ID NO: 229837 - DNA, 792 bp, Homo sapiens
  misc_feature: GYAE6OF01CYUH7.23.35.D02.1.454.CMB.1.raw
  modified_base (189)..(189): a, c, t, g, unknown or other
  misc_feature (189)..(189): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggagatcctcttcttggtggcagcagctacaggttcccactcccaggtgcagctggancagtcgtgggactgagctagaagaacgccgtggggccgcgaggtggacgggttctccgtgacgtaacggtctaccgtacggaaaacctactactttcccgtagacgtagtatagtaattaagtacgtaaagttggggttacgaccggtaacgacggacccgtaccggttacgggtaaccgtccgggtcccgttagggaacgggttcgggtaaggttcggggtaaccgtttaacgttaacggttaaaccggtacccgtaaaaggtttaacgggacgggtaccgtagggttccgggaacggttacgttaggtacggtacgaagggtacggggtacggggtttacccggggacgtacgggtaccggttacctaccgttacggtaccggtacccggtaacgggtaaccctaacccgtaacgtacccgtaaacggtacccgttaacgaaccgtaccttaaacggacgtacgggtaaacgggtcgggaccgggtacgttaggtaacgttagttaaccggaaacgtacgtacccgggttaccgtttagttccgtacgggtccgggacgggtacggggtcgtaggtagtttcgggaaagtttaggtaacgg

SEQ ID NO: 229838 - DNA, 631 bp, Homo sapiens
  misc_feature: GYAE6OF01BFICP.23.35.D02.1.454.CMB.1.raw
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagccgtggggccgcagtgagggtctccgtgcaaggtctctaggaaacacattcccngatgatgatatcaagttgggtncgacgacggccacgtggacctcggtccttggagtggagtggactacgtattacgacctaattaggaggcgagtcgcggaactagtgcgaggaggtacgggttccggggacaggtacgtcgtacctaagtcggaccgtacgggacctaacgactacccgaacaccgtaaccacggtaccctaacaacggtagggaacgggttcgggaacggggtcgtaggtaacgtacgtttaaccgaaacgggtacccggtccgggttacccgtttttacgttaccggtcggtccgggtacgggacggggggtcgttacgggaagttagggttaacggtttaaggttacggg

SEQ ID NO: 229839 - DNA, 810 bp, Homo sapiens
  misc_feature: GYAE6OF01CKLKT.23.35.D02.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatccctcttcttggtggcagtagctacaggttcccactcccaggtgcagcgtggacgcagtcgngggactgagctagaagaagccgtggggccncgaggtggagggtcctccgtgacgaacggttctactacggaaaccactacttccctgatgatgatatactaaggttgggcgacgacgacggaccgtacgtcgggaccgtcggtccgttaggacggttaggaggtcggtactaacgtagttaccgaaccgttaagtttaacgggacggtaccgtagggtaccggtacgggtaacttaggtacggacgtaagggtaacgggtaaccgggggttacccgggaacgtacggtaaccggttacccgtaccgtaacggttacccgggaacccgggttacgggaaaccccgtaaccgtaacccgtaacccgtaacccgtaacccggttaaccgaacccgtaacccgtaacgtaagggtaacggggttaaaccgggtcgggggtaacggggttaccctaaggtacggttaaaccgtttaccgggaaaccggtaaacccggttacccgggtttacccggttttaccgttaccgggtaccgggtcccggggtaacgggggtaccgggggttaccggtggtaaacggtttagggttaaacgttttacgggtggtaaacggg

SEQ ID NO: 229840 - DNA, 661 bp, Homo sapiens
  misc_feature: GYAE6OF01CP568.23.35.D02.1.454.CMB.1.raw
  modified_base (154)..(154): a, c, t, g, unknown or other
  misc_feature (154)..(154): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggacgtggaccgtggaggactcctcttcttgggnggcagcagctacaggttcccactcccgaggtcgcagctggacgcagtcgtgggactgagntaggaagacgcgnggggccntaggtggaggtctcngacgaaggtcctgaggaacactattccgtgatgatgatanagtagttggngacgacgacggccagtacgctcgggtctggagnggtagnggattacgatacgacctaagtagacgatagngaccggtatagacgagaggtaggtacgggtccgggganacgtacggtcctaacgtacgttacggaaccgtacgggacaacgtaccgtaccaacgtaaccgtaaccgaacggttccctaaacggtacggaaggggaaccggttaggggaacgggtacccgttaggaacgggtttaaacttccggaaaacgggttaccgtaacccggtttaccggggtttaaccctttggcgggaaccccggggtagggacggggtaccggttaagtaggtacgggttaagttaacggtagggg

SEQ ID NO: 229841 - DNA, 664 bp, Homo sapiens
  misc_feature: GYAE6OF01AKCPF.23.35.D02.1.454.CMB.1.raw
  modified_base (226)..(226): a, c, t, g, unknown or other
  misc_feature (226)..(226): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagcctggagcagtctgggactgagctgaagaagccgtggggccncgaggtgacgggtctccgtgctaaggtctcgaggaacacgtacttcccaggatcgatagatatcgtaagttgggtacgcgacgacggcctacgtcggtacgtccggtccttggtaacggtggtacgtcggtaccttaacgtagttacgaccctaagttacggaggtcgaggtcggtaccggtactaggtcggtacgaagggtacgggtacggggtttaccgggacgtaggtaccgtacgtaccgtacgtaccggtacccgtacgggaaccaccgtaccgtaccgacgtaaccgtacaccgtaccgtaacgtaggtacggtaaggtcgggaccgggaccgtagtacgtactttacgaaacgtaccgttacgggttctttaccgttcggtcgtacgggcgggtaacgggtcgacggtaagtacgttaaggtttagtacgg

SEQ ID NO: 229842 - DNA, 651 bp, Homo sapiens
  misc_feature: GYAE6OF01D6I9T.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtcgtgggactgagctagaaagaagccgtgggggccgcaggtggacggggtcctccgtgcgtaaggttctcgtacggaaactactattccctgatgatagattatacgtaagttggggtgacgacagggccacgtgaccgtcggtccttggaggtggagtggtctacgtacgttacgaccctaagttaggaggtctaggtcgacggtactagtgacgaggacggtacggggttccggggacgtaggtacgtccgtaccgtagtacggaccggtaggaacccacctacctacccgaacgtaaccgtaaccgaacgtcctaagacgtagggtaacggtgggacgggtccgtagtaggtacttacggaacgtaccgtacccgggtttccgtttacttcgtccgggacggtacggggtacggggtacgtaggtaaggttacgggttaaggtttaacgtacggg

SEQ ID NO: 229843 - DNA, 636 bp, Homo sapiens
  misc_feature: GYAE6OF01A6XIB.23.35.D02.1.454.CMB.1.raw
  modified_base (225)..(225): a, c, t, g, unknown or other
  misc_feature (225)..(225): n is a, c, g, or t
  modified_base (599)..(599): a, c, t, g, unknown or other
  misc_feature (599)..(599): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacacggttcccactcccaggtgcagctggagcagtctgggactgagctgaagagccgtggggccncgtagtggacgggtctccgtgacaaggtctctaggaaacactacttcctgactgatgatagtactaagttgggtagccgacgacggcccaacgtgggacttccgggtccttggagttggagtgggtctaacgtattaaccggaccctaaaggtttacggaggtcctaggtcgggtacggtactagtcgacgagggtacggacggggttacccggggacgaggtacgttccgtccgaacgtcggtaccgtacgggaccacgaccttccgaaccgtaaccgacgtacgacctacacgtaggaaggtcgggacggggtcctaggagtacgttacgaacggtaccgtacggttccggtttacttcggtcggaccgggngggtacggggtacgtgaaggttcggagtttaggtagg

SEQ ID NO: 229844 - DNA, 712 bp, Homo sapiens
  misc_feature: GYAE6OF01DCTR3.23.35.D02.1.454.CMB.1.raw
  modified_base (271)..(271): a, c, t, g, unknown or other
  misc_feature (271)..(271): n is a, c, g, or t
  modified_base (587)..(587): a, c, t, g, unknown or other
  misc_feature (587)..(587): n is a, c, g, or t
  modified_base (611)..(611): a, c, t, g, unknown or other
  misc_feature (611)..(611): n is a, c, g, or t
  modified_base (668)..(668): a, c, t, g, unknown or other
  misc_feature (668)..(668): n is a, c, g, or t
  modified_base (703)..(703): a, c, t, g, unknown or other
  misc_feature (703)..(703): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggacgtggaccgtggaggactcccttcttcgttgggtggcagcacgctacgtacggttcccacctcccgaggtgcaggcgtggacgtcgtacggtcggtcgggtactgagcgtaggaaacgacggtccggtgggggtaccgtaggtacggnggtccgttcgtcggacgtaacggttcctacggtacggaaacctacgtacctttccgagtacgtaggactagtaatagttacgaggttggtacgacgacgcggtcacggtcggacgtccggtcgtaggtaggtcggtacggtacggcttaacgtaacgtaccgaaccttaaggtacggacgtacggtaggtacggacgtaacgtagtcggacggtaacgggtacgggtacgggttaccggacgtaggtcgtacccgtacgtacgaccgggtacgacggtaccacgccgtaacaccgtacgactacgcgtaacgaggnggtaacgcggaacggtcgtaacgngttacgtaacgacggtaccgttacgtcgtttaccggtagccgggtcgggtaccgggnggggttacctaggtacggttaaggtacgttaaggngggttacgg

SEQ ID NO: 229845 - DNA, 746 bp, Homo sapiens
  misc_feature: GYAE6OF01CXB3I.23.35.D02.1.454.CMB.1.raw
  modified_base (188)..(188): a, c, t, g, unknown or other
  misc_feature (188)..(188): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggaccgtgggagattccttcttcgttggtggcagcagctacgtacggttcccactcccaggtncgagcgtggagcagtcgtgggactgagctagaagacgccggtggggccacgaggtggacgggtcctccgtgacgtaacggtctacgtacggaaaacaccttacttccgtatagtagagtgaattagtacgtaaggttcgggtacgaccgacgacggccgtacgtcggaccgttcgggtacgttggacggtggtagtcgggtacttaacgtacttaaccggacccgttaaagtacggaggtacgtaggtcggaccggtattagcggtacggtaaggtaacgggttccggggtaccgggacgtaagtacgttcctaaccgtagtacggtaccggtacgaccaccgtaacgtacccgaaccgtaaccgtaccgtaccgtaaccgttaacgaggttagggtaacggtacgggtacgggtacgttacggtaaggttaactttaccgaaaccgggttcccgtaccgggtttacccgtttaccgttccgggtacgggacccgggtagggggttacggggttccgttaaggggtagtttaaacggtttagggtttaagttacgggg

SEQ ID NO: 229846 - DNA, 670 bp, Homo sapiens
  misc_feature: GYAE6OF01ETFZG.23.35.D02.1.454.CMB.1.raw
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacacggttcccactcccaggtgcagcgtggagcagtcgtgggactgagctagaagacgccgtgggccngngtgngggtctcngcgagtctctaggaaacnctacttcctagagtgatagtatactacgtaagttcggggtagcggtaacgacggccctaagtcggtaaccgttccggtccgttaggtaggtggtagtcgggtactacgttaagttaccgtaccctaagtacgggtacgacgtaggttacgacggtactagtcgacgtaaggtacgggttaccgggtccggggagtaacggtacgtaccgtaccgtagtaccggtacggtaccggacctaccgtaccgtacccacgtaaccggtcacgtaccgtaacgtacggtagggtaacggtacgggtaacgggtcgtagacgttacgttaacgtaaccggacgttaccggttccgtttacgtcggtccggacgggtacggggagggtccgtaggttagtacggttaggttagtacgg

SEQ ID NO: 229847 - DNA, 953 bp, Homo sapiens
  misc_feature: GYAE6OF01AEC7N.23.35.D02.1.454.CMB.1.raw
  modified_base (142)..(142): a, c, t, g, unknown or other
  misc_feature (142)..(142): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctnttcgttggtggcagcagctacgaggttcccactcccgaggtgcagctaggagcagtcgtgggactgagcgtaggaagacgccggtcggggccacgtaggtcggacggttcctaccgtggacgtaacggtcctacggtacggaaacctacttaccgtttcccgtagtacgtagtaacgttagtaacttaacgttacggttagggtttcggggtacgaccggtacggaccggtacccgtacggtacgggtaccgggttccggtaccggtttagggacgggttacggtacggggttacggttacccgttaaaccgttaaccggttaacccggtaacccgtttaaagggttaacgggtaccgggtaacggtacgggttaccggggtaccggttaacgttaccgggtaacggtaacgggtaacgggttacgggggttacccgggggttccggggaaacgttacggttaccccggttaccgtaaccgttaacgggttaccggtaacccgggtacggtaaacctaaccgtacccgtaacccgtaaaccgggtaaccgttaacccgtaacggttaaccttaacgggttacgggtaaacgggtaacggggtaccgggggtaaccggtacccggtttaaggtaaccggttttccggtaaaacggtacccggggttaaccccggtttaccggggttttaccccgttttaacgggttccgggttaacccgggggtaccggggtacccggggggttaacgggggttcgggtttaacggtaaaccggggtttttagggttaaaggtttacgggttaaaccggggg

SEQ ID NO: 229848 - DNA, 898 bp, Homo sapiens
  misc_feature: GYAE6OF01ETE0L.23.35.D02.1.454.CMB.1.raw
  modified_base (142)..(142): a, c, t, g, unknown or other
  misc_feature (142)..(142): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctnttcgttggtggcagcagctacacggttcccaacctcccgaggtcgcagcgtcgggagcgtaaggtcggtacgggactggacgtcgtaaggaacggacggtccggtcggggaccgcgtaggtcgggacgggttcctccgtacggacgtaacgggttctaccgtaacggaaactaccgttaccttccgtaagtactaggtagttaggtaacttaacttacgtaagggtttgggtaccgacggaacgccggtaccgacggttcggtaccgttccgggtacttagggaggttcggtaggtcggtaactacgttacggttaaccacccgttaaaagttacgggcggacgtaacggtaccggtacgtaacggttagtacggaggtaagggttccgggtaaccgggggtaccgggacggttacggttaacccgtccggttaacccgtacgggacccggtaacgtaccgggtaacccaaccgtacccggttaccccgaaacggtaacccgtaacgtaacccggtaaccgttaacgggaacgggtaggggtaaaccggggttccggggaacccgggttccggtaaaggtaacccgggtttaaagtaacccgtaaaccggggtttaccggtaacccggggtttttacccggttaaccggtttccccggggtaaacggggttcccggggaacgggggggttacccgggggttaacggttacggggtttaaaggtacggggttttaaagttaaggggttaaaccgggg

SEQ ID NO: 229849 - DNA, 717 bp, Homo sapiens
  misc_feature: GYAE6OF01CZOQV.23.35.D02.1.454.CMB.1.raw
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctgggaggatcctcttcttggtggcagcagctacaggttcccactcccaggtcgcagccgtggaagcagtcgtgggactgagacgtgaagaacgccggtggggccacgtagtggacggtcctcgngacgagtctcgacgaacactacttccngactgtagtcgtatactactaacggtttgggacgtaccgacggacggaccgtacgtacgggtaccgttccggtccgtaggacggtgggacgtcgggtactaacgtaacgttaccgtaacccgtaaagttacggacggtacgtaggtacgggaccggtaatcgtacggacgtaggtaacgggtacggggtccgggaacgtacggtacgttcctacgtaacgtccggtaaccggtacggaacctacctaccgttacccaaccggtaaccgtaccgtaccggtaaccgtacgaacgggtaggggtaccggtaacggggtacggtacgtaggtaaccgttacggttaacgaaccggtaccgtaaccgggttcccttacggtcggtcggggacccggtagggagggtaccgtaggaggttaaacggtagttacgggtaagg

SEQ ID NO: 229850 - DNA, 810 bp, Homo sapiens
  misc_feature: GYAE6OF01D1TH9.23.35.D02.1.454.CMB.1.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
tcagacgcgagtatcacgaccggtgctcgatttagcacacgatagttgggtttggggagcatcactcaacaaccacatctgtcctctagagagaaccctgtgagcacagcctcctcaccatggactggacctggaggatcctcttcttggtggcagcagctacaggttcccactcccaggtgcagctggagcagtctgggactgagcctagaagaacgccgnggggcccgcgaggtggacgggtcctccgtgcgaaggtctactacggaaaccnctacttcccgtagatgatggtaattatacgtaagttcggggtgaccgtaacgacggcctacgtacgggaccttacgggacgtttaggagggtacgggaacggttggggtacctaaacgtagtttaacccggaccccttaaaaggtttaacggacgggtaaccggtaggttacgggaccggtaaacttagtacggaccggtaagggtaacgggtaccgggggtttaccgggggaccgaaggggtacggttacccgtaccgtacgtaccggtaaccggttacgggaaccgtaaccgtactaaccccggtaaccgaacccgtaaccgtaacgtacccgttaacgtacggtaaggggtaaccggttaggggaaccggggtacccgtgggtaaccggttaacgtttaccggtaaaaccggtaacccggtaacccgggtttaccccgttttaaccggtttaccgtcgggtacgggtaccggggtaacggggggtccggttaacggttaacgggtttaggttaaacggtttaaggttaagggg

SEQ ID NO: 229851 - DNA, 750 bp, Homo sapiens
  misc_feature: GYAE6OF01EMHYV.23.35.D02.1.454.CMB.1.raw
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (707)..(707): a, c, t, g, unknown or other
  misc_feature (707)..(707): n is a, c, g, or t
tcagacgcgagtatcacgaccggtgctcgatttagcacacgatagttgggtttggggagcatcactcaacaaccacatctgtcctctagagagaacctgtgagcacagcctcctcaccatggactggaccgtggaggactcctcttcgttggtgcagcagctacgtacggttcccactcccgaggtcncagcgtgacgcncgtcgtgggactgngcgtagaagacgcgtgggccgngaggtcggaggtcnccgtgacgtacgtctacgtaacggaaacctcgtaccttcgtacgtagtgtatagtacttaagtacgtaggttcgggtcgacgacggaccgtacggtacgtacggtaccgttccgtaccggtaggtacggttacgggacggttcggtacccgtaacgttacgttaacccggtaacctaagggttacggcgttacggaacgggtttcgacgttaacgtacgcgggtaacggtacgggtaacgggttacggggtaccgggtacgtaccgggtacgttacccgtaacgtaccggtacccgggtaccggtacgggtaaccctacccggttaccgtacccgaacccgtacccggtaacaacccgttaccggtaacgtacgggtaacggtacgggtcgggtacggctaacgtcggtaacgtactaccggtaccgttcggttacttccgtacggtcggtaccggngggtacccgggtagttacggtagtacgtttagtgggttaacgg

SEQ ID NO: 229852 - DNA, 704 bp, Homo sapiens
  misc_feature: GYAE6OF01EN9AH.23.35.D02.1.454.CMB.1.raw
  modified_base (266)..(266): a, c, t, g, unknown or other
  misc_feature (266)..(266): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacacggttcccactcccaggtgcagctggagcagtcgtgggactgagctagaagaagccgtggggccgcgagtggagggtctccgtgcaaggtctcgtaggaaacnctacttcctgtatgatagtatatacgtaagttcggggtcgacggtaacgagggtacctacgtcggaacggttccggtccgttaggaggtggtagtcgggtacctaacgtaacttacgacccgtaaagtttaacgggaacggtcgtaagggtcgaccgggtaacttaacggtcggtacgaaggggtacggttaaccggggttccggggacgagggtacgttaccgtccgtaagtacccggtacccggtagggtaaccacgtaaccctaccgtaaccgaccgggtaacctacgacccgtaacacgtaggggtaacggtcgggaacggtccgtaggaacgttagttaaccgaacgtaacgtaccgggtttaccgtttaccgttcggtgccgggtaacggggggacgggtctagggtaacctgggttaaagttaggtacggg

SEQ ID NO: 229853 - DNA, 707 bp, Homo sapiens
  misc_feature: GYAE6OF01A1QTM.23.35.D02.1.454.CMB.1.raw
  modified_base (181)..(181): a, c, t, g, unknown or other
  misc_feature (181)..(181): n is a, c, g, or t
  modified_base (228)..(228): a, c, t, g, unknown or other
  misc_feature (228)..(228): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtncagctggagcagtcgtgggactgacgctgaagacgccgtgggggccncaggtggacgggtcctccgtgacgtaaggtctacgtaggaaaccactattccctgacttaggactaggaattactacgtaagttcgggtacgaccggaacgaacgggcctaacgttacgggtaaccgttcggtacccgttaggtacggtcgggtaacgttcggggccttaacgtaacgtttacggaccccgtaaagttaacgtaggacgtaggtcggaccggtacctagtaggaccgaagggtacgggtacggggttccgggggacgaacggtaccggtccgtacgtaagtccgtaccgggtacgggaaccctacggaactcccgaacgtaccgtacacggtctaacgagtagggaacggtaggaccgggtacgtgaagtaccgttacgaaacgtaccggaacggttcccggtttaacgtcggtccggacgggtccggggacggggtctacggaagttagtacggtttaaggtaacggg

SEQ ID NO: 229854 - DNA, 743 bp, Homo sapiens
  misc_feature: GYAE6OF01DOL1P.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtcgcagctggagcagtctgggactgagctagaagaagccgtggggccgcgaggtggacggtctccgtgcgaacggtctcgtaggaaaccgactacttccctagactgactagtatactactaagttgggtcgacgacgacggccgacgtacggtaccgtcggtccgtggagtggtagtcggtctaacgtattacgacctaagtaggaggcgtagtcggacgtactagtgacgaggtacgggtacgggttccgggacgtacggtacgttaccgtacgtacgtacggaccgtagggaaccctacgaccgtaacccctaaccgaacgtaccgtacgtaccgtaaccgtacggtaacgggtaacgggttacgggtacggggtaacccgttgggtaaaacggttaacgtttaaccggtaaaccggtaaacccgggtaacccggttttaccccggttttaaccgtttccgggttacccgggtaccggggtaacccgggggtaacgggggggttacccggttaagggtaagggttttacggttaaaaggggttttacggtttaaacggggg

SEQ ID NO: 229855 - DNA, 775 bp, Homo sapiens
  misc_feature: GYAE6OF01DF59X.23.35.D02.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggagactcctcttcgttggtggcagcagctacaggttcccactcccgaggtcgcagctggagcaggtcgngggactggagcgtagaaaggacgccggtggggcccagtaggtcggacgggttcctccgtaggacgtaacggttcgtacgtaaggaaacctacgttactttaccgnggtataggatagtaacgttactacgtaaggttcgggtacgacggaaccgcggacccgtacggtacggaccgtccggtcgttaggaaggttgggacgttacgggtactaacggtacgtaccgaaccgtaaagtacggacggtactacgggtacgacggtaacgtagtacggaacggaacgggtaacgggtacggggttacccggggaagtacggtaacgttacccggtaaccgtacgtaccggaaccggtagggtaaacccaaccgtacgtacccgtaacggtaaccgtaccgtaaccggtaccctaaggtaacggtacgggtaacggtacgggaaccgggtacttaacggggaactttacggttaaccgaaccgttacccggttaccggtttacccggtttaacgtcggtacgggtaccggacggggtacggggtactaggttaggtaacggttaagtttaggtacggg

SEQ ID NO: 229856 - DNA, 793 bp, Homo sapiens
  misc_feature: GYAE6OF01CVDHE.23.35.D02.1.454.CMB.1.raw
  modified_base (181)..(181): a, c, t, g, unknown or other
  misc_feature (181)..(181): n is a, c, g, or t
tcagacgcgagtatcacgaccggtgctcgatttagcacacgatagttgggtttggggagcatcactcaacaaccacatctgtcctctagagagaaccctgtgagcacagcctcctcaccatggactggacctggagatcctcttcttggtggcagcagctacaggttcccactcccaggtncagctggagcagtccgtgggactggagtctaggaaacgaacggccggtcggggcccgcgtaggtcggacgggttccttccggtagaccgtaacggttcctaccggtaacggaaaaccaccgttaacctttaccccgtaggtaacgtaggtagtaggtaacttacgtaacgttaaggtttggggacgaccggaacgacggtaccgtacgtaccggtaccggttccggtaccgttagggtaaggtcggtacggtcggtacttaacgtacgttaacgtaccgtaaagttggacgtacgtaggtacggtacggtaacgtagacggacgaagggtacgggtacggggttaccgggacgtaacggtacgttccgtacggtaacgtaccggaaccggtacgggaacctaaccgtaccgtaacccgtaaccgtaaccggtaccaaccggttaccgtaacggttaaggtaacggggtaacggttaccgggacgggttaccgtaggtaaacgttacgttaaccggacgtacccgttaccggtttccggtttactcggtcggtaccggggtacgggtacggggttacgtacggtaaggtttacggtaacggttaaggtacggg

SEQ ID NO: 229857 - DNA, 815 bp, Homo sapiens
  misc_feature: GYAE6OF01AOLQU.23.35.D02.1.454.CMB.1.raw
tcagacgcgagtatcacgaccggtgctcgatttagcacacgatagttgggtttggggtaggcatcactcaacaaccacatctgtcctctagagagaacccctgtgagcacagctcctccaccatggactggacctggaggatcccttcttcgttggtcggcacgcaggtctacgtacggttccccacctccccgtaggtgaccgtgccgttggggaatccgaagttggtcggggtactggaagccgtagaaacggagtcccgtaggggcccgcagggttggaggggttccctcgtagtaccgaacggtccgtcgttaacggaaacacctaccttaccgtggatcgtaatggaacttatactaagttgggtacggacgccgaacggtccgtacggttacggaccgtccggtaccgttggtaacggttggaggtacggtacgtaacgtacgttaccggacctaagttaaccggaggttaccgacggtgaccggtactagccgtaggaaggacggtaccgggtacgggtcgaacggttacgtaccgttaccgaacgttacggtaccggttacggaacgtaccgtacgtaccccgtaacgtaccggttaacacggttacccgtaacctggtaaccggggtacggtaacgggtacggggttacctagggtacggtaacggttaacctaaccgggtaacccggaaccgggttttaaccccggtttccgttacggtaccccgggttaccgggtacgggggtaacccgggggtttccgggtagggttaaccggtttaccgggttaggttagggttaaaccggg

SEQ ID NO: 229858 - DNA, 697 bp, Homo sapiens
  misc_feature: GYAE6OF01B05RB.23.35.D02.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
tcagacgcgagtatcacgaccggtgctcgatttagcacacgatagttggggtttggggagcatcactcaacaaccacatctgtcctctagagagaaccctgtgagcacagctcctcaccatggactggacctgggagactcctcttcgttgggtgcagcagctacgacggttccccacgtcccgaggtcgcagcgtggancaggtcgtgggactgagtcgagaagacgtcgtgggccagaggtcggacggtcctcgtgacgtaggtctacgtacgacactacttccngatgatgtactagtacgtagttcgggcgacgtacggacgtaccgacggtcggtacgtcggtcgtaggacgtgggtagtcggtactgtacgtacgtacgtagtacggacggcgtacgtggtaacgtaccgtaggtcggacggtacggtaggggtccgggtacggtaggtaaccgtcgttaccggactaaggtccggtaccgtacggtacccaacgtccgtaacccncggtaaccgntaaccggtccgtaaggtaacggtagggtacgggacgggttacggtccgtaggtaccgttaaacgttacggaaaccggtaccggtttaccggttccgtttagcccgggttaggacccgggggtaccgggttaggggtccgttaaggtagggtttacctaaaggggttgtaacgggg

SEQ ID NO: 229859 - DNA, 803 bp, Homo sapiens
  misc_feature: GYAE6OF01CFYW7.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatcggactacggaccgtgggacgacttccttctttcgttggtcggcagcagctacgacggttcccacctccgagtcgcagcgtggacgcgtacgtcggtacgggactggacgtaccgtaggaaaacggaccggtccggtaccggggggacccgtaggtagggtaccgggtaccgggtccttccggcggtaccgtaacggtttccgtacggaaacggaaaccgtaccgttaccgttaccgtagtacgtacggattaagtaacttaagttaccgttaagggttccggtaacggaccggaacggtacggacccgtaaggtccggttaaccggtccgggttacgttagggaggttacggtacggtaccggtaactaacgttaaccttaccggaacttaaggtaacggcgtaacggtacggtacggacggttacagtacgaacggacggaacgggttaccgggtcgggaagtccggtacgtacctacggtaacgtacggaccgggtacgtaaccgtaccgccgtaaccgtacgaacaccgtacgtaccgtaggcggtaacgggtaacggtcggtaaccggtgtacggtaccgtacgttaaccgacgttaacccggtacgtttccggtaacgttcggacgggtaccgggtggggtacggtacgttaaggtaggtacgttaaacgtggtacg

SEQ ID NO: 229860 - DNA, 702 bp, Homo sapiens
  misc_feature: GYAE6OF01BE6H8.23.35.D02.1.454.CMB.1.raw
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
tcagacgcgagtatcacgaccggtgctcgatttagcacacgatagttgggtttgggagcatcactcaacaaccacatctgtcctctagagagaaccctgtgagcacagctcctcaccatggactggacctggaggatccttcttcgttggtggcagcagctacgaggttccccacgtcccgaggtgcagcgtggagcgagtcgtagggctgagctaggaagacggtccgtggggcccngtagtggcgggtacctccgngacgaggtcctgtacggaaaccacgtacttcccgtanagtacgatgattatacgtaagttgggtcgacgacgacggacctacggtcgtaccgtccgggttcgttaggacggtaggtacggtcggtacgtactacgtaaccgtaccgtaaggttacggacgtacgtacggtcgtacgtaactggtccgacgtagggtaacgggtaccgggttcgggacgtacggtacggtacctaccggtaacgtacgggtaccgtaccgggtaaccaccgtacctaccgaaccgtacgaccgtacgtaccgtacgtaggtaggtaggtacgggtacggtacgtgtaacgttacgtaacgtacgtaccgttaccgggttcccgttaacgttcggtcgggacgggtacggggtacgggtacgtagttaccggttaggttaacgttaggttaccggg

SEQ ID NO: 229861 - DNA, 740 bp, Homo sapiens
  misc_feature: GYAE6OF01A042B.23.35.D02.1.454.CMB.1.raw
  modified_base (286)..(286): a, c, t, g, unknown or other
  misc_feature (286)..(286): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagcgtggagcagtcgtgggactgacgctggaagaagccgtgggggccgcgaggtggacggggtcctccgtgacgtaaggtctacgtaggaaaccactacttccngatgagtgatatacgtaagttggggtgaccggacgacggtcctacggtggtaccgtccgggtccttaggaggtggaggtcggactacgtacgttacgacccttaaagttacgggacggtacgtaggtcggaccggtaacgtagtcggacgacgggaacgggtaccgggggttacccggggacgtaacggtacgttacccgtaccggtaacggttccggaacccgggttacggaaaccctaccgtaacccgtacccgaacgttacccggtaacacccggtaacccgtaacgtaagggttaacgggtaacgggttaccgggacggggttaccctagggtaacgttacgttaaccggaaaccgtaccggtacccggtttaccgtttaccgtcggtcgggaccgggtaccggggtacggggtcggtacggtaggttggtttaaacggttaggttacgg

SEQ ID NO: 229862 - DNA, 676 bp, Homo sapiens
  misc_feature: GYAE6OF01B0LVN.23.35.D02.1.454.CMB.1.raw
  modified_base (242)..(242): a, c, t, g, unknown or other
  misc_feature (242)..(242): n is a, c, g, or t
  modified_base (348)..(348): a, c, t, g, unknown or other
  misc_feature (348)..(348): n is a, c, g, or t
  modified_base (597)..(597): a, c, t, g, unknown or other
  misc_feature (597)..(597): n is a, c, g, or t
  modified_base (629)..(629): a, c, t, g, unknown or other
  misc_feature (629)..(629): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttccccactcccagggtgcagcgtggagcgtaggtcgtgggacctgacgcgtaggaaggaacgccggtcgggggccncgaggtggtacgggtcctaccgtgacgaaggttcctacgtaggaaacctacgtacttccgtgtatgatagtactactacgtaaggttggcgacggacgacggaccncgtcggtaccgtaccgtcgttaggacggttaggcggtcggaccttaacgtaacgttaccgaccgtaaagtacggacggacgtacggtcggacggtaactgtagacgagggtaacgggtccgggttccgggatacggtacgtcctacgagtcggaccgtacggtaaccacctacgtacccgagtacccgtaaccgacggtacctaaggtcggtagggtaacggttcgggacggtccgtagacttacgtanaacgggtcctcgggtttccgttagcgtcgggnggtaccgggggtagggtctacgtaaggttaggttagttaggtacggg

SEQ ID NO: 229863 - DNA, 720 bp, Homo sapiens
  misc_feature: GYAE6OF01CJERU.23.35.D02.1.454.CMB.1.raw
  modified_base (239)..(239): a, c, t, g, unknown or other
  misc_feature (239)..(239): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggactcctcttcttggtggcagcagcctacgacggttcccactcccgaggtcgcagcgtggacgcaggtcgtagggactgagctaggaagacggccgtggggccngaggtggacggtctccgtgacgtaaggtcttacgacggaaacacgtacttaccgtgtatagatagatacgtagtagtttggacgacgacgacggcctacgtggaccgtcggtcgtaggaacggtggacgtacgggtactaaccgtagtaccgtaccgtaaagtaggacggacgtagtcggaccgtatacgtcgacgtaggacggtaccgggttacggggactacggtacgtctacggtaagtaccggtacgtacggggaacctacggtaccttacgaaccgtaacgttaaccgaaccgtaccgtaaccgtaggtaaccgggtaacggtacggggtaaccgggaccgttacggtaacggtaccgtttaacggaaaccggtaaccgtacccgggtttacccgtttaacggtccggtacggtaccggggtacggggagggggttacctagggtaacgttaggttaacgtttaacgggttaaggg

SEQ ID NO: 229864 - DNA, 835 bp, Homo sapiens
  misc_feature: GYAE6OF01C6D9K.23.35.D02.1.454.CMB.1.raw
  modified_base (252)..(252): a, c, t, g, unknown or other
  misc_feature (252)..(252): n is a, c, g, or t
tcagacgcgagtatcacgaccggtgctcgatttagcacacgatagttgggtttggggagcatcactcaacaaccacatctgtcctctagagacgaaccctgtgagcacagcctcctcaccagtggactggaccgtggaggactccctctttcgttgggtggcagcagctacgacggttcccacgtcccgaggtcgcgagcgtggagctaggtccggtgggactgacgcgtagaacgacgccggtacgggccncgtagtggacggtcctccgtagacgtaggtcctacgtacggaaaccaccttacttccgtagtacgtaggtagtacgtaattacgtagtaacggttcggggacgaccgaacgcggtaccgtacgtacgggtcctcgggtacgttaggtaggtacggtagtacgggtacgtaacgttagtaccgtaacctaaggtttagacggtacgtacgggtacggtacggtaaacgtacgtcggtaacggtacggggtaacggtacccggggttaaccgggtacggtaacggtacccgttacgtaccgtaggtacccggtaaccgggtaccgggtaacctacccggtaactacccgtaaaccgtacgggtaacctaaccgtacccgttagttaaccgggtaaggggtaaccgggttacgggtaaccgggttaccgtaggttaaccggttaacgttaaacccggtacggtaaccgggtttacccgttaacccgggttttccgtaccggttaccgggttacccggggtaccggggtaggggttaccggttaacggtagggtttaccggttaaacgggtttaggttaaaccgggg

SEQ ID NO: 229865 - DNA, 755 bp, Homo sapiens
  misc_feature: GYAE6OF01C0JXT.23.35.D02.1.454.CMB.1.raw
  modified_base (246)..(246): a, c, t, g, unknown or other
  misc_feature (246)..(246): n is a, c, g, or t
  modified_base (595)..(595): a, c, t, g, unknown or other
  misc_feature (595)..(595): n is a, c, g, or t
  modified_base (606)..(606): a, c, t, g, unknown or other
  misc_feature (606)..(606): n is a, c, g, or t
  modified_base (700)..(700): a, c, t, g, unknown or other
  misc_feature (700)..(700): n is a, c, g, or t
tcagacgcgagtatcacgaccggtgctcgatttagcacacgatagttgggtttggggagcatcactcaacaaccacatctgtcctctagagagaaccctgtgagcacagctcctcaccatcggactggacctggaggatcccttcttcgttggtggcagcagctacgaggttcccactcccgaggtgcagcgtggacgcgagtccgtgggactgacgtcgtaggaaagacgcccggtggggcccgngtaggttgggaccgggttccttccgagtaccgtaacgggttccgtacgtaaaccggaaaacctacgttaccgtttcccgtaggtaacgttcgaaacggttaggttaaactttacggttaaaccgttaagggtttccggggtaaccgacgaaccggtaccgggaccgttaccggtacgggtacccggttccgggtaccgtttacggggagtcgggttaacggtcggttacccttaaacgtaggttaccccgtaacgttaaagttcgggacgtaacgtgggtaccgaggttacttagcggtagagggtaccggaccgggtcgaggtcgtacgtcctaccgagttacccggngacggtaaccncaacggccaacgtaaccgcacgtacctaggtacggtaggacggtggacggtctaggtagttaactaccggacgttacccgacgtttaccgtttntcggcgggacggtacgggggttacgctaagggtgttaaaggttgtttacggaagg

SEQ ID NO: 229866 - DNA, 963 bp, Homo sapiens
  misc_feature: GYAE6OF01BGZ2H.23.35.D02.1.454.CMB.1.raw
  modified_base (876)..(876): a, c, t, g, unknown or other
  misc_feature (876)..(876): n is a, c, g, or t
tcagacgcgagtatcacgaccggtgctcgatttagcacacgatagttgggtttggggagcatcactcaacaaccacatctgtcctctagagagaaccctgtgagcacagcctcctcaccatggactggactggaggtatcctcttcgttggtggcagcagtctacgtcggttcccacgtcccagggtgctagtcgtggacgcgtagtcgtagggtactggacgtactagaagtacggtccggtcgggggaccacggtacggtcgggtaacgggttcctccggtacgtccgtaaacggttccctcggtaaaccggaaacctaccgtttaccgttacccgtaggtacttacggtatacggttaaactttcgtacgttaagggtttccgggtacggaaccggtacgacccggttccgaaaccgggttcgggacccgttttaacggtcccggtttagggtacggttacgggttacggtaaccgggttcttaaacggttaaaccggtttaaccccaacggttttaaaggtacgggtaccggtacgtaacggggtccggttaacggttaaccggtggttaccggaacggtaacggggttaacccggggtaccggggtacgggtaccggtaacggtttaccgttcccgttacccgggtaacgttaccccgggttacgggtaacccgggtaccgtaaccgtacccgttaaccgaacccggttaaccggtacccgtaccgggttaacttaaccgggtaaccggttagggggtaaacgttcccgggggtaacccggttagtaacgggttaaccttacgggttaaacccggaaacgggttttcccggtaaaccccggggtttttaccgtttaaccgggttacccggngggggttacccggggtaacggggttaaccgggggttcttaaaccgggtaaggtttacgggttttaaacgggttcgtttaaacggggg

SEQ ID NO: 229867 - DNA, 783 bp, Homo sapiens
  misc_feature: GYAE6OF01DFTA8.23.35.D02.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (273)..(273): a, c, t, g, unknown or other
  misc_feature (273)..(273): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggactccttcttcgttggtggcagcacgctacgtacggttcccacctcccgaggtgccagcgtggancgagtcgtgggactgagtcgtagaacgaacggccggtcggggcccgngtacggtggtacgggtccttaccgngaccgtaaggttcctacggtaacgaaacacgtaccgttccaggtacttaggatacggtaattacgttagtaacggttgggtacgccggaccggacggtaccctacggtaccgggaccgttccggtacgttaggtacggtagggtacggtaggtacctaacggtacttaaccggacctaaagttacgggacggtacgtacggtacggtaacggtacttagtcggaacggaacgggttagggtaccggggttacccggagtaacgttaccggttccgtacggtaacgtttcgggaacccggtaacggacctacgtaccgacccgtaacggttacgaaccgtaccgccgtaacgtaagggtccggtaagggttccggaacggtttcccgaggttaacgttaaccggttaacgaaaccgggtaccgttaccggggttaaccttttccggaggtacccggggcggtacggggtacgggttgtaaccggttagtacggtttaaagtccggttaggg

SEQ ID NO: 229868 - DNA, 688 bp, Homo sapiens
  misc_feature: GYAE6OF01ACPN5.23.35.D02.1.454.CMB.1.raw
  modified_base (252)..(252): a, c, t, g, unknown or other
  misc_feature (252)..(252): n is a, c, g, or t
tcagacgcgagtatcacgaccggtgctcgatttagcacacgataggttggggtttggggagcatcactcaacaaccacatctgtcctctagagagaaccctgtgagcacaggctcctcaccatggactggacctgggaggacttccttcttcgttgggtcggcaggcagctacgaggttccccacgtcccagggtgcaggcgtgggacgcaggtcgtgggacgtgacgcgtagaagacgccgtaggggcccngaggtggacgggttcctccgtaggaccgtaaggtcttacggtacggaaacctccgtaccttcccgagtacgtagtagtacgtaactacgttaccgtaaggtttcgggtacgaccggtacggacggcctacggtcggtacgtccggttacgtaggtacgggtggtacggtcggtaccttagtacgttacgacctaaggtacggacggtacgtaggtcggacggtactagtcgacgaggtacggtcgggtccgggagtacgtacgtaccgtacgtagtaccggtacgtacgacaccgtctaccgacgtacctacgactaccgtaagacggtacgggtaggtcggcgggtactaggtacgtagtaccgacgtacgtcccggttcgttagtcggtggcccgggtagggtgggtaccgtgtacgttagttggttgtacggg

SEQ ID NO: 229869 - DNA, 651 bp, Homo sapiens
  misc_feature: GYAE6OF01CGHDB.23.35.D02.1.454.CMB.1.raw
  modified_base (235)..(235): a, c, t, g, unknown or other
  misc_feature (235)..(235): n is a, c, g, or t
  modified_base (554)..(554): a, c, t, g, unknown or other
  misc_feature (554)..(554): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcgttggtgcagcagcctacaggttcccactcccgaggtgcagcgtggagcagtcgagggactgacgctaggaagacggccgtcgggggccncgtaggtgggcgggtccttccgtggcgtaacggttcgtcgtaacggaaacctacttaaccgtttccctaggactacggtataggtaactactagtaaggttggtcgacgacggtcgaccgtacgtcgacgtccggtcgtgacggtggagtcggactactacgtacgacctaagtagacgcgtaggtacgacgtacgtcgcgagtaggtacgggtacgggtccgggagacgttacggtccacgtacgacgtcgggaacgtacaacctacgtaccaacgtacgacgtactaccgacgtaggacgggtaggacgggacggtntaggtacgttacctaggacgtaccctaccgggttacctttcgtaccgacgggccgggaagggtaccgggtctagtacggaggtttacgtaggtacgg

SEQ ID NO: 229870 - DNA, 743 bp, Homo sapiens
  misc_feature: GYAE6OF01EW08M.23.35.D02.1.454.CMB.1.raw
  modified_base (656)..(656): a, c, t, g, unknown or other
  misc_feature (656)..(656): n is a, c, g, or t
tcagacgcgagtatcacgaccggtgctcgatttagcacacgatagttgggtttggggagcatcactcaacaaccacatctgtcctctagagagaaccctgtgagcacagctcctcacatcggactggacctgggaggtactcctgtttcgttgggtcgcagcagctacctacggttccccactcccgaggtcacgtcgtctggacgcgtagtccggtagggtacaggacgccgtaaggaaaacggtccggtcccgggtaccgggccgtacgtagggtcgggtccggttacctccgttaggaccgtaacgggttacctacggtaaccggaaactaccttacccttccgtaagtcgtaggtaattaacgtacttacgtacgttaagggttccggtacggacccgtacgggtaacgccgtaacggccgtacggttccggtctagggtctagggtacgttcggaacttaacgtagttaaccgtacgttaggtacacggtacgtccgaggtaacgtactagcgggtaacgacggtacgggtaccgggtacgggtgtaacggtacgtaccgtacgtacggtacccgacggtacgtaacccacggtaccctaccgaaccggttaacacaccgtacgtaacggtaggaacgggtaggtacgggngtacgtagaccgttagtacgtacgtaacgtcgttacgtcgcgtcgggacgggtagggtcggtacgtacgtataaggtttgaaggttg

SEQ ID NO: 229871 - DNA, 870 bp, Homo sapiens
  misc_feature: GYAE6OF01AN1YH.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcgttggtggcagcagctacgaggttcccactcccaggtcgcagctggacgcagtccgtgggactggacgcgtagtaacggaacgccggtcggggccacgtaggtcggacgggtcctccgtgacgtaacggtctacggtacggaaaacctcgtacgttcccgtgaacgtcgtatatacttaacgtcgtaacggttgggtcgaccgacgtacgggccctaacgtcggtacgtccggtaccgttggacggtaggtagttaccgggtaccttaacggtaacgtacccgtaacccgtaaaggttacggacggtacgtacggtcgggaacccggtattaacggtcggaacggtacgggtaacgggttacccggggttaccgggaaccgtacggttaacccggtcccgttaacccgggtaacggttacccgggtaacccgggttaaccggaaacccgtacccgttaaccgaccccgtaaacccggttaccggtaacccggaccggttaacccgtaacggttaaccggggttaaggggaaaccccgggtttaacggggaccggggttacccgtaaggttaaccggttaaccggttaacccggaaccgggttacccgggtttacccggtttacccgggtttaaccgtcgggttcccgggacgggacccgggggtttacgggggtacccggttaggtaaaccgggtttacggttaaaccggttaccggtaacgggg

SEQ ID NO: 229872 - DNA, 811 bp, Homo sapiens
  misc_feature: GYAE6OF01EJPEH.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcgttggtggcagcagctacacggttcccactcccgaggtgcagcgtggagcagtcgtggactgagctagaagacgccgtcggggccgcgaggtggacgggtcctccgtggacgtaacggtctacgtaacggaaacctacctacttcccgtagtactagtatagtattagtacgtaaggttggggtacgaccgacgaccggtaccctacggtacggtaccgtccggtccggttaggtacggtagggacgttcggtaccttaacgtacgttacccggaacccgtaaaggttaacggacggtacgtagggtacggtacggtaaccgttagtacgggaaccgtaagggtaacggggttacccggggtccgggtaacggtacggtaccggttaccgtaccgtacggtacccggttaccgggtaacgggtaaccctaaccgtacctaccccggtaaaccgtaacccggtaaccgtaacccggtaaccgtaacggtaacggttacggggtaacgggtaccggggtaacgggtaccgttaggtaaccggttaacgttaaccggaaccggtaaccggttaccggttacccgttttacggtccggttacgggaccggggtagggtaccgggggtacgttacgggtaaggtttacggttaaagtttacggtaacgggg

SEQ ID NO: 229873 - DNA, 779 bp, Homo sapiens
  misc_feature: GYAE6OF01DZJKF.23.35.D02.1.454.CMB.1.raw
  modified_base (103)..(103): a, c, t, g, unknown or other
  misc_feature (103)..(103): n is a, c, g, or t
tcagacgcgagtatcacgaccggtgctcgatttagcacacgatagttgggtttggggagcatcactcaacaaccacatctgtcctctagagagaaccctgtgngcacagctccctcacctatcggacgtcggacctcggaggtactcctcgtttcgttgggtcggcagcacgtcgtacgtaccggttccccaaccgttcccgtaagggtccgcgagcggtcggatccgtaggttccgtgggtacctgacgtactaaggaaggtacgccggtacgggccgtacggaggttcggacggttccttcgcgtaacgtagttccgtaacgtaacggaaacctaccgtttaccgttcccgaagtacgtaggtactacgttacgttagtttaccgtagggtttcgggacccggtaggaacccgaccgggtaccgtaccggttacgggacccggtttcggtaacccgttggggtaacgtcggggtttaagttccgtttaacaacggttacgaccgtttaaggacggtacgtacggtggtaccggtacggtacgtactcgggtaacggtacggttaacggggtccggggtaccgaagggttacacggttaccacggtacttacggtacgccggtacgactacgtccacgtactcgccaagtacgtaggtacggtagcgggacgtacgttgtaacgttctaaaccggaccttagtcccggtttcgttaacggtcggagggcccggttggggacccgtcgttaggacgggttatggttcgtagtacccggg

SEQ ID NO: 229874 - DNA, 500 bp, Homo sapiens
  misc_feature: GYAE6OF02GSQZZ.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccgcagtgagggtctcctgcaaggtctctggaaacacattcccctgatgatgatatcaattgggtgcgacaggccactggactcggccttgagtggatgggctacattagcccaattagaggcagtgcggactatgcagagaggttccgggcagagtctcatcgacgtgggacacatccacacgtacacgcctacatggaagtggagggcctgagtattacgagacgacggtccgtttacttcgtgcgcggtacggggcgtggatggtagttattagg

SEQ ID NO: 229875 - DNA, 508 bp, Homo sapiens
  misc_feature: GYAE6OF02GCA1R.23.35.D02.1.454.CMB.1.raw
  modified_base (224)..(224): a, c, t, g, unknown or other
  misc_feature (224)..(224): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccncagtgagggtctcctgcaaggtctctggaaacacattcccctgatgatgatatcaattgggtgcgacaggccactggactcggccttgagtggatggctacattagccctaattagaggcaggtgcggactagtgcagagaggttccggggcaggagtctccgatgacctgggacacactccacacgtacacgcctacgatggaagtggaggggcctggagtatttcgagacgacggtccgtttacttcgtggcgcggacggggcgtaggatggtagttatagg

SEQ ID NO: 229876 - DNA, 719 bp, Homo sapiens
  misc_feature: GYAE6OF02HQYH2.23.35.D02.1.454.CMB.1.raw
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncgagtgagggtctcctgcaaggtctctggaaacncattccctgatgatgatatctaagttgggtgcgacaggccacgtggactcggccttgagtggatggctacagttagcccaagttgacggctagtgaccggtactagtgacgaggtacggtacggggttaccggggacgtaacgggtacggttccgttacccgaagttaccgggtacccgttacgggggaaccgtaaccgtaacgttaccccgaaacccgtaacccggttaacccgaaaccgggtaccccgttaaaccgtaacggttaacggggtaaaacgggttacggggaaacgggggggtccccgttaagggaaacgggttaacgtttttaaccggaaacgggtaccggtaacccggggttacccggtttttaaccgtttaccggtcggtacccgggtaccgggggtaacgggggggtccggttagggtaagttacgggttaggttttaaggttaacggg

SEQ ID NO: 229877 - DNA, 621 bp, Homo sapiens
  misc_feature: GYAE6OF02I8YAD.23.35.D02.1.454.CMB.1.raw
  modified_base (223)..(223): a, c, t, g, unknown or other
  misc_feature (223)..(223): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctcctgcccaaggtctcgtaggaaacactattcccctgatgatgatatcaagttgggtgcgacaggccacgtggactcggccttggagtggatgggactacgattacgaccctaagttaggacggtacaaggtcggacgggtaacttagtcggacgtaaggacggtacgggttaccgggggactaagggtacgttacctaccgtacgtcggtaaccgtacgggaccaccgtacgtacccacgaccgtaccacgtcctaacagtacgggaagtcggacggggtcctaggacgtacgttacgaacgtaccgtacggtaccgttttacgtcgtacggtaccggtacgggtacggggtcgttaggtacgtacggttaaggttacgttacggg

SEQ ID NO: 229878 - DNA, 586 bp, Homo sapiens
  misc_feature: GYAE6OF02F4EL1.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccgcagtggagggtcctcctgcaaggtctctggaaacacattccctgatgatgatatacaagttggggtgcgacgacggccacgtggacctccggccttggaggtggagtgggactacagttacgaccctaagttacggaggctaggtcgacgggtactagtggacgaaggaggtacgggttccggggacaggtacgtccgtaccgacgtcgaccgtagggacacgactaccacaacgtacacgtaccctagagtaggaagtggacgggcctaggagtacgttacgacgtaccgaccggttccgtttaccgttcgtacggaccggtcgggacgggggtcgtaggagttaggtagttagttacgg

SEQ ID NO: 229879 - DNA, 528 bp, Homo sapiens
  misc_feature: GYAE6OF02I5QLI.23.35.D02.1.454.CMB.1.raw
  modified_base (225)..(225): a, c, t, g, unknown or other
  misc_feature (225)..(225): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctgggggccncagtgagggtctcctgcaaggtctctggaaacacattcccctgatgatgatatcaattgggtgcgacaggccactggactcggccttgagtggatgggctacattacgcccaattagaggcaggtgcggactagtgcgagaggagggttccggggcaggagtctccatcgaccgtgggacacactccacgacgtaccagcctacagtggaagtggacggggcctggaagtatttacgagtacgaccggtccgtttacgttcgtcggtcggcggacggggtcgtaggagtggtagttagttagg

SEQ ID NO: 229880 - DNA, 519 bp, Homo sapiens
  misc_feature: GYAE6OF02FZFYT.23.35.D02.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctccgtgcaaggtctntggaaacacattcccctgatgatgatatcaattgggtgcgacaggccactggactcggccttgagtggatgggctacattagccaattagaggcagtgcggatatgcagagaggttccgggcagagtctcatcgacctgggacacatccacacgtacacgtcctacagtaggaaggtggacggggtcctaggtacgacgtttagaacgaccgacgggtccgtttacttcgtcggcggcgggtaggggcgtaggagtggtagttagtacgg

SEQ ID NO: 229881 - DNA, 514 bp, Homo sapiens
  misc_feature: GYAE6OF02HSQAH.23.35.D02.1.454.CMB.1.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
  modified_base (378)..(378): a, c, t, g, unknown or other
  misc_feature (378)..(378): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctcctgcaaggtctctggaaacacattccctgatgatgatatcaattgggngcgacaggccactggactcggccttgagtggatgggctacattacgccctaaattagaggcagtgcggactatgcagaggtagggttccggggnaggagtctccatcgaccgtgggacacactccacaccgtacagcctaacagtaggaagtgacgggcctgaagtattacgagtacgacggtccgtttactcgtggcgacggacggggcgtagagtagtagttagtagg

SEQ ID NO: 229882 - DNA, 561 bp, Homo sapiens
  misc_feature: GYAE6OF02IRQDC.23.35.D02.1.454.CMB.1.raw
  modified_base (223)..(223): a, c, t, g, unknown or other
  misc_feature (223)..(223): n is a, c, g, or t
  modified_base (286)..(286): a, c, t, g, unknown or other
  misc_feature (286)..(286): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctcctgcaaggtctctggaaacacattccctgatgatgatatcaagttgggtncgacaggccagtggactcggccttgagtggatgggctacattacgaccctaagttagaggcaaggtgcggtactatgcaggaggacgggttccggggcaggacgtcgtccgagtcgaccgtgggacacactccacacgtacacgacctacagtaggaagtggacgggcctaggagtacgtttacgaacggtacgaccgggtaccgtttaccgttacgtcggccggtaccgggtacgggggtaccgtggaagttacgggtaggtttaacgttaggg

SEQ ID NO: 229883 - DNA, 593 bp, Homo sapiens
  misc_feature: GYAE6OF02IO1K8.23.35.D02.1.454.CMB.1.raw
  modified_base (225)..(225): a, c, t, g, unknown or other
  misc_feature (225)..(225): n is a, c, g, or t
tcagacgcgagtatcacgaccggtgctcgatttagcacacgatagttgggtttgggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccncagtgagggtctcctgcaaggtctctggaaacacacttcccctgatgatgatatcaagttgggtgcgacaggccatggactcggccttggagttggatgggactacgattacgaccctaagttacgaggcaggtcgcgggtaactagtgacaggacggtacggggttccggggactaaggtacgtcgtaccgtagtacggtaccgtacgggaactacacgtaccgacgtaccgtacacgacctacgagtacggaaggtgggacgggtccgtaggtaagtacgttacgaacgtacgtaccgggtccgttttacctcgtcggccggacgggtacgggggtcgttaggaggttaggtaaggttagtacggg

SEQ ID NO: 229884 - DNA, 648 bp, Homo sapiens
  misc_feature: GYAE6OF02H2T92.23.35.D02.1.454.CMB.1.raw
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctccgtgcaaggtctctaggaaacacacttccccngattgattgatatctaagttggggtncggacaggccacgtgggacctcggtccttggacgtggagtgggacttacgtattacgaccctaaagttagaggtcaggtgcggtaactagtgacgaaggaggtacgggttccggggacgaggacggttctaccagtcgaccgttacgggaccacgaacttacccgaactaccggtaaccaccggtaccctaacgtaacgtaggggtaacggtagggaccgggggttaccgtacggtaaggttaactttaccgaacggtaccggtaccgggtacccggtttttaccgttacgtacggtccgggaccgggtacggggggtccggttaggacgtttaggtacggtttaattacgggg

SEQ ID NO: 229885 - DNA, 499 bp, Homo sapiens
  misc_feature: GYAE6OF02GQUAW.23.35.D02.1.454.CMB.1.raw
  modified_base (418)..(418): a, c, t, g, unknown or other
  misc_feature (418)..(418): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccgcagtgagggtctcctgcaaggtctctggaaacacattcccctgatgatgatatcaattgggtgcgacaggccactggactcggccttgagtggatgggctacattagcccaattagaggcagtgcggactatgcagagaggttccggggcagagtctccatgacctgggacacactccacacgtacacgcctanatggaagtggaggggcctgagtattacagacacggtccgtttacttcgtgcgcggaggggcgtagagtgtagttagttagg

SEQ ID NO: 229886 - DNA, 533 bp, Homo sapiens
  misc_feature: GYAE6OF02HL59L.23.35.D02.1.454.CMB.1.raw
  modified_base (414)..(414): a, c, t, g, unknown or other
  misc_feature (414)..(414): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctagaagaagccgtggggccgcagtgagggtctcctgcaaggtctcgtggaaacacacttccctgatgatgatatcaattgggtgcgacaggccactggactcggccttggagtggatgggctacgattacgacccaagttagaggtcagtgcggactagtcgacaggaggtacggttccggggcaggacgttctccgagtcggaccgngggacacgactccgaacacgacacgcctacagtaggaagtggaggggcctaggagattcaagtacctacggtcctttacgttctgcggcggacggggtcgtggagtggtagttagtcgg

SEQ ID NO: 229887 - DNA, 581 bp, Homo sapiens
  misc_feature: GYAE6OF02INWLA.23.35.D02.1.454.CMB.1.raw
  modified_base (223)..(223): a, c, t, g, unknown or other
  misc_feature (223)..(223): n is a, c, g, or t
  modified_base (474)..(474): a, c, t, g, unknown or other
  misc_feature (474)..(474): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctcctgcaaggtctctaggaaaccacattcccctgatgatgatatcaagttgggtgcgacgaggccagtggactcggccttgagtggagtcggactacgtattacgaccctaaagttaggaggactaggtcgacgggtaactagtcgacgaggaggtacggggttccggggactaggtacgttccgtaccgagtcggaccgtagggaccaacacctaccaacgtaccgtacacgacctaanagtaggaagtgggacgggcctaggacgtagttacgacgacgtaccggtccgtttacttcggtcgccgggacggtacgggggtcgtaggacgtaggtagttaagtggg

SEQ ID NO: 229888 - DNA, 645 bp, Homo sapiens
  misc_feature: GYAE6OF02JLMQ3.23.35.D02.1.454.CMB.1.raw
  modified_base (199)..(199): a, c, t, g, unknown or other
  misc_feature (199)..(199): n is a, c, g, or t
  modified_base (274)..(274): a, c, t, g, unknown or other
  misc_feature (274)..(274): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagacgcgagtatcacgaccggtgctcgatttagcacacgatagttgggtttgggggaggcgatcactcaacaaccacatctgtcctctagagagaaccctgtgagcacagctcctcaccatggactggacctggaggatcctcttctggtggcgagcagctacaggttcccactcccaggtgcagctggagcagtcngggactgagctgaagaagccgtggggccgcgagtggaggggtctcctggcaaggtctctggaaacacattccccngatggaatgatatacaagttggggtgcgacgacggccactggacgtaccggccttggacggtggacgtgggactatacgttacgacctaagtaggtaggcgtagtcggacggtaatcncgganaggacggtaggggtaccgggcgaggtacgtctcgtagtacggtaccgtaggggtacacgtacctaccgaacgtaccgtaccgacgtacccgtacgaagtaccggggtaaggtacgggacggggtacgtaggtaaggtatttaccgacggtaccggtaccggggttccggttttaaccgttccggttaggaccgggtacggggacggggggtcggttagtacggttagggttacggtttaaggtacggg

SEQ ID NO: 229889 - DNA, 586 bp, Homo sapiens
  misc_feature: GYAE6OF02JE4FP.23.35.D02.1.454.CMB.1.raw
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccncagtgagggtctccgtgcaaggtctctaggaaacacactttccccgngatgatgatatcaattgggtncgacaggccacgtggactcggccttggagtggatggctatattacgaccctaagttacggaggctaggtgacggtactagtgacgaggacggtacgggttccggggacgaggtacgtcctaccgagtcgaccgtgggacacacgtacccaacgacgtaccacgcctaacgagtagggtaaaggtggaacggggtacctggaacgtacgttacgaagtaccgaccgggttcccgttttaccttcggtcggtacggacggacgggggtcggtgtaggtaggttagttaagttaggg

SEQ ID NO: 229890 - DNA, 625 bp, Homo sapiens
  misc_feature: GYAE6OF02HP2EN.23.35.D02.1.454.CMB.1.raw
  modified_base (223)..(223): a, c, t, g, unknown or other
  misc_feature (223)..(223): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctccgtgcaaggtctctggaaacacacttcccgtgatgatgtatatcaagttgggtgcgacgaggccacgtggactcggcttggagtgatggctacagttacgaccctaagttacggacggtacaggtcgacggtactatcggaccgaggtacggtacgggttccggggactagggacgttactaccgaagtcggacccgttagggaacctaccgtaactacccgaaacgtaccggtaaccgacgtacccgtaactaagtacggggaacggtacggacggggtacctaggaacgtactttacgaacgtaaccgtaccggttaaccgttttaccgttcggtacggtcggtacgggtacggggcgtaggtaaggtgtaacggtttaagtacggg

SEQ ID NO: 229891 - DNA, 666 bp, Homo sapiens
  misc_feature: GYAE6OF02I0J8X.23.35.D02.1.454.CMB.1.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
tcagacgcgagtatcacgaccggtgctcgatttagcacacgatagttgggtttgggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccngagtgagggtctcctgcaaggtctctggaacacattcccngactgatgatatcaattgggtagcgacagggccactggactcggccttggagtggatgggctacgatttacgaccctaattagacggcagtcggcggaactagtggaccaggtaaggtacgggttccggggacgaacggacggttacgtacccgtaagtacgaacccgtacggggtaaccaacgaccgtacccaaccgtaacccggtaaccgaaccggtaccttaacccgaagttaacggggtaaagggtcgggtaacggggggtaccgtagggtaacggtaacgttttaccgaaaccgtaacggtaaccgggttaacccgttttaaccgtttccgtacgtacgggtaccgggtacggggggtaccgtagggtaagttcgggttaaggttaaggttacggg

SEQ ID NO: 229892 - DNA, 530 bp, Homo sapiens
  misc_feature: GYAE6OF02FP76O.23.35.D02.1.454.CMB.1.raw
  modified_base (224)..(224): a, c, t, g, unknown or other
  misc_feature (224)..(224): n is a, c, g, or t
  modified_base (513)..(513): a, c, t, g, unknown or other
  misc_feature (513)..(513): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagcctggggccncagtgagggtctcctgcaaggtctctggaaacacattccctgatgatgatatcaagttgggtgcgacaggccacgtggactcggccttggagtggagtggctacattacgcctaattagagcagtgcgactatgcagagacggttcgggacaggagtcgtacgatcgaccgtggacacgtactaccaacaccgtaccacgacctaacgagtacggaaggtcggagggctagaagtattacgagtaccgtacggtccgtttacgttcgtacgcgacggaggggtcgtagngtacgtagttagtacgg
